United States Patent 6,812,339 (POLYMORPHISMS IN KNOWN GENES ASSOCIATED WITH HUMAN DISEASE, METHODS OF DETECTION AND USES THEREOF) - sequence listing, part 69

SEQ ID NO: 16509 - DNA, 174639 bp, Human
  misc_feature (1)...(174639): n = A,T,C or G
ggggagtatttagctccaagacaaagtgtgccagcttctcctgtagacacccacatcatcaaagttagaggtaagagagactgacacaggatccatccatctttctgggttctggttggtggttctaggattcagcttgttcctcctccttttctccatttacatgcatcttcccacttcctgactgccagtcatgcaaacttcatgctccagcatgagacacaaagacaacagcctcacagagactggataatcacatctcacaattgtgtaaggttcaacttctggtggttttgcttccctgacaaaccctgatagagaatttggtagcagacaagattccaggggtatagaacctgaagaatgagttgtctaaacaggttccaggttacttggaattcatcctctgattttcctaatgccctgtttccaatggttaagaggacattagtattatgcagtggcaaacagttacacaaattatcacattgacacctttaatcaaatgcctatggaacgacggttggcaaactttttctgaaaagggacagatgataaatattttaggcattggaagccacatagtctctgctgcatacactccacctagactctgcatagtctctgtctctactcaactctgtggttgtagcacaaaaacaaccacagacatatgtgtatgaatgaacgtggctatgttccaataaaactttatttacaaaaataggggcaagccagatttggctcaggagtcatagcttgctgacttctgctatagaaggaaagctttggatgaacaagtatttgctgccatagaatatttcagtgaaaatacaaaccataatgggattgattaattgcttctaagtgtgctggagaacttcagaaaagaaaatgatgagctctgggctttacattcttagctcaaggtctatataaggaagctaaactcttctatgattaccctaaaagaattctgactgatacagtgatgactgaactaaaatcagtagatgttttgcaggctaactttaaaaagaagcaataaatttgtaggggagttaatttgggacatgccaagttggaggtgtcaatgaagcgtccaagtggtgacgcttggcagacagtaggatgcatagtctgaaactctgggagaaatgtccatttggaaatcactcacacgtactcaattgttataatcacaagaataaaagaggtaacaaggaaaatgagagagagagagaaagagagagagagagaaagagagagagagagaaagtgcaggaggctaaagcagaccctaagaaacccaacattcagtggagggacaggggacgaggggcccgtaaaagagcctgagaagttgaagaccccagaagagagtagcatcgccaagatcaaggaactggagtgtatcaagaaactgcgagtgaatgcaataaaactgcacatggcagaggttgagaaagtcctaagtcaaaattgaaacaaaagatccactgccttcaaaagaaacaactggagaggaaaggcaaggtgatgaatttttatgaggtgtgtcaccaggaacaccattcattccataagcattcctttctttaaagaggaatacctctcttaacagcttaactcagggtggtgcaaagaagctttttttttttttttgaagggttttttcaaatgtttattttatgtacaaagaactatcatgtttttaattgagtagatgccttggataatcctttgaaggaagatcgtttagaccagcttaatgaaacagacatccttcgcgtactgacggaaacactggcggcacatattgaggccgtatttcaggatcagacctgccggttcgaacacacgcgacaagagcaaagaagttaaaagagaagtgtctgtgtggctccttccacgtgggtgaaggactgtgccagctgagaggtggtagagcaggaagctgcctgaggacctccatttatttggtgaaaaactgggctccgcccttaagagagcaagtcgagggccgtgtaggagttggaggagagaaatgaaattttggaagagtcagcagaaggtgggaaatttttatttcatttacagcagtacagacttcatgcagccaaaagtatgaatgccctttcttctgtgacttacactgtaaagggagcatttctcttatgtgcaaactaaccatagtggacatgtttgtctacatccagaccagttcctagattcaaaacttgtctttgtttttgtttttgtttttttttctttttttgagatggagtctcaccctgtcacccaggctggagtgcagtggttctgtcttggctcactgaaacctccgcctcccgggttcaagtgattctcctgcctcaacctctggaatagctgggactacaggcatgaaccaccatggctggctagtttttgcatttttaatagagatggggtttcaccatgttgggcaggctggtctccaactcctgaactcaggtgatcctcccactttggcctcccaaagtgctgggattacaagcgtgagtgagccatggcgcccggccatgtatttgttttataaccatgagaaactaaaatcaaaagtctatttgtagattctcccagtgggttataaaatctggaatatttctgaagaaattatttctgctacacacacacagacacatacacagagagacacacacacagcgcaggtgacagctctttggtaactcaactatgaagtatagtttttagaatattttcactgatgaaagatcaaactacagtgattctgtgtgaactctggtgtgtatgcgtgtttctgtgtgtgttgtataaatatatatatatatttcaccttaaaatcagagaagaacctgattttgaaagagcaactgacaaattttatttccagggagattcgctgccaaaagggaaaaaccatcctgtctggtctcaccaaataccatctcccgtctattcgccactcagcaaccagagtgatctcttagaaacataattgggtcatatcactcttctgctgaaaactcccaatggagagtattcaccaaaatgttaacacaatcctttctgggtgtcttaatgctttgagaaaatgaacagtagattttcctcattaaaagattaggccctctgtcttaaggaggaggaggaagagaaggaggaataggaggaggaagagaaggaggaataggaggaggaagaagaggaggaaaaaggagaggaggagggggagagggagggagaagagagggaggagaaagaggaggaggaagaggagggaagaagccctactgcagattggacagcttcaaacaaaaatagcattacccctactcctacatttcattcattttgttatcccagggtgggccattttgaagttggtaagggtttattttaaaggattgggccttctcagagagagagtagacaatgataggcaaagatggggctctcttcttaggaggtatttcatactcccagtccctactagagtctgtgttgaaggtttctaaattttatttctaaccctgaagtctcactaggcatctattggaagtcatagtttccaatcaaatgtatagccttcagtttgaagcatttgaacatgtttaaagtcaaatttgccatttgtcctaaaatagcaggctcccttttcaaactaacttatctctgttaatgcaatattattctctaaatttacgcaggcataaaatctaaagtggagtcactcatctttgatttatcccttgtttaaaaagttgagatcaaatccacattacataaaattcagcattttaccaactttaaggtgcacaactcagtaatttttagtatattcacaatgttgtacaaccatcactactatccaattccagagtatttcccatatttcccaatttcctcctcccctcatcctggcactaccaatctacaatctgtctctatggatttgactattttggacatttctatagatgaaataatagaatgtgcagtcttttgtgtctaacttatttctttcagcataatgttttgaaggttcatccatgttgtaacatgcattgtatcagtatatcagtcatttttgtagttgaataacgttccattatataccacattttgtttatccccttatcagctgataaacatttggtttgttccattttcaggctattatgaataacactgctatgaacattggtgtacaagtttttgcgtgaacatatgtttttgaattatacattcaaaacgtacatgaacatccatttttggtatatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtacatacccaatttcttgggtatatccaatttggtatatacccaatttcttgggtatataccaagaagcagaattgctgaatcatacagtaactttattttcaactttttgaggagctaccaaactgttttccatagcagctgcaccatttcattcccaccggcaatgtatgaggattcccatttctccctatccttgccaacacttatttttccttttttttaattaaagccatcctggtggatgtgaagtggtatctcattgtagtcttaatttgcatttgtgtaatgactaatgatgttaagcatcttttcacatgcttattgatcatttgtatattttctttgcagaaatatctgttcgagtcctttgctcatttttaaattggattatttgtccttttattgttgaattttaagggttctttatgtattctggctactagactattatcagatatatgatttacaaatattttcccccgttctctggtttgtacttttactttcttgctagtgccctttggtgcactaaagtttttaattttgatgaagtccaacttctctatttgtcttttattgcttgtgctttttgtgtcatatttaagaaaccattacctaatctaaggtcacagagatttacacctgtttcctttgaaaagctttgttattttagctcttatagttagttatttgatcgatttttacttaatttttgtatacagtgtaagctgggagtccaacttcattctttgatatgtagatattcagttgtcccagcaccatttgttgaaaagactgtcctttctccccggaacagtcttggaaacctgttgaaaatcaattgtccacaggtggatggatttatttctgaactttcggtttaattcagttagtctatatgtctagccttatgcgagtaccataccctttagaatactgtagctttgtagttaagttttaaaatccagaattgtgagtccttcaattttttctttttcaaaactattttggttattcaaggtctcttgcatttccacatggattttaggatctgcttgtccatttctgcaaaaaccaaggaggcagtttgaatttttataagttttacattaaaactgcagagcaatttagaaagtactgccatcattttttcctctcttcttgtttcaatttgtttggtgttttgttttaccattttaactattttaagtattttaactgtacagctcagtggcattaagtacatttacattgttgtgcaaccattaccaccatccatctctaaaactgttttcctcttcccaaactgaaactccatacccattaaacagtaattccccattccttcctctcccagcctttgggaagcatcgttcttctcctttctgtctctgtgaattggactactccaggtacttcatataagtgaaatcacataatacttgtccttttgtgactgccttatttcacttagcataatgtccttaagtttcatccatattgtagcatgtgtcagaattttcatccttttcaaggctgaatattattctattgcatgtatataccacattttgtttatcaattcatccattgatagacacttggttgcttccaccttccagccaattgtgaataaggctggtatgaacatgggtgcacaaatatctatttaagtccctacttttaatgatcttagatatatacccagaaatagaattgctggatcatatggtaattctatttgtatttttttgaggaattgtcatattggttttcacagtggctgcaccagtttacattcctactagcagttcccaaggaatttaatttctccatatcgtcaccaacattgttattttctgttttgttttgttttggtttttaataatagccatcctaaggagtgtaaagtggaacaatgcccaaggattgtgttctttttgatgctgttgtgcatcaaattattttcctactttcattgttggattgttcattgctaatatatagaaatacaactaatttttgtatattggtcttgtatccttcaactttgaatagaagtagtgagaatagtaattttcttttttttcatgatactagggagaaattttcaaactttcaccattaagtataatgttagcagtgggtttttcaaagatgacctttatgagattgaagaatttcctttctttttctggtctggtgtgtttttaaatcatgaaagggtactggattttgtcaaatgctttttctgtatctattgagatgatgatttttttccctttatcctattaatattatattgattaatttttatatatcaaatcaatctttcatttctggaataaactccacttggtagtgatgtacaaggagacttcaaatgtttgtgaaaatggagttaaaaaatataaaatataaactaatttctcaacattaagctccatcaattcaagacacttttgtaagtgatgatactagccacttagttcatccctagagaactgagggtcctggaaatctgacgtcaatgccatttttttacattattaactgaagaaaaattggtgccttttacagattttttaaagattaagatataggaagaagtcagaaggagccaaatcaggactgtaagatggatgcctaatgatttcccttcagaactttcacaaaattgaccttgtttgatgagaggaataagcaggagcattgtcatggtggagaaagactctctggtgaagctttcctggtatttttctgctaaagctttgtctaactctcttaaaacactctcataataagcagatgctatcattctttggccctccagaaagtaaacaagtaaatgctttgaccatcccaaaaaactgttgctgtgacctttgctcttgaccagttcacttttgctttgactggaccactttttttgtttgtttgtttgtttgtttgtcttttgagacagagccacactctgttgcccaggctggtgtgcagtggcacaatctcggctcactgcaacctccacctcctgggttcaagagattctcctgcctcagcctcctgagcagctggaactacaggcatgtgccaccacacctggctaatttttgtgttttcagtagagatggggtttccccatgttgcccagactggtctcaaactcctggcctcaagcgacccacccacctcggcctcccaaagtgctgggattacaagcgtgagccactgcacctggcatggaccactttttacctcttggtatccattgctttgattgtgccttgtctttaggatcatactggtaaaactatatgtcatctcctgttataatcctttaaagaaatgcttcaggatcttgactctgcttgtttaaaatttcctttgaaagctctgctcttttgtgcagctgatctgggcacaatggttttggcacccatcaagtggaaagtttgcacaactttaatttttcggtcagaactgggtaagctgaaccaactgagatgtttatggcattgactattgtttctgctgttaatcgttgatcctcttcaattaggtcacaaacaagattaattttttcctcataaatggatgtggatggtctgccaccgtaggcttcatattcaatatcatctcatcctttcttaaaatgagttatccattgctgatttctttggggcgttgtccccataaactttttgtaaagcaccagtgatttcaccattctccaactcaagcttcactacaaatgtgatgtttgttcttgcttcaattttaacaaaattcatgtcgctctgatatgggctgttttcaaactgatgccttatctttcttagtgcctcaatctagatcttgttcagacatgttataagttagtacaagttcattttagtgcaaaaaattgaaatccatgcattctcttctcatatgtgttttccatgaacttttgaagatccctcagataatcattttcatatgctactgaagtcaatttgttagtattttgttgaagatttgtacatccatattcacaatggatattggtctgttattttcttttccctgttgtctttgtctggtgttagtattagggtaatattggtcttatagaaggtgttaggaagtatcccctgccctttatttttttaaaaaatctttgtgaaagcttaaggataattatttgaaaatttggcagaatttatcagtgaagccatccagtcatgggcttttttttttttttttcttgtctttttcctttttttcccccttttaaaacatggtcgggctgggcacggtggctcacgcttgtaatcccagcacttcgggaggctgaggcaggtggatcacctgaggtcaggagttcaagaccagcctgaccaatatggtgaaacctcatctccactaaaaaatacaaaaattaacctggtgtggtggcatgcgcctgtagtcccagctactagggaggctgagacaggagaatcgcttgaactgaggaggcggaggttgtggtgagccgatatcatgccactgcactccagcctgggcaacagagtgagactctgtttcaaaaaaaaaaaaaaaaagacaagatctctctctctgtcacccaggctggaatgcattggacaaatcatagctcactgaagcctcaaacttctggactcaggagatccttccactgcagccccccatgtatctagagctacaggtgcacaccaccatgctcagctaatcttttttaaatttttttgtagagacagggtgttgctatgttgcacagactggccttaaactcctagcctcaagtaatcctcctgtcccagcccaccaaagtgctggaattacaggcatgagcaccacagccagccttgttttgggtttttttgttggaagttttttgattactgattcaatttgtttactttttatacatctatccagactttctagtctttcttgagtgagttttagtactttgtgtgtttttagaaatttgtccattttctctagattataaaatttgttgtcatgcaattgctcatagtattgccttataattctttttatttctttaagattgatagtaaggtgcctgctctcattcctgattttcgtaatttcagttttctccctatttttctggtcagcatggataaaggattgcctattttgttgaccttttaaaagaaccaacttctggcttcattgattttctctaatatttttctaatctctttttcatttactttcactctaatctttattattttcttcctttttcttgctttgggttcagtttgcccttctttttctagtttctaaaaatggaagatcatgttgttgatttgagatctttcttcttttttaatgaaggtgttcaactaactgtaaatttccctctaagcattcttccaacattccctgtatcccatacatttttctatgttatgttttcatttctattcaccccaatattttctaatgtctcttgcaatttcttctttgacccactgttgtttaagagtttctttgtttaatttccatatatttaggaaccttcctgatttacatctgttattgacttccaacattttaaaagatggggtctcactatgttgcccagcaggccttgaactcctaggctcaagcagtcttcacacctcagcttcctgagtagctgggattacaggcacatgccaccacacccagcccaatttcatcttaatgtggtcagagaacatattttatgtaatttcaacattttaaaatttattcagacttgctttgtggcctgtcttatagtttaacctggagaatgtcccatattgttagatgtgtacatgtttatcattgttatatcttcatagtggagtgactcttttatcattataaaatgttcttctttgtctctcatgacaatttttgtcttgaagtctgacacatttgtctggttttaggatagccacttcaactctctttttgctactgtttgcaggaaatacttatcttttctcattcttttactttcaacctgtttgtgtctttaaatctaaagggagacttttacaaacagcatatagttggatcatgtttttttttgaaattcattcttctaacctctgccttttgagagctaattcattcacatttaatgtaattactgaaaagaaagggcttacgtgtgccattttgctatgtattatgtatatgtcttatatcttttttgcacctcagttcctccgttactagtttcttctgtgttaaatagacacttttctagggggccactttaattcctttaccatttcttttactacatacttttgagctattttcttggcaatttccctgggaattataattaacatcttaatttataacaatgtaattaggattaataccaacttttaatgttatacacaattttgttcctatatagttcagtttcttgctttatgctgttactgtcacaaattacttcttaatacattgtttttccatcaatataaatttataattattgctttatgtagctgtcttttaaatcagatttttaaaaagggagttacaaacaaaaatacattaataacatcttttatatttatctatgtagttatcattaccagtggcagtggttttttggttttgttttgtggtttttggttttgttttgttttgttttgtttttttgagatggagtctttacagagggattctgcaactttattggggcatgccttcagcactcagccgagcggtttacagttcggccttggccttcacttactgtttgctcaggtaaactagaggggagaaatcaggactttctctggtctttcttgagcatgtgaacagttctcggcatgcacatggccttctaaattcccagaaatgtaagagcttttcaaagtccttattcgccaaagcatctcatttaggcttttctcccaagatatttggttaatctattgtttgccccaactgttatccattgtctcagtagcaaaggctaaaacatttacttgtgttttcaacaaatgactccagatagtgactttagggctgggcaagctctgaaacaagataaaacatgacttttgagcccatctcttagggagtcaccagacaatcaaccaaggacaaatatttccaaatgacgacattcattctccttcttctggtactggtgctagaatgcaggctgttatcttcaagtggctatctgccactgagctggggagctagagatggaacgaaggcaagttataatgtcacaagtctgtccctcctatgaagactcagctatttttcctgaatacgtgttccctgagttgctgcaagcatttggttaatttccagggttctgaaaaagtagattctgatcatttttggcaaatttgtagttgcttttatgttggagttcattttcagagtaccttactctaccatcttcacagagaccacaattcaccatttttttatccactatatccagaaaatcaccaaagacagccagttattcctttaaaagtcacctttatctatttttcttaatcactaccaccaccaggcaggccttgagaggcaatttattatactatttaaaaccatcagttctggaatcatatgttggtgtttgaataccagctctaccacttcctacatgcatgacctggagcaagccaattaaaactttttatgcctcagttttaacatctgtaaaatgggataataaaagtattgctatgaggattaaatgagttaacacttgtcaagtgattagtactaggcctgcatatagtgaacactcaaaaattgttaggcactaaatgcatccagcaaacatttattaaagctaaatttattaagattatatactcatctctaggactattacaatgagcaagactgacaacaggtaagagctccacttttgtggagcttacgtgaaatgtcccaaacacttcatattcagattgcgatttctcagatgacttctgctgggaaacaatttctcattaatttctcatgtttcttcccatcttgtaagcagaggcacagatggccttatttttggactgtcttcctctggagcagagaacagatttgtttattgtacagtataataaaaatgtctttctccaaggcaaaggccaggcaggtatgcacacattccattatagaagatttgagtttcctaggcttgggattcctcagctctggcaaaaactcatgacatatacagcattgattctgcatcacctctgtggaatttgaggagcatggggaatggatatgaaactgacattcatgctgccactatgctatgattaatagagtcgtttgtctctgactcaggagtctcatgtcttccaccatcatccacgcaacaggataactttttagcttacatgcagagtaaaatctccagtgtttcagcttttgacaacttctagccggtatgctgttacaaaggtatcttccttaaacctaatttctactggttacatctaaatttctttatctggctttcagactccttcctacctactcagctgaatatctatttcttcttgaagaagactttctgcttcatagaccagtattttcacacgtatactgtgatgttcctttctacctctgacattaggctcaaattccactccacccccttttgttggaattcctttcctttccccttttttcctatttagtcaactcaaatccatctcttaacacctgtatcaagtccaaaactgtcaagaaacttcctcattgatcactctttctgcaaacatctgtagaacttaagaacctatacaaagagcttgaatatatattgtgttattttctagtggttccatatgggcatgcattgcttccccattctgactgtaagcaagaagaggagtgcaggcacaaagcagaaatggaatgtgactgattggaatggttacgtgcatatgcactaaagccagaattcccagatttagatccccaccacttattagctatgtggccttgggcttattacttaacttccctatgcctcagtttctccatctttaaaatagaaataattataatgataatacctatctcatagacttcttgtgaaaattgaattaacacacataaaaacatagatcaagttagaaacatcccggagtttagaactgtaagaacctgtggaggtatatagtattacagaggaatttgaaaaacctttcttaaaaacctctcaaacctaccagataaaaaattaaaaacatcttttgtttgacaaaaaatataggaaatattccaaagtcaaaggtggcatggcacaaatctaaagaggagggtgaatgctaaagctggtagctgttctagaacatttgctggtccacagtaatccagagcatttgtttcagtggccacttggctacaggacaataagtctcaggtctacacaaattcaaaagtaagattagaaacccaaacatttatccaggattgcaaaggatcatatgctcagtgaataattaaaagagacacacatatacccctcaaaggaatatggtgaaaaaataatggcacttggtacaaggtccaaaagtcttctcttgagaatttgtaaccacatgtgagacttcaaataaggttacagcctgaattcacatttccttcatgtttcttcaaagtgattcaggttggtagaccccaagcccctggcaaaagcaaacacaaattctctctactcaggaatctaagaatctaaaaaagttccaaagaatgttagctcacaatttacaaaagtcacaaaatacacaaggaaacaaaattccctgagtaagggacagcagaaacaccatgtaaggaaaaagtgacctaccgagactttaaatgtagttattaatggctacagaatattttttaagtatatataacacatttaaaagtaagagaactaattgaaaacaggagaaaagaaaaagaggctatcaaaaatgatcaggcaggcggggcacagtgactcacacctgtaattccaacactctgggaggcagaggcaagaggatcagttgaggccaggagttcgagactagcctggccaacgtgacaagaccctgtctctactaaaaacacaaaaactagctgagtgtggtggtgcattcctgtagtctcagctattcaggagactgaggcacaagaattgcttgaacccaggaggctgaggttgcagtgagccaagattgtgccactgcactccagcctgggtgacagactgagactctgtaaaaaaaaaaaaaaaaaaaaaaaaaaaaattaccagacatatttgaaaaataaccaaatagttccagaaaaaaaatttttaatgtaataattaaatttgaaactctgtggacaggttaaatagtagactcacccagaagaattagtaaattgaagaatagctgaagaaattttacagaattcagcttagagaaatcatgaaatggaaactacaaaatattaagaaacatggagaatgaagtgagaggtatgtatgtatctattcaccttcccaaaagagggattaaaaaggtaatattcaaagagatactgtcttttcaacaaatggtgttgggaaaactggataataacaaaagaataaagttggatgcttaccttataccatatacaaaaaataactcaaaatgggttaaaggcctaaacataagaattaaaactataaacctcttagaagaaaacataaggggacaagcttcacagcattggatttggcaacgatttcttggatatgacaccaaaagcaaaggcaacaaaagaaaaaaatcgataaattgaactacatcaaaatttaaaacatttgtgcatcaaaggacactattgatggattgaaaaggaaactcacagaatgggagaaaatatttgtaaatcatgtatgtgataaggaattaatatataaaacgcacaagaaactcctgcaactcaacaatgacaacaacaaaatacccttgatttttaaaaagggcaaaggacttcagtaaacgtttctccaaagagatatacaaatggtcagtaagtaaataaaaagatattcaacatcactaattattagggaaatgcaaataaaacccacaatgagatatcactttacacttataagtatggctattaccaaaaaaacactcacacagataacaagtattggtgaggctatagagaaattgaaattattgtgcactgctgatgtcaatgtaaaattgtacaagtgctatataaaatagtatggcagtttctcaaaaaattaaaaataaaattatcatatgactccccagaagaatagaaagtggggacttgaacagatatttgtacacccatgtttatagcagcattactcacagttgccatagggtggaggcaacccaaatgtgtatagatggatgaatggacacacaaaatgtagcatttacatacaataaaatattatccagccttaaaaggaaaggaaattccaacacaagctacgacatggatgaaacttgaggacattatgctaagtgaaataagtcagtcacaacaagatgaatattgtatgattccatttatatgaggtacttagaattgggatagaaagtataatgggttgccaggggcttgagggagggaggagtggatagttagtgtttaatgggtataaagctttactctgggaagctttttaaaaagttctggggatgaatggtagtaatgattgcacaacaatgtgaatgtccttaatgtcactgaactgtacacttagaaatagttaaaatggtacattttacattatatatatgtatgtacatatatattaccaaggttttttcaaaacttggggaaaaataatggttgagaattgttcagaactgataaaagatgcaaatattcaacttaaggaatcacaaagaatccctcataaaacaaatacatatctagacactttgtaaaatgtctttgtaaaaccacagatctacaaagagaaatgttaagactagttagaaagatattacctacagaggaatgatatttagactgacaactgatttttcaacaccacagtggaaggcagatggaaaagcatcatttcttcaaaagactgaaatgaaaaataagtttacctaaaaatgtatatattttaaaaatcttacagaaggccaggcgtggtggctcacgcctgtaatcctagcactttgggagtccgagacaggcagatcacgaggtgaggagatcaagaccatcctggctaacacggtgaaaccctgtctctactaaaaatacaaaaacaattagctgagcatggtgggacccgcctgtagtcccagctactcgggaggctgaagcaggagaatcgctggaacccaggaggaggaggttgcagtgagccgagatcacaccactgcactccagcctgggcaatagagtgagactccattaaaaaaaaaaacttacaaaaataaggaggaaaataaagaaaattttggataattaaaaattggaactttactaataaacccaaatgaacttctaatgaatacattctgagaagtagaatgatatcagaaaaaaggtttgagatgctagaagggatactaaacaaatagcctgacaaatatatagacatagacagaaatctaaaaacaattgattatataaaacaataagtaaaatagctaatttatgggataagaagtaaaacaaacagaaatgtgaacagtgacagcataaaaattgggggagattaatctgagtaacagcactctaagcttccttaaattgttagaagagaaatgtatcaaatagctttagcctgtattaagaaaattatgcatgttaagatttctagagtaaccattataagaatagaacatctattaaaggggaaaaaattgaataaaggcatagaatctgaatccaaaagaaagagagaaaggaataggaataagcaaacagaaaaagcagaagaaatagaaagtgcacatttagataatagaaattaatttaaatataacagtaattacaataaacagaccaaactctttgggttaaaaaagtcaatatggaaatttttttctttttgttttgagacagggtcttactccactgcccaggctggagtgcagtggcgcaatcttggctcactgcaacctccatgtcccaggctcaagtggtcctctcacctcagttccctgagtagcgaggactacaggcacgtgccaccactcccagctaatttttctatttttttttttttgtcttaagacagggttttgccatgttgcccaagctggtcttgaactcctgggctcaagcaatccacctgcctcagcctcccaaagtgctgggactacaggcataagccaaagcacctggagggaaataatttttaaaaagcactttttaaaatccacatttgctatttataaggtgaacactcagaacaaagagacaaagaaaggttgaaacttaaagaatggcagtgtagtaactgaaagaaagcttgtgtagttataatacatgactatcagacaaaaattttgctaaaataaatgggttactacataaccatcaatgtttttatttcccaggaagatataaacttcttaactcttatgtacctaataaaatttaaactatataaagtaaaaaatgacaaacttacaaaaaaattgacaaatacaccaccattgtgacagattctagcatacctctttcagtaactgatagaatctctgcttaaaacatctacaggggattatttaaacaacaccataagtttgatccaactgattatatgtaaaacgtagtaacaagtgaaaagtatacttttataaaaatcaagcatatatgaggtcataaattatattctaacatattaaaaataatcagtttcccagagaccaagttctctgaacataatgcagttaaattacaatatatatccagttttaaaagataatttttaaaaaacatgtatttaaacttctttagaatttgaaaatatttaggactaagtgataaataataataatgaaaatacatatcaaaacttgtgggatacaactaaactagtatttagagggaaatgcacagtcttaattgcctatatgagcaagaaaaaatacaaatattaataagataatcaactaacacaagaaattaggactaaagcaattaaaacagattcaaagaattggaaggaaggaatttattcatgcattaaactaatgtttattgaacacccactattaggcatttacgattcagcagtgacctaaaaaaaatcctattctttatgaaacttagtgcctccaaaaccaaatatggaagtcagcataatactggtcatcaagagatttgagttgcagtccaatttttccagtacccagctgtgtgtctttaggtaaatcattttttctcactttgcctcctttttcttatctggaaaggagatcataatttctatcctatctatcatgatataatcaaatggtatccaatgacacaaactatattttgggaaagtataagcattatgcaaatataaaattattattattaatatttaaaacatccatgttccttttgctatcactgccttcctggtcttagggaaataaaatgactgcttcatttaaaactttccttccttcaattggctaaaagccataacatgagtctagctatgaggtggcttcaaatcttaatgctgggagagactgagtgttgagtgttactgtgaaatcaaagatgcagcataaattactaagtctactctcatgtatgccttgtatttctgcaactctgaacagtggaattttcacagtaggatttagcacttatcagttgtcctgtcccacacttcaagatcaaaggttcttgacacatcaaacactgagttaaaaattgccgctcagagtaggcaatttttttcattcaacactcttttactgagcattgcttatgtgttaggtaatagactgagcattggaagctcagagattacaatatagttggtgaggctgacaaaattgtctagcattctcttagcatacttatctaaacacatgagatcacaagagaagactccccacctacatacaagcccaacctcgtcttacaatctttagagctgaactaacaaagagagtgaggtcaatcgttctcagccttttggctaaaatctagaatggagagtgagggcagaggtagatggtcctggtctcatttattgtttctgtatttctaaggcctaaggcaggggctgatattcactaagttcttaacaaatatttgctgggtaaatgaatagactttgtggaacagattgaaagaagcccttggtagcaggtacacaatatccaataaatactttttaaatgttttacttattaattagagacagggtcttctgtcactgaggctggagtgcaatggcacgatcatagctcactgcagcctcaaactcctgggctcaagcactcttcctgcctcagcctcccatgtagctgggactacaagcatgcctcaccacatccagctaattttttttccatttgttggagagacagggacccactttgttgccggagctggttttgaactcctagcttcaagtaatgctccagccgcagcctccaaaagtgctgggattacaggcacacaccacagcacctggctgggtaaatagttcttgatcgtcttagagaccaaggaaaatgtatccagccaatttctctccatcctcccaaatccttgccaggcctttcctcttgcttcaggacctgtagcccaatttgctcttcctcctgtaacaaccgcaccagatctctggctggtccagaagtcaggtgaaagagtactgtcatcctctgaaagcccatcctttactaggctgagttttgctttgtgtccagcgaacaaggctgacttgaaagaggaccataccctgaagaagaaaataataggactttccatcttcaaagctcctccctacacaattttgtttgttggtttgtttgtttgtttttgagacagggtctccctctgtcacccaggctggagtgcagtggcacgattgtggctcactgcatcctcaacctcccaggcttagatgatcctcccacttcagcctcccaagtagctgggagtacaagtgcacaccaccacgcctggctaatttttgtattttttgtaaagacggggttttgccatgtttcccaggctggtctcaaactcctgggctcaagcgatccgcttgtctcagcctctcagtgctgggattacaggcgtgagccaccgtgcccagctccaatcattaattttagatggaggatctggtggccagctggcagctattattaacatgtgacacagaagcagattgtgtatgtattgggggaaggagggaggaagggaggaggaaatacagactgagatacagaggtcatagtctccacatcaaggccacatggtcaggtcaaacacagagcagaaggtcacagaattttattcaatcataggccattactcttctctcctactgctcactactatagaattttttgtaatttttccttctcatttatggaagtgtctcttaatggagtctttctctcatatgtgtgtgtatttgtgtgtatgtgtgtgtacgtataattggaagagggccctgtgttgggtccattctgtcagaagtatgtctgaatttaatcccctttctccattcccacggctatagtcctaactcagggccaagcatttttggcccggactttttcaacactcctccccatctcctccttgcccctggcctctccctactgcatttaccctccctactgacaccaggtcatccctagtttaaatttctgcttacgatagaattcaaaccctccacactctgaacccaaattaacttttcaatcttttttctcaactgggacagccaccccaccctgtgattcaataacatcatatgtgtctccaggtctttgcttgtgccatttcttttctatgagatggtcttttcttgtgggcaacgtggacaaatcttagctattcttcagatacgccatttcctctgtgaaatttgttctgaccccaccacttcttcccctatgttccacatccatatcattttgtacataacccttagaacagcacttcagtatttcaatacagttatgtgtctgtttcctcaaccataataggaggtcaagaattataccttatctttgacccctagaacctgttggtagagttcagtaagagttttaaaactgttgtctgtgtggttaaattaaacaaataaccatagaaataaaatgttaatcattattggtcatgtacacctgcatttgtgtccatcagatttcctgaacaaaaatcaaaatgtgtggtctgaaaatgtgacagatgatttggaagtggaaaatgtcctagaaaatttgtgtcatgcttgtcccatacttgtgtcccataaacatcccaccaacatttcaggactaaaattgccaatattccctccctctacctaaacccactgccatgtttcaaatgaaagtaatccattgtgaatccaagaaaataaattgcctctatattgctgtttacttctctgcctggatcaggaggccatacacctttctgttcctcttgataggctggaagactaaaaccaagattagctttgaattactctgctttctttggtttgcttttagttctcaatcaatcaagtattttagaaaagcccaatacaagtagatgcttagccttgtgctggtagctattgccaaaaagatacattgattagtctcttactatgtaccaggtactgggttaagaactttagatagattatcttttgaaattctcacaacagccttttataaattattattataatgtcaatattgtggatgagaaaactaaggcttaaagagagtaagcagcgtactcaaagtcctacacagctagtaagtaagcaaaactaactttaaacccaatactgaggctgggcacagtggcatgtgcctgtagttccagctactcaggtggctgaggcaggaggatcgatttagcccaggaggttgaggccacgatgagccatgattagcaccactgtactacagccagggcaaaacagtgagatcctgtctcaaaaataaataaataaataaataaataaacccagtactgaagtctgtgctcttaacaacaagcagcttactgtctatctggggagataagacattcacatatgaaataattggaaaacagtattccttgaaatgtcaggatgtggctccttaagttctccaaggccagattgagatttgtttttctgaaccttgagggacattcgggagaaacgagcctgagttttatataacaaaataaaagtttacaagagccctgagttatatacaataaattcagtgatcgaaggtgtagggtaggtagacaagagaattcatgggaaaatgcctccagagctaataacttgtatttgtcaaacactttccagttcacagagcattttcacgtatattatgtcacatcatcttcacaaccctgtggaatacaaattatctctattttacacgctaggacaaagcattgattaagtagcttgccccatatcatgaataaatgttccaaagtggtcagtatgcagactcagaccccaacctctgcctcccagcaactatattttctgctatgactcactgtgactcaggactcaagcagcccagtgtccagtctggctgctcttcccaggagctttcccacctggcctccttctgctcaatgggtcctgctggagacccttccattggtccaactggtggtctctaccaactgccacagaagcttccaacagccacattccacccatccaacccttctgccattagagaaccaggaattccctgttttggggggtagagaattggacatactcataaagccttaagctcctaaaactcatgactatctttttactcctgcctcaagttttacacataaatcaatgaaaatctggtcattgtgtggctttccaagccatttggacattgtgaaacttgaaatgagagaaacattgaaatttctggaactctacttctgagtaccttattgccttttcccattccctaaccttccctgtgatagtcttaacattcctgctgtcaataaatatttatcaagcacctgttaggtgccagaaactattctaagttgggagtataggcctagcttggtggcttatgcctatattcctatttgggaggctgaggtaggaggatcacctaagccccagagattgaagatgctgtcagccatgatggcaccaccactgcactccatcctgggcaacagagtgagaccccaactcttttttttttttttttttgagacggagtctcactctgttgcccaggctagagtgcagtggcacgatctcggctcactgcaagctccacctcccgggttcacaccattctcctgcctcagcctcccaagtagctgggaccacaggcgcccaccaccacacccggctaattttttgtatttttagtagagatggggtttcaccgagtcagccaggatggtctcgatctcctgaccttgtgatccatccgcctcggcctcccaaagtgctaggattacaggcgtgagccaccacacccggcctgtgagaccccaactcttaaaaaaaaaaagttacttaggtgaatgcatcactgatcaccccagaaaaagccccccatgcttgctatcatgaaacttgcattacagtcaggacagactaactaaataattaacatgccaaatggtgatggacattgtgatgaaaaataaacttaggaaattaactggtggaatggggtctatgttggaaagaagttggtcagggaaggcagatttaataagacacctaaatgcagtaagggaagaagcgaagccaattggccctcaagagaagggttttccaggcacagagaacataatgcaaaggccctaagcttcactcatacttaggttattcacagaatgggaaggaggccagtgtggctggagcagaatgaacaaagcgggggagtgtggtagaagatgaggtcagagtgagcaagtgagggacctgattttgtaatgcctcataggcccatagaagattgttgtttttcaggcattcaacctcgttcaaacaaaccaagcaattattttaggccagaattgttgggtgctgatgatacagagatgaataagacaaaggcgttactgtcaagaagctgagtctgatgaagaacagagacaagtaagcagacagctatatcacagtgtaactggtactgcaagagggttaagccctgattcctgtagtaacatatggagggcacctactgcagatgggatgtcagagaaactgaagtctaaacctgtgccattcagaatggggtgattaaagatgtgaaatgtgactagtatggctggggaaccaaatgtttaatattaattaatttaaatataaaactgaagcagtgtgaagcatttttcctttaaattcaaccttacagttttggtaggactacttctacttttgtcattgcatcccataagatttcatgattgttttgttagtgctcatgtactttttacttctactttcaaaaaatgtggctactacaaaatctacaattaaataaatatgtggctcacattatatttctactggacagcacattatatttctactggacagcactaatctaaactcaaagtggaagagacaaaccagggatgtagaagaaacctcaaggcagagggtctacatgtgccaacgtccagatcacaaagagagcatggcaccttcgaggaggaacaaataactcagaatgatgagtcctgaagtgccagcaagcaggtaggcggagatgaggaagaaaaaataaacagaagttgggtctgaaggtctcgtgtgttatttaagggaatttgaacttcattgtgagtataacagggagctaccgagggaagacacccagccagctgggattgttgcaaaggtcattctggctatcatgtggagcatacactgaagtggggcaagaatggaaggaggaaaaccagttagtgctggttgcaaaaatgaggcaagagtcgggggcagtgacagtggagaagagagaagtgggctaatgtgagacattatgagaggtcaagttggctagacttgtcattggataggtatgaagaatgagggtaacaggatggcttaaagatcagtccctaacactgtaggctctgaggagcaaatgactactgccctccaaagctgggtgtccaagcaaatgactgagctcctaaagggatgcggggtgtgagggctgacttcagtggccatatttccccctgaccgtaaacattatgaataaagaaacatcacctggaatttcacctgggcatcttgtttgtctttgattagtataatttttggaagttaatgtattccatgctgccaggtacactgctccagcattttcatttcctttgatcagatgatggttaagtgacaagattatatctctcaaaaataatctcaggaaaggagaaatgtacttggggttcttccttctcctccaatggcaaacagggaacataaattaaatagagtcacactccatctcagcaacccaggggcgtgcccaggttttgtggagcctaaaatttatatagttggtggttgggttttttttttttttttggaggggggaggaggaagggtctctttaagtaaaataatacccaattatgaatttaaaatcactaggtaggttctcatgcaaatgaggggccctgacacttaagcttcattagcgtcatggtatatcgatagttttaggaggccatattttttcatccattgaacatgtatcagctgatgggttatgggcactgagcaggacatagggatataaacatgaataagaacagacataggccccgccctcaagaagtccaccatttaaagcaggagatagataaataggtcattgtagaactacattatgaatgcagttataagagctctatccacagagtatagtgggtgcagagaggaggagaactcaactcacctgaggtgaaaggtgcttgggtatcttacaccagcaggatgtgtaagatacgtgaattacttaaacactaggtagaaaataggttttggataatattttgtgccccatgaagctggaaactttgtcagctaaaagtagaaaggccttaaatggcaaatccagttcttgctaaaagtctcatcactgccaagattaactctgtactactagctggagattctccccagaataaaatgacaatcctattgtggactgaactgtgtccccccaaaattcatctattgaagccctagccccaaaggtaactgtatttggaaataaggtctttatggaggtaactgaggttaaatgaagtcctgagggtaggaccctgagctgatagtttgggtgtccttataagaagaggaagagacaccagagacatatatgtgtctctctgtcactcttactctttctctatcttccccaccacaacccccaacctctgcagggcagtggaaaggcagaggaaaggccttgccagaacatactgacaaagtgactctctgtaagccaggaagagagtcctcaccagaaaccaaattttctgtcaccttgatcttggtcatccagcctccagaactatgaaaaaataaatttctgttgtttaagccacccagtctgtggtactttgttgtggcagcttgagcagactaataaagatctttagacaaacatggtccatttctccctatgcctggcccctgagcagaataccagaaacagtgggccattgctgtgcctccttgtccatacttccaggggaaatgcaagaatgatgtttagtgtccttttaccacattgggctttattccttccttctcacaccttagcccctctaggctactcttagggtcatagtcactgtgttagtctgttcttgcattactataaaggaatacctgaggctgggtaatttataaagggaannnnnnnnnnnnnnnnnnnngcaggagcaggcaggtcacatggccagtgaggaacccacacgtggtggggaggagggcaggctcttttaaacacccagatctcaagtgaactgagcaagaactcactcatcaccaaggggatgctaaaccattcaggagggatccacccccatgatccaatcacttcccaccaggccccacctccaacactgggattcgcatttttcaacatgagatttggaggaaatgaacatcccaaccatatcaatcacagctagctaatgattctttgctcattcattagggaggtagcctaataatgctgaaagagttctggtaatacatttgacccctaaacaacacaggttcaaactgcacaggtccactcacatgcagattttttcaataaaagttacactgagtatgcctgcctctcctgcctcccttccacttcctccatctcttccgcccctgccactcctgagacagtaagaccaacctctcctcttccaccttcttctcctcagcctactcaacatgaagatgaggaggataaaggcctttgtgatgattcacttccacttaattaatagtaaatacattttctcttccttatgatttttaataacattttcttttcgctagcttactatagtataaaaatacaatatataatacatataatatacaaaattttattttgcatattattgactgtttatgttgactgtgttatcagtaaggcttctagttaactgtagactgttagtagttaagttttgggaaagtcaaaagttacacttggaggccgggcatggtggctcacgcctgtaatcccagcactttgggaggccgaggtgggcggatcacgaggtcaagagtttgagaccagcctgagcaacatagtgaaaccctgtctctactaaaaatacaaaaattagccatgaatggtggcgtgcacctacagtcccagctacctgggaagctgaggcgggggaatcttgagcccaggaggtggaggttgcagttagccgagatcgcaccattgcactccagacagagtgagactccgtctccaaaaaaaaaaaaaaaaaagttacacttggatttccgaccgtgccaggggtcagcacccctaacctaaccccttcattattcaggggtcaactgtacttagaaatagcctagctcagctgctgtactgggtgcaaggtcccaggcaaatcaagttctgtctctgtactagaaaattaaggacatgagctagattattcctaggctgtcttctacttgggtgactccagggttctaaactgttatgtttctggggttcacttttaagagcctccaaagacttcatgaatgtctccaaggcccacataaaggaatcattctctaagatggggaggtacctttggccaagaggtcttcccagaagtcttcagatagtgtttggtatacatgtagctgtactacctgctcagaagtattagaatctcccactttttagcacttttggatccacaaaatgtttgggggacacaggaattcaaaggtctcactggaaggttctgattaacaagaaatattaagaagtcttttcccagtgagaacaggagtctctgtggtattccttccacttggacagggaaaatataaaagcaaagtgtaaaacgtcagggaggaaactgcttgagtgctatgtcctgactgtgtagagaggggaaccttcttaatgtcccaggggacaggcaaagttgtgccaacctaacctgcattttggcatgagatctcaaatgccctgtgagcaaacagccagcaccctgctctcactgccatgccagcgtcatgattggtgagtgtggcagatcctctgaggcttcaaaaccaagcctcagaggccacgtaagaggcaaggatccatttcacagtcctattgtctgtgtgcctgagaatcatagagtgaaaatacactaaagttgaaagggatttcaaggtcaaaccaaggttgaaggttgggcacctatcaaaatggctttgaatagtgcattttttcatgtgcgtttgaacccgcagttgattgcaaactctgtaagtaaccatctattatttttgtgtctcctccttggtacttagtatgttcattgtattttctgatgccaaatgtgggggagcaggcagaggagggattccacactgattcttcaattctccaacaccaacttggtgtccctcttagtccattttgtgctgctataaaagaatacctgagacggggtaatttataaagaggtatatttaactcatggttctgcaggctaagaagttcaagggcatggccctggcttctggtgagggtttttgtgctgtcataacatgacagagaaggtcaaaggggaagcaaacatgtatgaagagagaatagcctgagggacatctggctttataacaaatcactcccgcaggaactaacccagtctggccagagcaagaactcactcactaaagagcagcaccaagccattcatgagggagccacctccgtgactcaaacaactcccaccaagcgccacttcccaattcagccacatggggaccaaatttcaacatgagttttggtgaagacaaaccatagcaatgtccaacaattcaattcaattctgacactaactactggagctggcacagaccccacagggtaagggctcagtctcacaagactgcccccacttcaggtgcccaggctacctgcacttctgcctgactacaaattcaagggttcccatgactccccctcaggtttaatcactggctagaatgactcacagaattcagggaaccactttgcttacatttactagcttattttaaaaggtgcaacttaggaatagccaaatggaagagatgtctggggcacagtatggggcagggcacgcaaagtttccacactctgtccaggtgcaccctgtcccagcccatccctgtgttcaccagcccagaagcttcctgggtcccattgttcaagactttttataatcaatttcaagagccctgcctcccaccctttctgaagttcaggggatgggactgaaagttcagcctttctggtgaccagcctccatcctggagatatctaggcgctccaacctgagtcacctcattagcataaatccagatgtggttaaaggggttccttgtgaataacaaaaggcactcctgtcagtcgggaagttccaagggttttaggaacttcttgacttgaacaagagactaaaactaaatatattttttattgtaccacaattgcacacagattcttaattaaacatgtatcagttaattcactgactagcttagaacacaagaagcctgatgaggggctaaaaatggctaagaaatcccttatctctaaaatcagaaagattatgggaaaccctttagtttgggacaggtcattctgctagaagaacatataaccccaactccatacataaccttgaagttggtgagaggatagataaaatggcatgcatttttggctatttttgtaatttaaaaaggctaaatttctgattcgggagttttcccagatttagctaattatgaggctctctgattactccttattccctgaccctctttattgaatccttgtgagctaacagaatgacagaaagcaggggctgcagcacagtgcccttggcacctctgcagctgagaaacctgctatttccatatgcagaagcttgccagagctgcatctgagcaagctgcgaagagacaactggcagcagaaagatgcatcagcaccagggaggtatcagagcaggtcagccagggtatgctgcggcaatcaattatgtagtaggatttggctgcctttcagaagcttctttcaccacattccaaaggctcttgcattaaaaggcacacagcactcttttctcctcaagatggcaaactcagagaggattgcctgggccaccccacagcttcctaccattcaagtttcttacatgttgtgaattgaagctgagattaaggaaagatgcttggaggtttgcaactcaggattcctcagcctgaagtatctcaagagatcatcttgttcatttacagcgtgcatgcctacattgagaatggacaatgcttgagatgttccatttatcccctgattcacttctcatctttggaggcaataggctggaccagattatttctacttcagcagtagagacaggcctgggtgaagccgaagtttcaccaccccatcaatctgctctgattccgaagttagacctatttatgcaatgcttgatctttccacatcctctatcttttcgaggcccaggctaagaaataggaggatgaccaactatcatggttttctcaggactgaagaggttactgggacacagaactttctctttttttaacttttattttaggttcgggggtacatgtgcaggtttgctatataggtaaactcgtgtcacagaggtttgttgtacaaattattttatcaccccggtactaagcctagtacccaacaattatttttttctgctcctctccctcttcccaccctctactcttaggtaggctccagtgtctatcgttcccctctttgtgtccatgtgttctcatcatttagttcccacttataagaaaaaatgtgcagcatttggttttctgttcctgtgttagtttgctaaggataatggcctccagctccatccatgttcctgcaaaggacatgatctcattctttattatggttgcatagtattccatggtgaatatgtaccacattttctttatccagtctatcattgatgggcatttagttcattccatgtatttgctattgtgaatagtgctccaatgaatgtatgtgtgcatgtgtccttatggtggaacaatttatattcctttgggtatatactgagtaatgggacaaatggtagctgtttttggctctttgaggatctgccacactgctttccacaatggttaaactaatttgcactcccaccaacagtgtataaggattcccttttctgtgtaacctcaccaacatctgttattttttaactttttttttgcctcccgggttgaagcaattctcctgcttcagcctccagagtagctgggactacagggatgcgccacaatgcctggctaatttttgtagttttagtagagacagggtttcaccatgttagccaggctggtctcgaactcctgacctcaggcaatctgcccacctcagcctcccaaagtgctgggattacagacatgagccactgcgcccggccttgactttttaataatagccactctgactggtgtgaaatggtatctaatgtggttttgatttgcatttctctaatgatcagtgatatttagattttttatatgcttgttggccacatgtatgtctttttttgaaaagtgtcttttcatgtcctttgcccattttttaatggtttttttttcttgtaaatttgtttaagtcccttatagatgctggaaataagacctttgtcagatgcatagattgcaaatattttctcccattctatactttgtctgtttactctgttgatagtatcttttgctgtgcagaagctctttagtttaattaaataccatttatcaatttttgcttttgttgcaatcgcttttgacatcttcatcatgaaatatgtgactgttcctatgtccaaaatgatattgcctaggttgtctttcagagtttttatagttttgagttttacatgtaagtctttaatctatcttcagttgatttttgtatatagtgtaaagaaggggtccagtttcaatcttctgcatatggctagccagttcacctagcactatgtattgaataaggagccctttcctcattgcttgtttttgtcagctttgtcgaagatcagatggctgtaggtgtgcggccttatttctgggttctctattctgttccattggtccatgtgtctgtttttgtaccagtgccatgctgtttttgttactctagctctgcagcatagcttgaagttgggaagcaggatgcctccagcttcatccttttgcttaggattgccttggctattcaggctctgttttagttctatatgaattttaaaatagttttctctagttctgtgaagaatgtcactggtagtttgatacgaatagcactggatctgtaaattgctttgagcagtttggccattttaatgatattgattcttctgatccatgaacatggaaggtttttccatttgcttgtgttatgtctgatttctttgagcagcgttttgtaattctcactgtagagatctttcacttctcctgggacacagcactttcaggctaaaactagtaaagtcccagacaaactaagatgagtcagtaactgtagtaaatagttggaactgacctgaaacaagtgtagtaccagataggtttttgggaagccaaattcaggggctggttttgtttggaaggcagtggctctgctatactgtttttttgaatttggcaagaaataattatgtgatctgtggctacacaaaaaaatgaattgctatagcagtagatagtgtaagcatatagactccaaaataaaaatccacaaacatatatgttttatgagagaaggaataattatttctgtactctatcacttactacaatgcaagccacatagtaaatattctaataaatatttgtgaagtaaatgaataaatgaattccagctctgtctggctctatcattactacctgtatgacattacctaagttactgaatttctttctttctttctttctttttttttttgagatagagtctcactctgttgcccaggctggagtgcagtggcatgatcacggctcactgcaacttctgcctccagagtgcaagggttcaagtgattcttgtgtctaaaaccaagtagctgggattacaggcatgcatcaccacactcagctaatttttgtatgtttagtagagacgggtttcgccatgttggccaggctggtctcaaactcctggcctcaagtgatacgcctgcctcagccttccaaagtgctggggttacaggtgtgggccaccacacccagcctgaaggtactaaacatctttaagcttctgtttcttcatctgtaaaatggggatgataataattagccacttcatagttgttatgggctaaatgaattgtgtccccctgcccaagtttatatgttgaagtcaacccccaatacctccaagtgtccttataggaattggaaatattgacacagagacaccaggcacacgtgcacacagagaaagaccatgtgaggagacagtgagaaagtggccatctgcaagccacagagagaggccttaggagacaccaaacctgctgacaccttcatcttggaattctagcctccagaactgtgggaaaataaatttctgctgtttaaaccactcagcctggggtattttgttatagcagccttatcaaactaatacaataggagaaataatgttcatagatcacctagcacatgaatgctcagtaaatatttctaatactaaaaatatctgagcagggcactgaaaaatatataatacacacaaaaacatacaaaagggaatcagtagaattatttttctacacctgaggaccttgggggacagagaaaactgaacctgccctgcatactattctctgcactgggatcatgaaagagtgtatccacaaatgacattctagtccagaacatctcaaactttaaagtgcatatggatcacctggagaacgtgttaaaatgcaaattctggttcagtgggtctacggtctgcatttcaaacaagctcccagttgattctgatgctactggttacaggaccacaccaggcaacactgaagaaataggttgctgagtcctaaggagagttataaacccttggatacacaagacacaaaaccaaatacatcgagtggccagaaaatactcagtaaattgaatcctatatttgtatatatcatgactagagatggcagtgccacttaagtatatatataataattcaggaccatggagttaaagtgctcaggcaggtaaagtcatctggagaattcctgaaggaagaaaggaagacacttgattcagcaggggaaaataaagaaaacattctctgtaggagaacccgtctgggttaaagcgaacttaaatagttcaagttgagttgtatttagttccttacttccctaccttaataagtacaggggcggcatttgctgctcctctggaagggtgaggggagggaggaacgtgtgggtgtgcttatggcactgtttgctccggctagctaatgtttggtttccttatctttggagagtgtaatgggtgttggtgccagcttggaggccacctgatctcaatcagactctaaagtcattaacgaagctactaggaggtaggcctccacgtggcctgcagccagagctttaggaagcgggagtatggagagggaaaacaaactcaaccttgggttacctaagatgaacatctttatactagagctccagaatctgcatcaccaaggctcttactatgctccaagatgtggtcccttccaggtacctgaccacacacaggtcagactttccttgtcccctgagacccaggaagttccatggggcaatcagatgtggatccaaatacttggggatgtttatgtttttagtggtttttctagagttggaggatgaattatgaaacaatagcagaaatttgctgaggtgcggtggctcacgcctgtaatcccagcactttgggaggtcgaggcaggcggatcaccggaggttaggaatttgagaccagcctggtcaacatggcaaaaccctgtccgtactaaaaatacaaaattagctgggtgtggtggcatgcgcctgtaatcccagctacttgggaggctgaggcaggagaatcccttgaacccaggaggtggaggttgcaatgagccgagatcgcaccactgcactccaacctgggcaacagagcaagactccatcgcaaaaaaaaaaaaaaaaaaaaaaaaaaagaatagcagaaattccagaccctgaaaacttggatttatccgctgacatatgggtattcttttgtagaaacatgagtttcttgtatattaagtggtcaagatgatccctgatggtaatttctccataaacagatttttttagggcttcattcagactgtaagatcaaatatattattgggtttagattaggagcttggattttggaggtttgctagctgtttcacctgggcaagatccttaacctctctgaagtctcaatttcccaaatttaaaaaataatatttatataatggattaaatgagacataaagcatataaagtgattggcttttattataattctttctcttcttatcccacttaattacattcttcccatgaagtaatgtcaggctctataaaggcagttggggctgtgggcctatatccctcctctccacccatcctaaagtctactacactgcttctctgttagagaatatttaattgagcatctcctgtatgtcaactaaaagacacagtctttgcacgtaaaggagtccacagtcacttagagggagacaagatgagtcagcaaataaatataatcaagtatctcaggtgctctggcaaatgtctaaatggacaaggagtgatgaagcagagcatgtttacttttagtttggagacttaaataagaaaaggattaaaagtggatgtgtttgaactgagttttgagaaatgagaattggccaggtattctagagtgtgtgtgttgtgtgtgggcactcggtggaaggggaggattggtgggcatgggtcaccaagaaacaagcaacagcatggcttgtcagggacctggaagaggtttgaagttgccagaggatgggatgtgtggggaaggtggtagagcaatagataaggttacacagctagatcaaggtcaactcacagagggtcttgtaagccatacttagaagtttgggcaatgaaaagccagtaagaggggagtggtttggtcagacatatgggtgttataaggaaaattttttctctagttgcaaaaatagtttattttcaatggggaaaaaaaaccacaaaaaaaaattacatatgaactcactactaatacccaactcataatgtactggagtgagttttccagagagaataacagagtgtaaaaggaaaaaaaaaggttttttcctactctctctgctccctatttactcaatacagaacacttcttagaccagatgtgtgtttttccccacacaccaagcaattctccagcagaccctctctgggtatcctagaatccaattctgattctatctacctggatatagcatcagatcccagtggttgtgggctcagtcccacaaaactgctctcacttcagaggccaattgcaagtctgggccacctttatttttcaccaaccggctataaactgagattccctcaactttctgctgggatttgattaatttgctgggatggctcatggaattcagggaaacatttaccagcttattaactgttttaccagtttagtacaaacgatattacaaaggatacagataaacagccagacgaagagatgcacagggcaaggtatggcagagcggttgcagagcttccacgccgtgtctaggtgagccaccctcctggcgtctcctagtgtttagcagtcccaaagctcatcaactcttgtttgagtgtttatagagcttgatgttcagcaacaccctccctcccctccttggaggttggagggtagggttgaaagttccaatcctctaatcacttggtctttctggtgactggtcctatcctgagactaactagggcccccacactaagtcaccttattagtataaatgctggagttattaaaggagctcattatgaataacaaagatgttcctatcacccaggaaattctaggggttttagaagctatgataggaaccaggaaaaaagaccaaagatattttacatcatatcacaaggggaaagggagccaacatgtactgagctatgtgccaggtactttatgaagtttatctcatttaatgtaacactgaggtttgctgctccatgtgggtccacagccagagggttttgaagagggcctagagaaggggaagaataaactcagtcttgcattacagaggctcctcaacttatgatggggtcacattgttgtaagatgaaaatatcaactaagtcaaaaatgtatttaacacacctaacctaccgaacatcatagcttagcctagcctaccttagacaaactcataacacgtatgttagtttaccttgagtaaaatcatctaacacaaaatctattttaaaataaagtgttgaatatctccatttatttatttatttatttatttatttatttatttgagatagtcctgctctgtcgcccaggctggagtgcaatggtgtgatctcggctcactgcaagcgagtctcttgcctcagcctcccgagtagctgggattacaagtgcacatcaccatgcatgtctggctaatatttttgtatttttagtagagtcagggtttcaccatgttgaccaggctggtctcgaactcctgacctcaggtgatccacctgccttggcctcccaaagtgctaggattacaggtgtgagacactgctcccggctgcctgtaacttattgaatactgaactaaaagtgaaaaacataatagttgtatgcgtactcaaagtatggtttctactgaatgtgtattgcttttataccattcacaaagtcaaaaattggtaagttagggactgtttgtattaggtaaactaaggagaacatctttacaaaagtgccaaatatttgcatcgccaggatctaatgctctcactgtgctccatggctagataagatggagcatgggaaggtgggaggagaagcaactttgggaagaggagatgaggataataagttctttttgagatggttgtaaggcacacacgtggatgtataggtttagtactcaaaagagaaatcggggctggaagtaaaaactttggaattggcatttacattagatttaaagccatgagaataagtgaatgtgccccagaaagacagaagagagaagatcaagactagagccctagttgccgggcgtggtggctcaagcctgtaatcccagcactttgggaggccaaggcgggcggatcacgaggtcaggagtttgagaccagcctggccaagatggtgaaaccctatctctactgaaagtacaaaaattagccaggtgcagtggcaggtgcctgtaatcccagctactcgggaggctgaggcaggagaatcgcttgaacccgggaggcagaggttgtaatgagccgagatcgtgccactgcactctagcctgggcggcagagcaagactgtctcaaaaacaaaaaaacaaaaaacaaaaaaaaaacaacaaaaaacagaatagacccctagagaatgccagaatttaagaggcagagcaaaggagataccactagggcctgtgaaggagggtcaaagaagaaccatgaaagaaagatcctggaattcaccaactgtcaaatgtcacacaggccaatcaagatgaacagtgcaaagaggacacagggttttgctatttctcagtgggagctttgcctgggccctttatgaagtgggatgcagggagcctcactgcagcaggtggaagaatggatggaaagtgacggtaaatgcagtctgtacttttagagagcttgactatgatgggagacggttttgtggtggattgatttgttttgcttttaaagactggagaaaatagcatatttttatgatagaaaggagccaatagtggctaaacatgaagactggagagagggaataaccaaggttgccaagttctacagcagtttttctcaaccggggacattcagtatctggaaacatttttggctgtcacaactggggtagaggagttgttaccagcatctgctagacagagtccagggaggctgctaaatatcctttaatgtacagcacagcccctcatgacaaagaattatctggccattgccaacaatgtggaggtcaagaaaccctattctaaaggaagaaaaaacagaccaagaatgcaagtgataggattagcttccacctgatataactcaatgcatatttgttaaataaattaatgaatttaaaattccataaatagattccatcctgtttcctttcatctggaagccctataacttaagcatggcataaaaaatttgaatactatgtaggtactgcagactcaaagataagacacaagctcgtactctaagttttgaataaaatgatgctgcctagagaattcagggaagccttggaagatgggaatagagaaataaaattgacttttattaagtgtccactttatataagcacttaaaatatgcttttatacaagcactttatttagttgtgtgatttaatatacaccacactctggtgagtgagatattagctccattaactagggaggaaacagagtcacagaggtcaagttaacttgtccaaggtcactcatctagtgagaaatggaaccaagatttgaacccagttaagtctcaccctaaaatctaagttgtttccattgtactatgctgtcttcatgcaataaccaagtcaagtgacatctcagccttgaatgatgagcaggaatttgcaaaacaaagagaggggaagagaggactgggcattccagatattatggagcacatgcaaaggccctgaggtatgaaacagtcgtttggtgaggctatgtgactgaaataaatggcacagggcagggcaggggcagaggtggaccacaaggggtggagaagtaccatggcagccatgtagctaagtcttttctagaagtcagcagctcttaattttagcctttcctgatgctgttcaaataattgagcctccctatcctctgttttacactgtttttcttttgcccagtactatatttttcatattccaagcacagaggtgtctaaatattggtttggggtttagtaaatctttttctttcctatgacagcaaaaacgagctatgtaacttacaactcccttgactgagacattcattttacaagcaaagtgagttatggattaatttgggaatatttaagctccggttaagcagcagtgggcacacgattgcctagaacataaaaccaggacagtcagggagcatctctagcttgttaactgtaatgccagataaatgtcaccctctgctcaggctttttaataatttattaaaaaaattaaaagtactcagttgtacttcctaaggcatttcctgtttacagggtgtgtattctaacagctgtgttagaaagtgtgacctaagagctttcagattgcttgtcctttgaagctactgagtgccaagctaggggattactcccacctaggccagagcctggtctcccggcctgaacctggctatcttgggttcccagctcctacaaccatacagtctgtaataactgcagagcatgaagggtgcatggaggtctagaggccaattcactttcatggaaagtataatttaattggaaagtgggaaagaataatgtttacaaagtatcttgcagagatttctgtatttccgggtcacagagcagaggctgacaggcacagatcaccactgaacctctaaacattcctgttctccccaacccccaatgtctttccctgtcctggaaaagtgcaaaaaagcagtatacatcccaggctgctggacatatgcccaattattctctagggcaagaagtctacccctgatagtgatatatataaatgctcatgctttaaaaaaaaaaaaaaaaatacagcaagtttaaccaggcgcaatagttcacatcagtaatcccagtggctgggaaagctgaggtaggaggatcacttttagcccaggagttcaaggctgcagtgagctatgattgcgccactccactccagcctgggcgacacagcaagaccccattcaaaaaaaaaaaaaatacagtcagtttaagcacgatgtatcattttcaggtcacgagttcactaatctctactccagtttatttttaaaatacgcagtcatagtttcacaatttctatgtaagtctcatttcacacaaaagattaatgcataaaattgtttaaaatagcattatttacaatgaaaatctgaattgcaaaaaaaagctgaactaaaaaatagacaaaaaattaaatgcaatttacaatcacaagagaatgggtaaagaaagttatggtacattaacagtagatattttgcagctattaaacgttatacttaacaagagtaatagtaacactaggaacgattatataataatgttgaataagcaaaacaagatacacaactgtctatacaattgttatttcttttttttttttttttttttttgagacagagtctcactctgttgcccaggctggagtgcagtggcgcgatctcggctcactgcaacgtccgcctcccaggttcaagtgattcttctacctcagcctccctagtaagctgggattacaggcacccaccaccatgcccagctagtttttgtatttttagtagagatgaggtttcaccatgttggccaggctggtcttgaactcctgacctcaggtgatccgcccgcctcggcctctcaaagtgttgggattacaggtgcgacccactgcacctggccacaattgatatttcaactgtgaatgtcatgcatagagaaatgattggagatgtacaacaagatgtaccacagattaattttaccaccagaaaaggccaaatctccctgtctgtttgcttgggctgctataacaaaatacgttacactgggtaatttataaacaacagaaacttactgctaatagttctggagactgggtagtccaagatcaaggtgccagcagactcagcatctagtgagagccggttcttcatagatggtgccttctgtgagtccttacaagacagaaggagcaagaaagcaccctcaagcctcttttataagggcactaatcctattcattcaggtggagccctcatgagttaatcacttcccaaaggtaccgcctcttaatactattacactgagtattaggctctaacatatgcatgtggggggacactgcattcatactgtagataaaaggagccgaagaaacaaacagcctctcgcatagtgttgtttacatccttctaatgtctctagagaaattcatatataaatagggaatactttatatgcctgatgtggccggtgaccagaatgccattatttaggaagagtagaaaaagtagcagctctgataactaaggaaaaaaataaacccacaaatatgaggcttattcagttaaaataccaaacctaggaggatgagcttcaactgcttgccataaaaatctcactacaagagtctgcagctttccactgcaaaactagaaaattaaatatctttcatcttcattttcacaccctttactgtattttcttactaatattaggagccgcagatggcaaatcaatagattgtttctatgatagcatggaccaaaaagaatggtgtagaaagagataagtctgtctctagctattccatcgtggcttcatcaattggacagggtgaatgtcacctctgttgccgatttaatcctcctctttcaagtctggacacctgcattcctcaactatcctagctccaggggaggactaacagggagggaatttgtttttttaggtattgaaagaaaatcacatcaaataataaattactctctatatctcttttaaaactgtctcgtgtgtctttaaaatgtcatgggagaaataaaaaggtacactgagagagtatgctcaatgaaatatttaaaccataaaggcagcaaggccggtgattaaggagattaaatagatctggatgatggatacaaatcagaagcatgttgtcaaagattagtagatattaaagctctttattgtccttccaacagaaaaaaaaaagcagtaatacggtttttttgatgtcagtctgagccatcaagccattatgtaatttttatcttttcttactccttttgccatgaggcaagacaatttatttcccctgtagtaaataaatttcctctgcctcaaacatgctctgaatgtaatcctgggctagccacccacctcttaggattcactttcctcatttgctaaaggagggaattggttctcatagttctgacattctgtgtttctctgaaagatgtttagagagttctaggatgtgagttatcatatatcatctacactaagacacatttaattataagataagccattattttatgtactactaacaaaaaaaagatcctgccaactaaactatgacagaataccctaactatagccctgtgacctcaggattaatcacaccagcctctcatgctttgaaataaaggacaattcctgccaccctccattgcattgcttggttgattttagacagttcatttgtatgtatctcactaataaaacaacacaattttgcttgtaggtatctttctttctcaggtcccataaaactcttgattcttgttcttttcagaataatatatggaactgcaatcatttctctgatgatgaatatttgcttcactagtatcaaattcatgccccactatgttcatgccttctacaaatacgggaatcatagtgtaattttttaaaaatttaaacaacaagtaagctcaacatgttattaccaatagtgtccttaactgaatggaagtcgtgacaacatgaacagctatgactaattttgaacctgggcagaccaggacaactacatcatggctacagtctaactgacatccctactgacttcagagatgtcaaaaaacaaccaggaacctgggcaacattgtgaaaccccatctccacaaaaaacacaaaaactggccatgcatggtggcatgcacctgtaatcccagctactcaggaggctgaggtgggaggattgcttgagcccaggaggtcaaggctgcagtgagctgagattgtgctactgcactccaccctgggcaacagagtgagaccacatctcaacaacaacaaaaaagtggaggatggtggcaaggagaaaaatatgtggtttagaactgatgaactgagatgtcttcttcacctccagtgagagaggagtggcatatagcaagcgttccctaaatatttgcaggttgttgaaggactgaatgaaagtatagatgaaaggatgaatgaaaaaacaaacaagtagctaattgggaatgttgagaaggcactttactgccttctttgagattgcttcttatggcaaactgcactgcagtcttgaatcaccacggctggctaaaatcatggcgacccaaccttcacctaagactctggaatctgattcacattcacctcccagcctctgctgacctctcatgcctctatcagactgcgaaactgaatgctaaggtccacgtagaggactcaatgtaacacaagagcttacatttccttgactcctcaacaccagtggccttgccttcttatcctcccctgcagctgctcccagccctactcctccttgtccttgtttttccaccattctatgacatcccatccctgcatatcgacttcctgccttctgcatccaggtggctacaagcaattatatagattcatttgctccaactttaggtgaccctcaagctgctgctaacctgttccttctgtcattcttctcaacagctctctcacgcattctctttttttccttaaaccctcaacaccttcatcacctgcaacttcagtaaatcatctttctactttatgagaaaattaaagctatcaggtcggaactccctgagctccatcaacaacacctaaaaactctcagtctaattctatcccttctttctctcctctcaggacattttctctagttcaaaactaatccctccatctgacctctgcctacgcctcaggaaactgttactctattcgttatcctctctatctcctttactccaagcttcccctctacttgatctttcctggcaaaatataaatattatcatctctaatctaaaaacaacttccactcgcccactcttctcttctagctcttagtcatttctctctttttcaaagccaagttttttaagtctacctattattgttgcctccactttcacctcccattcacttacaaatctagtgcaatctggcaaacatgttcaccatgccaacaaaattgttccctaaagtcactaattacctgcacagggctatccttacctcacttgacctctctacagtatttaatgctgtgaaatattccctcctcaacatctgttccttttggttattgtgatactgttctctcttcctttttcatgtccttctctgttttattctttggtcagacagaaaaaaagtttttgctttccccagtctacttatgagttctctttggtggtcacaaatacactatttcagcttctgcatatgacccacagcctcaaatctctacgcccaactgaaacttctctctgcgttgatgataacaggtctcaaactcatcatcttcccccataagcctgcttctcttcctgcctcaggtgtcaagccatgcacacaggtgtcaagctggaaatgtgtcccttcctttagatgtgcccctcctcacccacacatctgattggttacttaggcttttagagcctgtaagccaccctctctgtaatccacttctactgtttctactttagctgaggcctttgccatttgtcatgtggatcatcatagtgggctgctgggtgtttcttctctaatctatctgccacactgctgccacataccacattactaccagaataatctttctaagatgcaaatcaatcagatcatgttttttccctgtttaaaaatacttcgattgttcttccggtagctttcaggatggaattaaaacatggaacacacaagatcccccatgatacgcccctgcccacatctttagcctcttattccaccaggtacctctaatggcttcctgttttctgatcacacttgactgtatacacatgatgtttcatgcccctgagactcctctggggatactctctaccttcttatctctggcccagcttactaactgctgaacatccctctcaagcatcttttccctaggaagctttaactacttcaattgggagcctctcttccattctagaagagcaactggtgcatacccctatcacctctattatcattaatgatttgtttatacgtctgcactagaatataccctccatgaaagcaaagactgtatgtttttggctgaaggtgttaaaaatattagcattaaatgaatgactaaatgaataaaccactgagcttttgggtctaaaaacaaggtcaagtgaataaggcattttttataatcaagacagagtaaaacttttagaaaaattaagtagtgataacagtgaaagaactgtaaaagaagtgctttattataattagatatctatatttatatatttctctaaattgtatcatccccttaaatgtgttaacacagctattattgttttggtgtcttgatgatattttaattttaagtgaagaaactaatttattagttttagcatctggatccaaactcctaataaaataattcaagtggagccaatgtacctgaaacacaatctggacaccatagtataccttaggcaattcaggttttcttaccaaataccttaactgggtatttcaatttatccaaagccaggcatagtggcacatgcttgtagtcccagctactcaggaggctgaggcaggaggattatttgagcccaggaattcaagtcaagcctaggcaacatagcaagattctgactctataagataataaaataaaatgtttccaagattttatcccaacatacctttcaccattattcagcactaaatctacattcaagttaaattaaactcctaaacactccctgaaaatgctccacattttcccaatgtgttatttcctctatatgggccttaactccttacactgagaatctctttgctccatttctacctgtttaaatactaagtccaactccatgcacatacagttttctgattcctttcagagagattttgtgccttttatcacatccagttttatgtatttatttatttttattaatttatttttgcaacagggtctcactttgtcacccaggctggagtacagtggtgctatcatggctcactgcagccttgaactcctagttcactgaactagaagttcacttgaactagatcacctagatcacttgaactcaagtgatccttccacctcagcctcctgagtagctgggactacaggcacacgtcaccatgcccagttaatttttgcttttgtttttgttttttgtagagatgaggttttgccatgttgcgcaggctggtcatgaactcctgggctcaagggatccttctacctcagcctcccaaagatttgggattacaggcgtgagccactgcacccggcctactatactttctaattatttgttttttcttacattgggacacagctgatttttgcattttaatcttgtttctgtggattttgctgaactctcttaatagtttgtagattgtcttcaattttctatgtagataatcacattgattgtgaatactgtagtttgtttcttcctttcaaatccttaggcatttaatttttttatcttattactgcctgctaggacccccagtactaaatttaatagaggtagtgatggtggacattcttgtcttattcttgacttaaagaatgcttctaacaaatatttaaccattaagcatgcatactaagcatattatttgctgtaaattttggatgaatatcctttatcaagttagggaatttccctctgtaatgattagctaagaatgtttactgtgaattaaattttataaaatgttttctctgcatccattaaaataatttgaattttttctcctttaatgtataaatgtagtaaattataataatacattttctaatggtcttttttttttttaagagatggggtctcattttgttgcccaggttggtcttgaactcctgaaagtgatccacccgcctcggcctcccaaagtgctgggattacaggtgtgagccactgcgcccggcctctccaatgttctaatattatattctgggataagcccaaagggatcacaaatattagctttaatgcattgctagatttaattttctattattttgtttagaatttttacttctgcatttatgagagattggtctataattctccttgtctggtttggtatcaaaattctgccagcactataaaataagttacagtcagttcttccttttctattatctggaatagatcatataagattatgattatcttgttcttaggtgtttggcagaattgcttataaatccctttagccctggtatgttttgtttttgtaggtagattttaaactaccaattcaacgttttaaaaatagctatagttttctaattagattttctgtttcttcttgagtcagttttgtaagttttctttttctagggaactggccatttcacataagttttcaaatttagttgcatgaagtttataatcatctcctattgtttaaaaaatgttacctatgtagcgattttctttttttaattcctgtcagttttattagtcttttcaaagaaccagctttttgttttcctgatcctttctatcataactttgttttaaattttattaatttctgctctgttaatacttccttccatttactttcttgtgtgtatgctattgttccattattcaatgtcttgagatggacatgtgactcattaatttccagtgtttcttctttactaaataaacattttaaagcttttgtaaatttctctgcgtaagttttggaatatatttcattatttagctctctatattatctaactttagttataatttgttcttttatttaggacttaatcacaattgatttattcctaaagttatttagaagtgttttaaaatatctgagcgcatgatgttattaaagctttttttaaaaaccgatcagataacatgatctatatgatactgacttgtctgggctgagatggtgtcatgatgtcaccagagacctggatccttctatctttctgttctgtcatcctaattcatggcttccatcacagaccttttttgtatttcccattgttttcagtaaaatggtttgcacatagcagctatagggtacatcctacatcatgctacataagaaagatttaacagcccaaacaataatcatgagatttatcatgaatcagtctcatcagcttttctctttcagaattcagaattcgaagttcagagccccattttggatttgcacatcagaggtctggactctatcccacgccccagctctggacctcgagggctggctccaacattaggcatttgggggatatttattagattaaagaatacataattagaaaagaatgaatactccctgcatgctaatcctgctagccccaaactagaaacggatggcaaatgtcacaaatagtaattcaatactctttctaaagagattggaacacagtctacaacaaggcaggcttataatgcgagcagaagcatcacgtgctgcacattcttggggagaacaatttaaggaaaattaatttctaaacaataacattctgaaagcctctcaaacatatatgttcaccaatctcctggctgacctgtcacaaagggtcactgttgttcacagcacaagcagtctgtctactcaggacagcagccacttaaccccagatattgtccacagagcaaatctaggtatatgagccaaaggcacatgtatattggggagcaggaaacctgaagtttagggtaaatgatttctatcatgttctgtaggccacgcttgacagtcctgtaactgcacccttccaccttgctttggccaagttaacacagtttgggtgtggttgctcataaatattcccaaagagcaatgacgattcttttggattcctgaacacaccatctctgttgtgggagaactctggggtatgtttccagctctctcaatgaagttttaatcaaagcactgtttccttcccgttgttgcttttggaatggccttgttctctgagtcctagctttgacaacagcaactgtgctgaacttttccacagcagcttttggatttctgccccaccccctcccatctgcacgcccccatttcctctcttctctgttttggctctgcgtggctcttctgagtaaagtggctgaagagtaatgaacccaaaatacctaagtaacaaatgagtcaccacacttccacagaagagctctgaggatcagtgggtgtgttggggggtaaatagcagaggaggtggctgcccagagagagggagagagagaaaaaatagaaacaaaacgagcaagttggcagaggtggctgagagcagctgagtgggtggagggggcggggagccgggttgtgttggcttgcaaaggtgagatcagtgctgtggcttgtcacaccctggctgactcaagctaagcccaggcccctcgggaactgttcacactgggctgtctagtaaaaatcagctagacaagtcgcctaactgccgttctcttgtgtttacaagttctgagttgtagggcttggaattctttgctcaagttgctgcaaagctgctaattaggaacctgcaatgatattgctctagggccattccctttctggttatatggtatctgggtgataagagtcagggcagaatttaaatttcttctttgtacttttttgtttgttgggaatgtttagaatgcatccttttttcaaaaccttatcttgaagtgtagtggtggagctggatcgccacctcaaagctaaggctccaggcagcattgatcctgaccatgcccagcaccctaagaggatgaggctctgctgagagatcctgggatgctgccccatagggccagctttgcttagaagccactgggaatttgtcctggcagcttaagttatgactcctactttttttttttttttttttttttttttacctttctaagtaaaaaaggagtggaataggcagagcccttggaacaagacaaatggtctgatttcatgaggttctgcctggccagcccacagtggacttttaatctgtcacaaaaaaaaccagaaagaaaatccatgtgtgcaaagaacaaggcctaagattcattcaggactgttaatgtgaaatgacctccgggagaatcttttgaaaaaagaattataaaatgtcctctgagacaggtggtctcagatcacaaggataacaggatttgatcacaagctgtctggttttctcttaggtcaaaaccaggaagttcagggactagcttacaaacagaggaaaacaaaataagttgatttggatttttaagcctccagcaacgtttcacttcacttgaccctgcagtgggggctggtgtcagcctttgattttatcttctgcagttctcccacccctatcccgcataagtataaaaccagatgccacgacttggaaagagcaaaatttgatcttgagaggaagtgggaaaatgtaaaactaacacagctttggcagctagaaagaaacaactatagcccctgcaaagaaagattcacaccctaggcaacatagtgagacagcatatctacaaaaaataaaaaataaaagaattagcaggttgtggtggtgtgagcctgtagtcccagctacttgggaggctaaggcaagggaattgcttgagcccaggaggccaaggctgcagtgagccgtgatcatgccactgtgctccagcctgggcaagagagatagacaaaaaacggaaggaaggaaggaaggacagatggaaggaaggaaggaaggggaaggggaaagggaagaaggaaggaagaaagaaagaaggaaaggagggagggaaggaaggaaggaaggaagggagggaggaaggaaggaagcaaggagagcgagaaaagaaaaagaaaaaaacaaagaccgagaccaaagacttgataaaggtgaactttctgaacccataaagttccttaagtgctgcctctgctcatttagtcttctgctcacctgagcccactgatgaataaatgaaaatctttggaaatgattcatgaaaatcatcacaaggaagcatattcttggcctctgaagtcttcatttcaaaatgaagtttatagtttaagactataaacaatacacgattcttataaaaataaaagtagaaacaaaaaatattagccatagttccaaccctcaaatgttaacacttcagtgtgtttccttccagttctcttataggcatatagacttattcttgtaacacagttgcactcattctgtatatatggaattgtgtatgctgctttttgctaaatatatattactgttatcatatagaaaattatgcaaccatcattattaatagttgcctaataaccaatacagttaatcagcccatcttcccccactatgttttggacattaaatttgtattcagctttttaaactgtaagtcttgatttaattaatgtacgaaatttagagctttttgaatcagccccactacttagccatgtagcaaatcttaccaatatctggaccagcaacctgaaggctgcaggaggaacctataggacaatcagagggaggtactagtacagattcctcgggctgtaggagtttctggtacaggggtcttgaaggacaaagaaattgcctgacgtaaggtcaccagccctctagctgtgtattccctgtccaatgtcacccacaagcctcatttccagctcaacatcttcaagcatcctagagaatagagatgacattttcaatgagtgaaaaaaaacagtaaaacaaaggacagggataacacatggcaaagctgaggatcttttttgttttaacataaagggtcatattgtctcttattctcatttcttattggagcattctgacatctttattttgggcttccctggttaggttacctgctggagaggtgtgtttagagctgcagttagggcagcaaaagcagagagagttggcaccagtgaggatgggcagagttggctatggatataatccatcatttgccaaatagctcaaagttgtatgaatatcattaaatatttcatgtaaatgctgttttttttcaagggcaagtcctgtttcatagaaaatatagttcccgagcatagtaaaggagcatgtgctccatactaagcacttctaaatgattatttcatttaagaatctcaacaattcagagttaagtgctctcttctccagtttgcacataggacaattaaacagcagaaaagtaaaataagttgccaagaggacttgctaataaatgtttgagccaacattagaacatagagctgacttcaaagtttgtgatctttgctctacattatgctgcctcccttgttaaacctaacagataaacataagtgcaattttaaaaaagagttaatgcttattgattaaaggcagggctttctctgggatccaggagtcaccattatgggtaggcaggatcatttacaacattcttttgaggatccctttaaaaaaaaaatgaccactgggtccagccaggtcaacaatggatgaggaactcttccatggagttctgaaaggccctacagaggctctgacaacaaggaggccacaggacagcttccacctcccagtttttcctaggccaatccttgggacatagtatggttgatggaaatggaaactattgcttcttggtgcattttttaaaggaatggttaaattataacgtaagagtctgttttcccactagacttgagttttataatatcagggaccatgtctgtcttcttcattgccatagtcccattccttgtacagtgcttggtccatagcagatgatcttagtccatttgagctgctataacagaatgccatagagtgggtagcttatgaacatcagaaatttatttctcatagttctgcaggctgggaagtcccaaatctgcagtgctgagagatgtggtggctggcgagggcccacttcctggttcatagatggcagtcttctcactgtgtcctcacatggtagaaggggtgaggaaactcaccagagtcctttttataacagcatagcactaattctcctcttaagggctctacccttataacctaatcaccttccaaaggcctcacctctaaatatcatcacattcaggattagctttcaatgtattgatttggggttagggggtcataaacattcattctatagcatagatgcttaataaagtttgttgaatgaataaataaatgaaaatattatccgggcgaaaggtgtgggctggagttaaggatggctcatggtcaatgcctgcatataaatgtattcctcaagatgtgtggtctgaattgaggtggcctaagtcaagatatgtcaggagtatatgtagtcagtttccactttttaatatccatgataagcccttggtcacaagcatgaagccatctgaaatgaggagtgaagagtttccttttttcccctgtcattgcagcacggagtgaagaaaaactttatttttcttacttctccttgattcctcaatcaaactggatttatgttaggcttaggaagacaatccctactacacagagtgtttataggatcctgcttgtttcccaaagggagaattggggctgaaagtgtgcattaagcccagtctttaagcaattaatattgtgcccaagaaataaaaagcatgaacattacaagtggattttgtcgtaatcctacatatcccaaatgtgtatactccaggaaagtccagatccccaacagaagcccatctgctatatttctagtgtgacactcctctgtttatatttgctcatttctcttacagagtgccaggaaagaaaaagcgatatttaaaaaattcatctgctagtatttatgcaaacacatttctctccaagtgtgggttgagcaatgtgagtaaagcagacataaatgcctccgacagaccacagagcaattttcataaagaaaggggagaaatatacacctagaacaattgaagttggcggtggaggggtgggaactttcctctgaccagcaacactcaacaggggagacattctaggtctcatgccgcagacttggaggctcatttgaaccattaatgactctattgagtttctactatgtgctagccagtttggagattataaaagcttaagactcctcgttgagaacataatagtaaataattataagacagcatactactgacataggaaaaaggggaagaaacactgtgagcctcagttaggtgccactctttgctaagtgtttcacatatattatttcatttaattctcacaactatcctatgatgtaatcatcctcctttttcagacaaggctcacagtggccatacaacttgctcaagattatataacttaggctattttgaaaatccctgttctttctgctataccatacataagatgtttccatggtttataatcaaatgttatatatgtttggaatctaaatagctaacatttgttgagtgcttactatgagacaggcaaaagtcttttttatatacgttaacagatttaaactttgtaacaaccctaggaggtagatactgttattatgccattttaggatgaagaaactgagtttacatataagtaaagttgtccacatcacaaggaaataccagagcccagtttggatccagattccatatatttaagcattacactatcctgcctaccctttgaggagcacttttttttttgtcccacacgcttcaaaactgttgaggagcacttttaagcaccttctattacataccccggaccaaccatcccaagcctacattgagcaaccttcagtaaacacagtgtgaaagtagaaaaattcaaactgtgtttctcctctgctttcacaccacaacaatcatcgcagaagacttctgtgatgaacagaagtctgtgtgaccacagaagtcttctgtgaccaaatgtgtgtgggtctatcctcacacagcaagcaagcgagcagttctgcagtggataccagctgggctccctccaattctgttccaacactatctacctggcgatagcagtagaaaccacaggttgagggctcagtctcacaaagctgcccctacttcctaccagtcgcaagtctgggcctcagaacttccgaccaactgacttcaagttgggattcctacgatcctctctttgaagtccattgatttgctagagtggctcaaggaactcagagaaacacttacgtttaactggtatattataaaggatattaccaagcatacagatgatgaggtgtatagggtgaaaaaggggcacagagcttccatgccctctggacatgccactctctaggagcctccagatattcagctatccagaggctccctgaaccctattcttttgtgtttttatggaggcttcattacataggcatgattcattatttttatttattttatttgtctttttttgttgttgtttttttgagatggagtctggctctgtcacccaggctggagtgcagtggtgtaatctcggctcactgtaacctctgcctcccgggttcaagtgattctcctgcttcagcctcctgagtagctgggactacaggcgcatgccaccgcatccagctaattttttgtatttttagtagagatggagtttcaccgtgttagccaggatggtctccatctcctgacctcgtgatccacctgcctcagcctcccaaagtgctaggattacaggcgtgagccaccacgcctggccacatgattaattaaaacactggccattggtgatcaatttgagcttcggcccttctcttctccccagatgttgggggtgggctgaaagtctcaaccctctaattatgacttggtctttccagtgaccaggccccatcctgaagctaccaaggggctgtgagccactagccaattactaacacataaaaagacagcactttggagattctaagagttttaggagttgtatgtcaggaagaggggttgaagactgacatggtttggatgtttgtcccccccaagtctcatgttgaaatgtaatccccagtgttggaggtggggtctggtgggaggtgattggatcacgggggcggcagggggatccctcatgaatgactcagcaccattcccttggtgatgagtgaactctcactcagttagttctgcctcgtgagataaggtttttttttaaagtgtgcggcactgtccccttctctcttgctccctctcttgccatgtgatgcgctggcttcctcttcaccttccaagatgattgtaagcttcctgaggccctcaccagaagcagatgccggcaccatgctttgtgtatagcctgcagaaccacaagccaaaataaaacatctttttaaaaaagttactcagcctcaggtgtttatagcaacacaagaacagactaacacaaagaccaaatatgtgtttcacaatgtcacacacagtatttccattcctctctaaacccctcttctttcagctcacattgcagaggcctcgcctggcctaatgccttggccagtcaggactggtaatcacaacagcttgaaaaacaaactagatattctaccatctctagaagttcaagaaccaagtctctgatcttagagagtttcccttaagtgtaaatggatattcctctgcctgtgatagaggctagcaagcctcctcttccagccagtgctacaagaggtagggagtggccacacgccaggcagcaaggctgtttgtcttctcctagcctcccctctccagcgttctgcctgaagaatgaaatcaattagagagcatcaagagcaggagagctctttccccattccctttgaaattccttgttaggacactgctttgtagatggccccgcaccaccatgtttaagagggcagagcagtgtggggagggcaccaggggacctggtctgagaaccactggtgccatttacagagaagaaaccagaagaagcaaggaatctgaaagactcctttatcccaaagtcaaaaattaagcctaaagaaactgcttaaataattgtatcagactagttttaaaatctattgagctaaaattatttttttctctcttgctacccagcaggtgagggctcataagggagatcagggtgattaagagaaaaaagaaactatacattctttatgcatgtgagcggagtgagtaattttgcaaccctgtttacacatgaagggtaggcagatgtgagtttcagcagtcaaaatcagaagctgaggttgctgcatctggcttactcccctctccataacagcagaatgtgggatttccaagacctttcttgagggcctggtctctcctcagtgaggtccacatacttatatttagaccatgtaagaacgcattcattaacctcgatgacaatgttcagtgtgggtaaaccacctgcttctctttggtgaggccggtgatcaccgtgggatcttttgtatccaagaagttgaatttcagccactctctaatttcaaccacacccattgtcctgggtgtccaggacaatgaccataccagagagtggtaacccactgctgagaaaggagatccttgtctatgatcacccctcactcctaacacaagaggaagatgccaaagaccagctgaggagaaggaaagggaggaataaagctatgtaatgactaaggaggactaagagattttactgaatagacttatctagcaggttaacgtgaatgggggtaaagggatttggtgctttctgtggctgaaggttgctattactctagaaatggaaaatgagaaaaatatctccttctccaagtagagaaacaaacactcaggaaaaaactcacccttcctgtctatgtaccatcttccctgatgacaggtagcagaaagtatagttgagaggtgcccaggtttgaaagttcaaatcccagttctgccatttctctcctgtgtaaccttggacaagtttcttagcctttttgtgcctttcatttgtaaaaaagagaaaataataataccttcctcatgggatcgctggagggttaaatgacacataaagcctaaagtacagctcctggcatgtgataagccctcaataaatatggctattattatttttataacaagggtaagaggaatatgatttcaaaggtccatctagtttaaggcatgtgtaaatttactgacaagtgattcagggtaaactttaattgaattttcaataaacaagccatagggtttcttcctccacagtctatgacccttcaccaggacctgcatcccacaccctggaaagaaatgtgttcattcagtgaattagatcctttagccaaacagcgtttgcaaacaactgcttggcatcctgaccctttctgtcactgagggtgttctaataaccatgttgggtaagaagacagtacccacctgtggtccctttcttcttgtaggttatgttcaggatcaagtcagtcttcatttgaaatcggcacttcagcaggataacaggaaagaaagaggattttggagtcaggaagctctggcttttaaattttggtctcatggtttcctaattgcaagagccaaatagttatctttaaaaatggggataataatatctacatagtaggggcttgtaatggaggattaaattaaactatttatatatagtgaccaatatagagttggcactcattaaatgtcagtttctcttcctctttccccttttcctgctgagacacagagttagactactctgtggggtgggacattcatcaggtggtgtgttggtttatttttctcccacttttctgaagcaagagatcatgaagatgatgggaggaaacaaacatctactgctctaaccttttcaacctagtgaacattgttcatccttctcttctgccacttaaaaaaataatcaaagtccagctgacacagagttatttagctactctggccatttttatcaacctagaaataagtatcctgtttatttctattaaaggtggatacaaataagacctcaggaaaatctaccccagtatctacacgttatgcccctttccaaagttgaagggatatacctaacacccaagggggcagggcaagtgaagtgtgtggtcaggcgtggccatggcactgtgatgcatcattatcaagggaggacatagtgtaagtcctgccagctctttccaatccaatcacctctccttatagtaattcacaatcacagagcccttcttcccctcttagattcccattcaagcacccaaccatcaaactcactgaggcttcaccctacttccccacctaccccattctcttcaactgccagagggctttcctgagatgaagcagaggctgagaacctggggcccttggacgagagacttagctactgacacatacaagtgctgacactggaaagtaccagtgctgaatcaaaaagccacttcccagagacgacatgaatgttcaaggtttggttcctggaacgccaccgatctggtcctgaaccttgaagccaacatcttacctctgtccttccatgcctcagttgcccagtatgtgggaagggtaatgacaacaaaggaaaattgccacctatcgcccaacctgtcatcactataatttgaatgacttggccaaccttagaatgctgtggaaattagtttactggggactctgagatgaaaggtgccaagtttggcagagctgaagccattggtaggatgttctggggtgcactgaagattcaacagaatgttcctttagcttgtaaattgaactttcatttttgtcaaagtagaaaattttaggtaacaaatatttcattttttcctttgtaaaatgttttcttctctcccttcccaagttcggggcatgaccagttgtgttggaatacgaaacccactcctcccagttaaaatgttcacaattgcagtttaaaaaatgacgaacatcttttagattatttttcataccatgcctactaagggggtactatctagcttttaaaaaaacttccttctctttttaacaaaacaaaaaaaatttgcaggattgcaactctgtgagatcctgcccaactttgaccctgaaagctgtctttgcctccagctacattttcagatgaccttcatttcagactcattttagaaatgtagacattttgctcctgggccacttactctttgcctctctgcttaaacttcaagagtataaaaggaaaagtttgcaaagatcatttacaatgtgccatcccaaacctctcatgtaagtgatgcaaagcaggctccagtgggccttggtgtctctgatgagaggagcaacgtgaatgcggaggaagtgggtaagtgagaagaggccctgaggctgcggtggtgactctaccagcaaagtcagcacctacagactgatgaaggcagcaaatgggcttgtgtagtgctccacagtgaagctgccctatctgtgagcatcaggagagctgacaagccaagtttctgcacactgtgcactgctaaatgctgtcagtgacacaggcatgctttaaagtcaggcgactgtttcttgcaggactaaagcctctgcctcactctcacctgctcaatgcttcccctcactgccatgctttgatccaaattcttcttgtgaggggactccccattacattctgcttttttctactttaacttaattcccagtggcaggatgtccacagttcagcttatacccttaaaatataaaaacaaaacaaaaaagtcatcattatcatcaaaataatttttaaaaacagttccccacccctgacaattttggcttggatttctttataatgctacagcttctacccacttcttaccttgtattttcatttatcttctttggtgcccttttccttgttcttccttttgggccaatctattgacagccaccctgcaaaatggcaaggaggtgaatttcctttcttataaattcatcctcaaaataattgcatgattaaaacagttgtgggccctctatcaagagtaatcagcaatgtgctttgaagcctggggtctgctgactctctgatggcacctgggaccatgtttatctccatttatatgattcggccaccactctgcctcactgggttccctgatgttagattgctttgaggtcttttgggagaggaagatctaccaccagagcttcaagttagtgtgacaattctccattgaactcagacaagagactgacatggtttcttgccaggcagcaattagtgactacaggactgaagtggtttccaagattcaggatttgcctagtagttgtaagaggtaacagccaacaggagaagaggagacccaaacccagactatgctgtgaagtgtagggcatgactggtattctaaggaaggtagtttccacatttttgtggcttgtgaatcactttggcaggataaaatttcccaagggccaatttacccgaccgattaccacttgccaatgcaaaaccaaataaacgtacatatgtttattgggaagaaaaccaaagctttggagaggacagggacaatgtctttggatccccagggcctaatggtctcaaaaaatattcactgaggtcatctgattcctctgagaggctaagcatacataattttccaatcattttggtcttcgtactatattcagagagtgaatctctgtgttaagtacaaccaggtgatggacaatgggtggactgaatttttcatttttatcaagcatggtatggaagaagcagcagtagcctgaccttctcaactgcttggaattcatggattaatttactgatgatttgttaaagatgtttctgtcttggtaggtgaagaaaggaggaactaaagtggtcacccaaaaagccagaaatccaaacactgttacaggccaaagtcttggcctaagaacaaagaaaattaggcaataggattgggctgtgcctttctgaagtcatgtcagcagtctcctgggccacagctttggcttgctcagatgcaatttgttcaggcagtgcagctgggggcagcagggcttcagctacaaaagtgttggctggtaagagaaaatcaaaataatccccattaagttcccattatcttaaaaatgagaaactctaatgagaggcttccagagcaagctgagcagcaggagggcacctctgatggatgctgtcctctgtaaggatgtcactgtcgtcaccaggggcaagctgagggcccaaatgcctctgcgcagtttccctggaagcagccaagattgattaggcaccccaggactcaggagccataagaaaagacagagaagcaggccagaagcaaggctggcatggaaggagacccttgacctgaagggtgatcatctttaaccctgaattctgttaactgtttctcagaaactctctctgaatctatttaacttttatagtcctggattcttttaggtgtggtgttgcctaaagacaggtaaaatgccccctaagggaattcctcacctctatggttctaaaactgggttctcgtcatatttcaggatgaggaacctttaaaaaaaaaatgccttcattctcagagcacgaagaaccttttataagaagaaggtagctggagaatgcttattctcctggcaaatagcaactgtggaaacactattttcatatagacctggcaaacagcttccagtattttctgtccaaatactacatctcctcaccagctttgcatgtatcttggcactgcacggcccagtagtaccacatcatttcatggcactgagccaagagtgtgcccagccgtgcttagcaccatacagggagtctgcagggccctccaagctcccaccaccacactcctactggagcagaaggggagattatcaggcagcaagtcacggtgttgttattattaccctgatgtgtaataaatctgtgtggtgcaataaattaaggcaaggctctgttctcactttacaggctgccgatagttttattgtaacagctcaaagatgtgagttttcctttttaggcagagtagaggaagctgtgaaatttgaagagagaacaaaagcatactcgaatgtagtttgtaaaacaggtattgtacaagaactggctcatcaggacatccagcacctaatgtttttctatttaatgatattagagaacagtgaggccttacaatggccacaagagttcatttgaattcattttcttttatttatttatttatttatttatttatttatttttattgattattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcactgcccttaatccatttaaccctgagtggacacagcacatgattcagagagcacagggttgggggtaaggtcacagatcaacaggataagaatttttcttagtacagaacaaaatgaaaagtctcccatgtctacctctttctacacagacacggcaaccatccgatttctcaatctttcccccacctttccccactttctattccacaaaaccgccattgtcatcatggcccgttctcaatgagctgttgggtacacctcccagacggggcggctggccgggcagaggggctcctcacttcccagtaggggcggctgggcagaggcgcccctcacctcccggacagggtggctggccgggcggggggctgaccccgccacgtccctcccggacggggcggctggccgggcggcgggctgacccccccacctccctcccggacggggcggctggccgggcagaggggctcctcacttcccagtaggggcggctgggcagaggcgcccctcacctcccggacggggcggctggccgggcggggggctgacccccccacctccctcccggacggggcggctggccgggcggggcctgaccccccccacctccctcccggacggggcggctggccgggcagaggggctcctcacttcccagtagagcggcagggcagaggcgcccctcacctcccggacggggcagctggccgggcgggggggctgacccccacctccctcccggacggggcggctggcctggcgggggctgacccccacctccctcccggacggggtggttgctgggcggagacgctcctcacttcccagacggggtgactgccgggcggaggggctcctcacttttcagacggggcggctgcgaggcggagggtctcctcacttctcagacggggcggccgggcagagacgctcctcacctcccagacggggtcgcggccgggtagaggcgctcctcacatcccaggcggggcggcggggcagaggctctccccacatctcagacgatgggcggccgggcagagacgctcctcacttcctagatgggatggcgaccgggaagaggcgctcgtcacttcctagatgggatggcggccgggcagagacgctcctcactttccagactgggcagccaggcagaggggctcctcacgtcccaggcgatgggcggccaggcagagacgctcctcacttcccagacggggtggcggccgggcagaggctgcaatctcggcacttagggaggccaaggcaggcggctgggaggtggaggttgtagccagccgagatcacgccactgcactccagcctgggcaccattgagcactgagtgaaccagactccgtctgcaatccccgcaccccgggaggccgaggctggcggatcactcgcggctaggagctggagaccagcccggccaacacagcgaaaccccgtctccaccaaaaaaatacgaaaagcagtgaggcgtggcgtcgcgcgcctgcaattgcaggcactccgcaggctgaggcaggagaaccaggcagggaggctgcagtgagccgagatggcagcagtacagtccagcttcggctcggcatcgggagagggagagggagagggagtgaattcattttcatatcaatgtctcactgctgagttctgctgagctgacctcttgcactagacttacagtgctttcttttggtgataaacctgagcgattttaagatcacaaattggttctggaactcattaaagtcagcaaatgagcattaaaagatacttgcacaggctgagtttgtgctaatctgtctatttaggcaattacagctcagaggatgaacagaggggcggtgagaaagaaccctccaactcccagcaagatgatccatttcagatgtctgtcaacgatgcacatgccctggcttttcttcctttacaccttgaaccctgggtgcaggaggcaagggaaggatttgagaatgcttcacctctaccctttgccaggttcaaagcccaagtgagaccttcaatcaggtccctggcacacctgacacttcattattattattttttttaatcaaaagcccacttctttggtagcaaatgctatttctattctctgttttagaacttgacccttacttttttttacttaaatgttagtcattcaagatttcttaaccctttggttacagagtcttccatctttttcttctgtcttcatctaggctcataggttatttctccctaaactagacacactgggtgctggtgctccgctctgtgtcattgtggcccctgaacaatgggaggctattgagcacagagttgatattcaatatgtaaatattgattgacttttttttgttttttgagatggagtcttgctctgttgccaaggctggagtgcagtggcatgctctcggctcactgcaacctccgcctcctgagttcaagtgattctcctgcctcagcctcctgagtagctgggattacaggcacgcaccaccatacccggctaatttttgtatttttagtagagatgggtttcaccttgttggccaggctgggtttcaccatgttggccaggctggtctcaaaatcctgacctcatgtgatcctcctaaagtgctgggatcacaggcatgagccaccacatctggcctgattgactttcaaaattgccttctagtttattctgtaaccaccagctctactaatttagtttaacatcattcacgtactgctctgaaaaactatacgccccttatgaccttacagccaaaaatgattgactcccttggtaatcctccttgcaaaaccctaagactcaccccctcactcttccttagaaaaatactatattcctttgcttgagtctcatttattagcagcaaatgctaacacaggaaacttcattctctgagtttacatattcttgtgaattctatttttctctcttatttttcccctaatacagtctacccctggccaatctataacaatcctaatcagtagaaactctggaaaaactgaggtcataatttctgaatctggtttgaatttggaatttgctccctcagctcaaaattaatattgtaaatttactgcaaatgtgttttctacttttcggactcagctagtagttttatacacaaagtttgctatctggcttaactagttactgaaagaaaaaggacatctccagctccttttctggcctttctcctattccactacttccctccacccaacacacacacacacacacacacacacacacacacacccaacaccagtcactgaagatggggaagatggagttcttccttgaattccccttaggttgtatcattgtttggaagttattggttcttatccaaaagcagacgtggacagagtaaggagttttagctcagccatataaagtagcataagccccaggctttaatcttcctgtaaggctgcactggtatatagtcgttcttctactgaatataacagatccatattaacaagcatttattgagtgcttactttgaaaaccagtactctattgtccctcatattatctcatttaatttaattgttgctctttaaggtagtattcccattttataaatgcgaaagcaaatattcagaaagtgacttgtactgaatggaagaaacatatttttttttattccaagcccattgccctttcttcttgtttgatttttaactttgtgataatagagctctattacaagaactggaactgtctgtacagttggttattcttaaatgatctacacagagtgcagaagtcctattacgacaaatcctattacaacaaatccactgtaacaaaacctctttctaagaaaatcccattctagagctgtcattggctcctaacttttatctagtaaacattcaaggaatattttgtaaaagtttgcccaaatttctcactggaaattttgtgcttaggatggcttcaaaattgggttcaagtatcaggcactaagggaaggaacaggaaacctgatgatattgtacaatgtttggtgtgtattcctttataccataaatagtgagtctaaaagttgtgttagctcagtttgttgtaaagtgacagtaccatggaaatagaagggaataaaaagctccacttcagatttttttaaagttacttgaatcataatgtcaatttaaaaaaagtaatttgcttaatgaataacggtttatctttcctataaaaatagctaatagtttttgagcacttatgctgtatcagttaacattgtaaatttttaaatgtattatttaaccttcacaacaaccctgtgaagtaaatgttatcctaattttacgcacaagggaactgaagctcagaacggttaaataatttgcccaaggtcacacagctggtaagaagcaggatcagaatttgaactcacgctgtgtgactccagagcctacatgtttaaccacacttagggttgccagataaaatatagttacactggatttttgggtaaacaaatcctaaatatttcatggaacatatttttactaaaagcacattttttgtttatctaaattcaaattcaactggggatcctctatttttatttgctaaatctagcaaccctaaccacactattctgccttctgtaaattcagatatccatatatttgggttgtttaatttgcagtttacacgtgcttgagtttttttttttttttacagaataaatgatgttaattcacatctacaaaactaggcttctggatttctctttccctccatttattgaagggcgggttggtctgatgccagtcttctccctgatagtgaagctaagtgcaagcttttctcttctgataaaaaaagacttcacttactgttggcacattctggccttctgcctacactgggctctctctccagtggccagctgtgtcttgcctggtgctcatcattatccaacttccttgcctcaggaatccttgactctttccaagatttgcagaggtgcatggctaagtagcagcttccttccagacaacagtgttcacagaaggaaagagaaaagaatcagtgggctagaacttagaagaactttatatataaagtctgttgaataaaacatataaataggcaatatatacaccaccaaatgaacaactcttgtttctccatgggtatcttccactctgatttagctctctcacaatgcacaatatgcacctgcctgtataccttctttcaccactcggatcacctaagctgaaaatatagaaactgttttcaatggccatcaagaaaccaactgtattgccgctcaaatcacacaatgcattaaaaaacaaatataaaagcctttggagttggctgatctttatcatcttttaacaatgtgaataaccgaaaagtaattgtctatttacaaacctggatgtttatagaattacctctatagtcaagatcttttaaatatttcaaacagcctgaatttctataacccaagaatagaataatagtaatagatatatttattataacataaaaataacattttgtcagtatgtgccagtctctatgaagagtattgtccatgcattctctctcttagtttttaccaaagtactacaaaattttgtactctttttagtatcagatgacagacaagaacactgaggctacaagaggttaagtaatttgtccaaggctgaacagctagtggcaaaagctgcatttaaagctatgtagcctcattccagggatcatatacttaattactgcataacaatacctctacatcataagatcagtggtagatagcgcttttttggtgaaaacgtagggttttttttttttttaagttttaaatctgttgcaagctctttttctttttctttttctttttttttgagacggagtcttgctctgtcacccaggctggagtgcagtggcactatctcggctcactgcaagctccgcctcccaggttcacgccattctcctgcctcagcctcccgagtagctgggactacaggcgcccgccaccatgcccggctaatgttttgtatttttagtagagacggggtttcaccgtgttagctaggatggtctcgatctcctgacctcgtgatcctcccaccttggcctcccaaagtgctgggattacaggcgttagccaccacgcccggccagctctttcatttcaaaggcatgaagtgttctctttgttaaatagtaaagaacatctaggaagaggagaagttgggcagtaagtggccaacatgataggattaaatgaaacgctatgtgactagtacatagcttatacctcatgtaaccaaccataagacttggacaacacctggactggtccatgccctgattcacctagacgaggccactaatcacttgcttggatatcacagcaatgttaagttgccagaaaggattctaaatgcttactctcactttctttacttatctcaaggtcaactggtcattttgtggaccagcatcaacaatctatggaccacattttgagtggcactaatatagataacatcggtttagttaattcaagtatacaaataaccagtgaagtatatggctcgcttatattctctctctctacgaaacacacagacacatgctcctgaatatttattcccgaaacatttactaagaacctactatattcttgttacttttctaggctctgagaatatagtaatgaataaagcaaatcaagtacctgctttcagggaacttaaaattctaattcaaccaatgtcttaatacccaaacatctgggtaccagtttgaggccttgctaattaatagctctccgcttttgtataaattcatttaatccttctaagcaagtctttctctttacaaaatgagactaataatacgtactttaatgtcatcattggtagcattagatattgtgaaaactgtaaaatcacataccaatgccaggtcacatttttatcatgggcccttcctgagtgaagggatggtatttttcctgcctttgtatccttagcaggaagcataagggcttgctaagtggcaagcttaaaaatatattttctaaacatttattagatggaagcttctttttattgatatgtatcacaatcttcttaaagtcttcaattggtcctagaagtgtctatgcttttcctgtcagttctaagaataatggtgttctttagcattacaacctagaactgaattgtaaaagtgccctaagtttggggaggaagaaattctcagccaataataacatgaaaagaaatgtacctagtctgtttctcttcaaacgtctgaacttcatgttagaaaagttgcttccagggtataaagactttctttttgagggctagtgatgttactgttagagttagacaggggtatggatgctctacagatttcatgaaagtgcataactacattcagtggctatttgaagagtaccttattttataaggtgccccttatactgcaagggacattagcataattaaaacacagtgacttgcaaggaataatatttagtaatgagaataaaatgaatacacaaaatgcactataaagcagcatataagtgccataggtgtggaatgaataggaactatgggacttcagaggagggctccacttaggagttgcaatatgagacaggccttcaaggatttcaacagattttaggtttgatagagggaatggaaggcatttgttgcaggcagagaggtaacttaatacgttgactcctttgtaaaaagttagtaggagttacagcaagtagtttgatatacatgtaagggtatagtgaaaggtaaggctagaaaagtgggatggagatacacaattgggcaagtgccagattgagcagtttgtactaaatttgatggggaactactgatagtttttaaaatagggtggagtcatgatctggacaatgcttcaggaagatggttttggcaagaacacaagacggactgaagggaaggcaaccaagcaggagaccaaacaggagatcacagcaaaagtctcgacctaggttaaccaatacctgacctagggtcgtggcaatagagctagagaggtgggggcagctggaagggccattgtgtagaaagtatagtatttatacctgtgcagtccaatatagcagctcctaattaaggctctttaaatgcaactttaattaaaattaaataggatttaaaattcaggccaggcgtggtggctcacgcctgtaatcccagcactttgggaggctgaggcaggcagatcatgaggtcaggagattgagaccatcctggccaacatggtgaaaccccgcctctactaaaaataaaaaaattagctggccgtggtggcctgtgcctgtagtcccagctactcgggaggctgaagcaggagaatcgcttgaacctgggaggtggaggttgcagtgagccaagaccgtgccactgcactccagcctggtgacagagtgagactctgtctcaaaaaaaaaaaaaaaaaaaaaatttacttcctcagttgcattagctgcatttaaagtgctcaatagccatatgtaactcctgtattggactatgcagataaagaacatttccatcacagtgcaatgtttattgaacagtgcagctcactatgctttagggactaattaggcatagaatgaggaagatggattaaaggaggcttcggtttggcagctgagtgactgagaaaggtagtgccatgaacagaaaagaggaagtcaggaagaggaggagctggatttaggaagaaaggtgtttagtttctgtcaaatactaggccagataaagtgtctacccaaatcatcagatatccctggtgaaaggaaagggcagggaaagcaaagtgcccattgggttctcccaaagcttgtaaaggagccctgggaggatttaattggtttatctcctcctgcactcagtttctcctgtttgtgcagctccctgaagattatgagtgggcaatccagttcctcaacctctccaaaccaatggttcacatataccgtgatgaggacagaagcccaagggctttgctgtttccttagctccttggagccagcttgaacctttttctcacagatgctttgtgcttcctgtcccctaaccgccttactcacccttccccatgctcaacttttggaaagtccccttggcctcacttgtttgattacttcctctcaaactacttctcacagggaccacagcaaaccattgactctaccactttttacttgccctgtcttccctcccagcttaaattccaaggtctatcactataatcactcccttacataatactcctacccctctcataggctttccccagcaaaactcagacctggtcaaatacaattctcctccaacccccaagcaatggagtgtggctggaggagaatcacacggccttgctgagtggtctcactttaatgtatgatcatcaactcaagagggccctcagcactgtccatgctaagcttctctagtcacttttccactcttcaaggagattatttctcaccttcttctatctcctttaatagccaacagcttttcattgcatagagaacagatcttacctcatcaatcccagtgaggcagccagtacatatggcactcagtggaaactgggaaaaggtccatacgtgtgtgtgtgggtatgcatgtgtgtgtatgcgcatgtgtgtgtgtttgcgcatgtgtgtgtgttatatgcaggatgctaacatgcaccacctctcctggtggagcaatcagaaaagtaccccttcctccaggctgatgtgaccccaccagggcacgtggctttgtgggcaaaacaagggctacatttcagctcctacctgccgcctctgctctacaggggcctgagcgtgccacaaccaaatgtactgtctaatctatctgcttctgcacccagacactctaccttctctccagaaacagtgtgtgaatgcattcccttactcctatcctaggccaaccctttcacttctgtgctagatccaattgcttctcacctatttgaggacactctttctccagttgtctcctcttgccttctgtgtcatcaattttacctctcttacagagtctcgctctgttgcccaggctggagtgcactggcgcgatctcggatcatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagcatggacagtgctgagggccctcttgagttgatgatcatacattaaagtgagaccactcagcaaggccgtgtgattttcctccagccacactacattgagttgggggagcaagaatcagcgtcaaaaaaaaaaaaatcattccagcatactaaaatgagaaaaagcatttctcatcttaaaatatcctcccttgatctcaagtacctctctggctactgcccttttctccttcaaagcaaagcctctcaagagctgtttagaacactttctcttcctcacctcccatcctattaacataccctaatcagactttctcccctatgactccactgaaactgttttcatcaaggtcatcagcaacttcatcaggccacatccagtgttcaaattctcagtccttatcttactaatttcagcagtatctgataagactcttcactctctccttcctgaaacaattatcttgttttccaacgcttcaccttctcttggtgtttctcctgccctgactggtagcgcctccttttctacttaaccttcaagtgttggagtgcctcttggtcctttccttcagctatctcccctccccatgtgatcctaactagacttaagacttaaaaagtatctatttgctaatgaatcccaaatgtatctctctagactcatatatcgattgtttattcaatatctccatttggatgtataacagacaccttaaacataacatgtgtaagaaaagactcttgatttccccatccccaaatctgctcctccatttcattaagtggcaccgccattaactcagtcatcaggcccgaacctaagaatcaactcttgatttctttttgttctttcacacactatgccccaaatccaaatccattccaatcaaaatgtatctaaataaaataaaataaaataaaatagccttcttctcatcctgtccgtggctgccaggctagttagtccaagctaccttactggtatcccaaggacatctgtgcttctccattgtgtattttacacacatcagcaagactaacttttaacaacatgaatcagatgcggtcattcctcggctcacccttctctcatggtttcccgttcctgttataatggcccacaggcttcactggatctggccaagcctagctggtactgctctcgggctggctgacgctgctcagccatgccggcctttcactgtttctgcaacatggcaggcgtatccccacctctgggtttatggctgattttctctcagcttggaaaggctattcctcctccaggcccgcgtgtttgcaagacttattccttcatcccgtgtgtatgcgctcaaaggtcttctttgagaggcagtatctcaccaggtgtaaagtcaccctatcctctgctttatttttctccacaccacttatcactacctgcaatttttgtcacttgtttgttgtctgtctcccctctctcactccaccagcatgcaagctgcaagagggtctttgcctgtctatgactttaaacctctgcgcttagttagaacagcgcctggaacctaacaggtgctcaattagggcttgtcgaatgattgagttccctccaaattctcttcttgaatctttggacccttcctcatcttttttccggtcttacccacctcccatcccgccctacgcaaagctaaaactccccgccccttcccggtagctccaggctttcccggctccagtgtgcgcggctcctttaagcggactccggaacgccgtggggaaggcggggccgaagcccagccatcgccaacttggaggggcggggcagaaccagggggcggggcctgcgtggtgcgtgcgtgcgcgttctggaggaggcgccgccgccgctcccgaggcccctgccgccgccgctcccgctgctgtcgccgcgcagagccggagcaggagccacggccgagaggagggaggaggaggaggaggaggtggagaaggtggaggaggtggaggaggcgccggaccgggggggtgagtaaggggcggggagctccagacggccccagagggagcggggggcgcgggtcggccgagccgagggtgaggcggctcatgtcgccggtcagtcgcctggctcccccttcctcctccgcgttccatcggtgtcggggcggcggcccgggggcctggccggcgggaggggccggagatctgggaggcccggccgccgccagggccagagccaaccacgcccgcggaccgacccggtcgactgtaggcctgcgggagaccgtcgggaggggccccggccggctgtgggagagaaagaggacattgtgtcccccacccttcagctccccgaggtgtcatagcacaagcccatttccctcgccgtctccccagacacggtgccctcgtacctcactgcctgagagaagtagaaggttggacatcgctgccttcctcctcttgcatgtcccctgtctagggtcagagcttccttcaaacccagctctcccttttgggcccgcgggggcgggggggagggacacacggggaacggggttggagggttgggtgaattctctgtcctctgctgtaggagtgcgggtagactggagcattgctgtctccgggctcacttctgtcagggttcagggtctccctttccttcctttattcccccagttaatagggctgacatctacatcccactccaccttccagcccctttcccgccttctttaccctcatgtcttccgtagcttaccatgtgttcgccttttcagtgttacttttcatgggtctctgcttcttccctgaattttgttagggaagaggtcacggtgtgattcttgttatccttcaaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaacagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatttctgtgatactttgacataataagcattaaattaggccccagactttctgtctttattatgctttcctataacattgttgttttgaaatcatatagttcgatattcttttgtagcgtgatatttcagtgaatcctgtctagttttcttggtgttttaaattatggcctacttcagatacgattagctgttaggtattgaggatcatacgtgttaagtatttgttgaatgaattgaatgattacaaagatgagtctagttattaaatcttctgtccttttgagaggtaccctatattaggatactgcagtccatttccagtttgtaagatagtaattcttaaccttttctaggccactgacacctttgagaatatgatgaaatatataaactctctccccagaataaagttaataggcatttattcacaaaattttgcattagttttagggaccctctgaggccaaccatgaacttatgtcttagaagtgaactggatggaatccctcagtgttacacagttccatattaaaacagctcaaaagcctttgttcactttttgtatggcttcaagaaggacagtatctacacttaatataccccagaagacaggtatattcatatacgttgttcctgtagtccttctgaaaatgaatcccaaggaaatattccaaaagaaagaaaatgttgtatatgcacatgttcgtttaattattttaatagatgggaagaaaaggaaactacttgcccaacagcagaaagatacacaattttgcaatcactgaaaaaggttagaagtgaagattattaatctcctaattgatcttccagcttccactcttgcccctccaccccaagttgatttccacacagcagctacaatgatgctcacaaacttcagaacaagtctctcttctattcaaaaccctccagtgttttcccatctcattcacagtagaatccaaagttcttaccatggcctacaagccttacagctgcccagctatttccctaatctcaagcccctttacttttcctcttgcttactgtactccagccacactggcctcctacatcccaaaaaggtcaaatacactgaggtgtctgcacttaatgtcctctctgcctgtaacctttttccccaaggcagtatatatccctcacttcttcaggtctctgcaccagtctcaggtcttcccttactacccttccctgccactgtttctatcctctcaccctaccttatactcttaagactaggttatactgattttgacagccacagttgttgacaaacattccatggtaatgtcgcttgtatacttgcattggacattattgtttaacatttaaaaaataatgtcagtcataaaaagataactttcagattgttaagttgaatttttcaatagctcacatttaaattttggatgttagcttacctctcttcaacatttaactacaggatgctaattgttggatacagagatgaattagacagggtctctgccctcagggagtttcacagtctgtcattgtttgtattgtaatagttaagttactccagatcttgccagtgtttagttttacccatgaactttagtgtatggttgatgatattttatataaaatagggattagacatccagattttcatgttggtaattgttttttttccttacaaagggatatttttaaaaattaaattttttttgagacggagtcttgctctgtcatccagcctggtgtgcagtggtgcaatcttggctcactgcaacctctgcctcctgggttcaagcgattctcctgtctcagcctccccagtagctgggataacaggtacccaccaccacgcccagataattttttttttttttaatcgttagtagagacgaggtttccccatgttggccaggctgatctcaaactcctgacctcaagtgatccagccaccttggcctccaaaagtgttgggattacaggtgtgagctactgtggctggcaacaaaggaatttttaatggtatctgtaatttgtttaatttctgttttgtatgatgcttttagaatattatagctgtgaccgccccatgttttgttctttgagacagagtcttgctctgtcacccaggctggagtacagtgatgtgatcttggctcactgcaacctctgcctccgaggttcaagggattctcctgccttagcctcctgagtaactgggattacaggcacgtgccaccacacccggctaatttttgtatttttttttagtagagacagagtttcaccatgttggtcaggctggtcttgaactcctgacctcatgatccgcccgcctcggcctcccagaatgctggactcctgcggctgagactattgtttttgttaaataggtcaacattgaaattttatttggtttataggggatgacgacaccagccagttttgatagaaaactataccactgtgagggctttgcccagaatttctggttctggaacctagatggcttgatttggcataggtggggagctttgacatctacacaagggagtgggttgaatcacttgagttacttgaaagcaccttgctctgtttctgacatgtgatagggacaccgtaaatgttcattgaacctcagatcacttctaatctcgtgattctaaaattctcttattttagttggtcaatgaaaataactaatgtaaagcatttatattttaatattgggatacatttgaaattgtgaatgtaagtttactcgtttataatgtcccttttcaaattaattggttataacaattaattgattacatctaatcatttgtaagaagagttacggcctatttccaagaattttttgcttattctgatgtcatataattgctgcattacttaatgccagattcatatcttatgaaaaagattagcattaaacaaaaatatttaagctttagtatgttactgagacagatgaagtgtccattttttcttttattgtgtgcatgaagtatggggattacaagcagtagtttttatgtgctttttagtttttcatatacaaagataatgttaatattagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttccgcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaaaaaattctttataaatcactcaaattttcccagtgtttcttacctctaacctatttagtttacactggtagagtggttcaaagtgttaaagttaaccaaatttaaaattaaatgtgtaatcatatgttttagtgtccgaatgtatttaaattaggccatatttcataagaatagcagtatattaaactaaaaaagctaataaaagatactattgggttaattaaaacttgaagtgccttaccttgaacacctaggtgtatacgcctataacatgttactccttcacggttttttgcagtgcagtgctgtacccacttattctggaggtaaaagataattttgttcatgataggactgtggttagctgtctttcgttttttaactgttttcttttttttttgttttgtttttgtctttagaaaagacaaaactataaaaagaggcacaaagaactgaatacaactatttggacatatcccaaatgcagtttatatgactctaagttagtagtggaaatctcttattgctgactatacatttcagatatgtcagatgtgtaatccagagagtaaattcactcactgtattttcagtgatattttaaaattcatttatcagtaggatcattctgttctagacaagttggctatattataaaacattaagcaagcaggcactaagttaaatattgtagcagttgaaatttaatgctaatcttacagttttacacagttaacaatctaggccaaatctattgatacctttggaactaccctttaaattccatcctatgcttgtgaaaaggttgcatataatttcttttcctttttctctcttctcttcctcttcttttttctttttctttttctatttcccttttcttcctttttctttcacagagtcttgctatatcacccacgctgttctccacctcctgggctcaagctatcctcccacttcagcctcctgagtagctgggactacaggcgtgtgccaccacagttaattcataatttcattaatagatttcagattcagtcattgaacagatgtttaagtaaccccaaattaggctctttgatggatactgagatgtgaaggtgtagtttctgcttaaaggaatttatagtctagcagtttattttgtttgccacagcctgtcatgtgttttataaatcagtgttgtattttcatgatagagtgaaaatagaatgatactcattttttaagtaaaataaattgtgaacatttcacattctcttagttggtgaacagctattttggtggtcttgttttctaacagcttatgagtattagaccaaatcagtttcccagttgtttaaaatagagttaaataagaattgtttgctttactgcctgttttacttcagtccaagacttattttttgtaaatagcttttctgcatatgtatacatacacacacacacacacacacacacacacacatatgcatgtatatacacacgttgtagggaagttgtttcctggttcagctagcaatttcaattctctgtttaacgtcagaagttgttttgtagaatgggatgttaatatttttttctacactgattaaaatcatcctttgccactaaagtcaagtatctgctaggacagaaatgtgcaaatagcatgcgtaaatgtgcatttttagtgactgttgttagcttgacagttttattttcaagatcctcttctctcccgacctaattaattatgatgtgtttataaggcaacaataatatatttagttagtttgcaaaatgagaacaatttttctggtttttccatttttgcatgttttgagtttggattaattggacttgtattattctcagtagacatatataataaaatagtccatttaactgtgattctttctcttggaacattggctgacttttagatagtgagccttgtgcagtttcataaatacaggtactactgagttttggatgacattctttacacaacctaaaagtaaaggtgagcataatagaagctggaaacaagctgctgggcataatagaagctggtaacaagtctgacgttttctttgcactaggaaatgtatttcttattccaagtaatatgcccttgttaggttcaggatctttttcagtggttataactgcttaaacatttttttttctgtttaaagtaattcatgttatactgtggcaaattttgaaaaaaatgttaagtgtaaagaataaattgaaaacatccatgatcctatcatccagaaaaaattactactgatactttaatatacatttttccagtttattccttgcatgtacggattttttatttattttttttacgaaacttagaattataactttatatatactgttttgatcatacttttttttcctgaatgggatgttggtctcctagtttgagactttaaagttgattctttataatattactgttttaaataacactgggacagacattttttgtacatgtatctttgattgcatctctgttttttttttcttcctgtaggatagattcccagaagtgggataactggatcagagggtgattaccctgtgtataagagtatgtgtctcactgcaccttcaatggcattgagtaggtcagtttttacaatctttgccaatgtgatagatatctgttacattcttgggtggtaatagcagaaatcctcatattattaataatctgtaaaaccatcatagtgtatgaaagaaatttgcaattgtcctgaaatgagtttctttaaaaatattttaggtaaaagtaatctgtgaccaaaaaaaaaattactgattaaagttggaatttcagcatttttttttttggagagctagaattttaatgttcttttattaaaatgacaaacatgagaaagcttgttttatagtatgtaataaatataaatattatgtaaaactaaattatttcagatagatgaggggggtagtcacatggttctgactttgaaaaaacaaaaaaaaaatctgtgaatgtttagagcagtagctctggagttgggcagcctgggtttgtgtccttgctttgccacttactaagtacatgattggaggcaacctgctaaatatgtgtatgatttgatttttctgaaccttggcttccttatttttataaaaggagaataatatctaccccataggattgttgagaggattagaataatgtgtaagaccacttggcacataggtatttaataaaaactagctattttcgttaaatttgttttttctgccagtctcctcaagggcaagaaatatctcatttttgtgtttctgtttacatgaataaatactgaaatgcaaatgggctgtggtgagcagtggcagcaggaggggaatggtggacattctttgtggtaggaatggcatgtgccaagatagaaagaaagttcaggagaagttggaggacaggtgattaatttgacagaagcctaggcttttgtatagttagaaaatatggagataagggagaattatggagattggggctagacttttaagccattgaatgctaggttgataagtgtagactttttcaggagtacaagctttggtatgtggaaaatgacttgataaaagcattcatcgaaaagcagatgaattcgcttgtagagtaaagaatgaattgaggaaggaagaggttgaagacagggaatctggattaatagtaacacaggtaaggtaagatctgagggtttaaaggaaaacaaaagggagggttttggaggaagtgcttaggcttcatgtttgtgaagatctgtacaaccaatttggagatcaaattcaaaagaaacagcctaggcttacatgcagttaggcagcctttgagagaagatgggactcagtacactttggttgttactattgtttttttaaaaattgaaggataaaacattccaagattcctatcatttcgtcagtaaaaagcatatatttatgcttttaaaaatatatatgtacaatctcctgcagtaattttatttagttagcattttgagttcttggttaacaggatatcctcgcttttagactttgtatttctggagctattaccttaaaactcttcactgtaaggtgaaattcttctgcatgtggtttttgtagcatttgtgattgctgcaggactttaaaaaaaccagtcgtgtgagcagaggtgatgagaagtgaaatacagacttcttgtttgttaagcagcttctaagtaaaatataggagcaaaaaaatgggaaattgtgtgtatgatgtttagaaaaacattacttttagtattcctgttttctctctcagccctgaattttcctaattaaaaaaagagagtttgcagatgccatttttagtcattctagaacctgactagagctctactcatactttccacttgactgaataatataaagcaagttagccagagattgatattaatagtatttctttttgactgataagtaaactcacatgaactgtgaattgtctgctcggtatcttccaatggagaaaagaagcaaccaccaatttaaaaaaatacaggcttgtgatacttataaggtgtttgcattttttaaaacagtgagttatcatacctttcttaatgtttcttttagtttccaaatactgcctaaattcagaaataaagtacttattatttttattcaaatctcttccctttaaaactatccttgaaaatatttttaaattaataagcaaatgtaactcacagtgctcgtagtgttggggattgtgtgcgtgtgacttttttttacaaatactgtgtttttcctgtgtgaatctgcaaaagcccagatctggtcaactgaatgaaatttcatttgctaaagggatctcagatattcaaaacgatgatttaatgtctacaaactataagagtctcttttaaataggtttgaggatacttctgcctgtttgtccagcagaatctgaactacagtcattctctccccatcattcctactccttaaactatagctgagagaatagcatagtccttagtttgggccattctggcattgccactatgatggcctgttgtcttacatttttagaaacttgcttgcatcttgacagaaaaaataaattattaaattaagtagctagcagtttatgggatactgttataagatagttcatttaatttttacatgaggtgaaatacgaaatgtctgaaatgtgaatagacttttatatgcttctatcccaaaggattaaaataaaacaaaatgaagtgtactggttgaatagaatattatgtacatttttctttatcagaagattttttcatactccttttgaatcagcaattttgaatgctaaatataaattcttgactaagaaatcattccctacagtaataataaacagtttggttagtcgtccaacatgtatttattgagtgattattgagtgcttgatactattctaggaaccacagatttagcagtgaataagacgtgctttcatggcaatttttataccactgaagggttgatgatagtagagagacacagtagaaaaacaagtaaataagataatttcagaggtcccaaatgccatgaagaaactatagcaagatgaaatgatagagaatgatgaaagggttttaaattgagtgttgtggaaaagctcgctgagatggtgatatttaatgtggcacctgaattacaaaatgccagacatataacagtatataagaagaatgaaccaggcagagaaagggcccgttggtgcaaaggccctaaagtgggaagcagatcatcatgtttgaggaagaacaaaaagacccttgtcatcacaaggctaggaaaagcctggtagatgaggttgatagggaacagctcactggatatcattatttctctttatgggtaaatatatgcaacttgtgaatttgaagatggtgttactaataatactcatttaaatctgtagggtaaccagtagtttttctagacatacagaatcactaattcctggtccataaattatgtttttcccagggatctgcagagataggaaggaattatgattagtattacaaaaagtcaaatgaaaattgtgcatttactctaaatagacttatacagataaaatattatgtatcttttctttgaccagtgattatattgactcaaatcattatcatacattgtagcgatttgcagattgttaaggaaataaaatattgtacttatcccttcaagatcctagcactgggttttgttagtttttaagtctttggcaatttgagaattttgattagcttttacttatgtgattaataagatgtcattgcagttggtagacaaaaatctttaaacacgtgaaatccatggaatagaataaagtttttttatagaaaggttgggagccattgattaatgtcctatctgtaatggacctacagggagaagggaactcatatgtttttgagtgtagaccccttacatcctatttaatttgcacagtaaatctacaaagtagatattgttattgtccagtttttttacaggtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaatttcttcagaaataaagtgacttaacctgtctttttttccataaatcatacggtgaaaatcctgaggagagaaataaagaccaaacacttacaaagtataattttctcttgggctttgttaactgagtaatttgtagagtttttggctttaaaaaaaaaaagtctgctttgcaccatagtgttcattatcaataacatcttttggttctgtttatatcttaattttttttgtaaccatttaagaatttagtattctgaaatgaggtgatggaattacagtagtccaaatgtttatgtagccagtgttagttgtctgcctaatatctatcacagtctgtggggagtggggcagggttggtggcatgtgtttgtttctgtcttctattagaatatcaaagtgtgtgatttgttgctcagaaatatgaactcataattctgggtcatttaatggttagtaggataaatgagggctttttttttttttaaactaatgcctacacccaggcagaataggagtatgaaatctctaaaccctgtgtttataaagtttctaatccttcaaattaattaatatcttaataaattctaagtttagtattcttttaaatgaatatcataggaatggatacctagaggatgaaagtaaatataagtaattgagaaattgaaagaaatcagagtaaggttgagaaaggaacgtaattatgatacagaatttaccataggggaataacacatggaagttgacgtgctagactgtggaaaaggaatttattttctcaaaaaagagaaatgaaattgatggaatgagggctaggaggaggtaaattatggttgaaggagtagaatactttggattagatattggagcctacggccaggtgtggtggctcatgcctgtaatcccagcactttgggaggtcgaggcgggcggatcacctgaggtcgggagtttgagatcaccctgaccaacatggagaaaccccgtctccactaaaaaaaaaaatacaaaaaaactagctgggcgcggtggcgcatgcctgtaatcccagctactcaggaggctgaggcaggagaatcccttgaacctgggaggcagaggttgtggtgagccaggatggtgccattgcactgcagcctgggcaacaagagcaaaacttggtctcaaaaaaaaaaaaaaaaaaaaaaaaagatactgcagcctgcagggaccttcagagagaatatgattaatctgtcaccatttgtggcagtataattactacttcatgaggtatggtgtcttgttggtttgagttggaaggacaataaacctagatcgaatgaagagggttgttgtgaagaggtaacatattttaaaatttgtttctagttgtctgagacttggtatgacaggtctataaaagataactttatgtgatattttggttcttggtatcctcaaagtgttggtttttaatttttcctggtggatttctgtatgtcagctttagactgccctattgttgcatcctgctgttctccattctaatcatacagttgatttggtaatgacatacataacccctggcatgaagtttttatgcttcagaaaattgtttggcatataaagtgcaagtatcaatttgctctatagatgtgtatctataaaaactggtgtgattatttaaggatatcagattaacttaagaaaaaccataggcaagtgatttgggagggagaatcttataatcagacacacctttatttgcatgtttagattttcatatattaggttatttcggtagtgtttctttttcgttcaactggtaagaagcctgggactttagtatctcgaaattggtcaaatagtatatactcttaaaaagtttctgtgtcttttaaataccgagtttcacacctaggacaaacctcagttgtaaaacatccctttgaattttaaattactgtttaataacttctgactagtatttcactcaagtgttacaacttttacattggaatatgatagcattataattcaagaaccaaccaaaatctgcagtagaaaccatgggttggagggttttagatgatatactcatcctaatattcccattaggcttcagacgtggactgctgtcacaacagaacatacttgagatgtgtcaccactcagtgccatctgcctacatgggtacataagctatatagtaggccttaaatattggacataaagaatcattgctttgtggttttcttagctgactctgcttaacttctagtgttctgggctgagcctgtagtcaattttgatcttttgcatttataacaacactcccataaccacatgttcagtgtcctctgtgtgttggtataccaaagatggacatgtgaagttttttaatagtgcaaagaaattggctgtttaatcagtaaaatttaaaggtgattttaaaaacattcaaatatttgagagagtgccctttatatgaaggaccaactatctcttccctccctggttaattttcacaatataataaatattttttagttatataggccaaagtgttctatagaaaatcaatcataaaattgcatttgtctgtgctatttttaaaaagttctctattgttacattggtaaatgcagattaccagtgtttacatagtatgattttagtacttatttttaaaatatatatctattcatatgtagaatataggctaaaaggaaacaccaaaagacctagattattatctctgatgtatgggttatagatattttattatatgttatatattatatgtattattatatgtcatatattttatttcccttgttaagccttttatgaactttacatttatatatatatatgtatgtatgtatgtatttatttatttatttattttattcatttattttttcgagatggagtctcactctgttgccaggctggagtgcagtggtgtgatctcggctcactgcaacctccacctcctgggttcaagcgattcttctgcctcagcctcccgagtagctgggattacaggcacgcaccgccacgcccagctaatttttgtatttttagtagagacggggtttcaccatgttggccaggatggtctcgatctgctgacttcatgatctacccgcctcggcctcccaaagtgctagggttacaggcatgagccaccacgcctggcctgttcatatattttataatcaaactaaaagttctaaaatcaattcattatagagtatgaaattaaatttaataaagcttttaaagataaagattcttaggtgataaaatgagttaaaggctttacaaataataaataggatttctgaaatggaattttatgttatggtaaacatttttcctttaaaactaaaacagatgcaaaattaagttgccattttctgggcatggggatgggagaaataggaaagattttgtactgttgtaccttgccttggaaaccttttgattcttctaactcagatttgcttcagttacgtcatatgctgttttatggataagtgtttaattataggatttaaacttatttatataaatggtatgcaaaatcttgctttgaatatttggtcatttgtatttgtggtcagcaggcaaaacactttgcaaaagtttgcatgtagtgcctaccagtttttctcagttttctcatctgtcagtggagaaagaacaatatctatatcttgtttgaggattaaataagcatgcctgaggtacaagaagcacttaaaattattgctgctgttattaccccaaagttgggattgatgtttctttgttttctttgtgttttgttttgtttctgaaacagtgtctcactctgtcgcccagggtggagttcagtggctgcaatctctgctcactgcaacctctgcctgcagggttcaagcaattctcatgcctcagcctcccaggtagctggggttataggcttgtgccaccacacccagttaatctttttatttttagtagagatggagttttaccatgttgaccaggctggtcttgaactcctgacctctgacctcaggtgatccccccacctcagcctcccaaagtgttggaattacaggtgtgagccactgtgcctggccagcattgatgtttccatgaaactgaggtaaaagatccctagggactggaacaatatcttatgccatgtatcccctattttggtcaaccctgtgtattccccattaattaagtgggacggttagttcctcacttaggtagtttcattgtttatgtatacaataaatctttggcattcacgacttaatagtttagacctaaagtatttagcatgaaaaatttataatctggtataggcaaaattttgaattcaaggctgatgtgctgaacaagtctgttaactagagaattgaatatagctgacagtatcccagtttttattacccaacagtgacgtgacttttgttctctacttaattttcatcctagaattaaaaactgtttctttgtgaatttagtgcccggggaaagccagtagttaatactggtttttgcagatttagataaactcttgattttagacaacaaacactatggcaataaagtaagtttattttagtagcaattcaattcatgagtgttgcttatttcttttctgttcttcacaatgtcttgcgcccagtggagataatgaacaataaggtgtgtttggtagtttgtgaagaaaggtaaattttttttttttttttggagacggagtttcgttcttgttgcccaggctggagtgcaatgatgtgatctcggctcactgcaacctccacctcccaggttcaagggattttcctgcctcagccttctgagtagctgggattacaggcatgcgccaccactcccagctaattttgtatttttagtagagacagggtttctccatgttggtcaggctgagtctccccacctcaggtgatccacccgccttggcctcgcaaagtgctgggattacaggcatgagccactgctcccaaccaagaaatgtaaatctttgaattcattaaaggaaaggggtgagttgactgggaatttctagatttctaggctcttatattatttctattacttcagtacataattttttaaatctctcaggccaaattaaaatatatttcctgtctagatttcatatttccatggagtggtgtgatgatgtaagtgtgcttcatttaataaaagctactccggtatacctcataaccttgcagaaatactgattttatgggtctgtgatagggctagggtgctgtattttactcctgtgatcctcagatgattctgatgagatgctttttcaatttatttatctccatattttcattttagtgttatttttaaaaaatggtttgtattatatttttaaagccataggaataaagaagtacattttatagttaataatgaaaattaatgatatatcttagctttccatggttatgttttgttttactttttcaattagttaaatgtacatagattacttaagtcaaactcaagtaataccaagttcactgtagaaaaaaataaagtaccaattagacattatttctcagcctttttagatatttttctaattgtccccctcatgaaattttaatgccacagatataactgtatatttgtttatgtattgtatgtatatctgtgttttatgcactaaaagaataagaattatttttttgcccctcaagagccaattttcaccccattggtggtgatactgctcctgttgagaatgcatgcaataagccaaaagaaaaatcacctttaattttaccttacaacttgttaacattttggtgtacatctttctcagtgatgttcaatgcatatatgccttttctttgatgaaaatgaaatcagatacataatacttcatgctcctgtttttcttaatattttgtgaattttcatgataaatgagtatcttttaacagtaccccatctctaatggataaatactatagatgtatagtagtatgtgaatttgccatcatttgtttaaatgatttgtctatagttttcaattttttattataaaagttctactatgaatatcattatagttgaatttttccatgcatccttaattatttctgtaggataaattccaaaaagtagaattacttcattctgtacattttaatattttttggtgtatatgacttagaaagtgaaagtccatttccccaaggacagccaccatcaaaatcaatctttgtctagccttttcctgtatatatcctaacataaataactatatatattatttatataaaacctacatataaataattttatatagctgtttctgtctcttaaaaaagaaaaatatattgttccttaactacagcaagttgcttttttgcctaacgcattttgcctgagagattttagtcatcccatatcactatgtataattctacctcattcttgtaagctgtatgatacatagtaatttgtccattcttctacggaaggatcttttctttcccattttgttttgtttttgcgtatgtctttgttttttatttctgcagcataaattcccatttgtaatagaattctgggtcatttatgaattgaaagtactttatatgtgctggtctttttctgtgtttatttttctttctttctttcttttctgtttttgtttttgagacagaatcttaatcctacccccgggctagggtgctgtggcagggtcacggcttatccactcaggtgattcccccaccttagcctcctgagtagctgggactacaggcgcatgccaacatgcctggctaactttttgtattttttgtagagacagtgctttgctgtgttgcccagaatggtcttgaactcttgggctcaagccattcacccacctttgccccccaaagttctgggattataggtgtgagccaccgtaccctgtgttttctatttttttcattcctttatttgcctactctggtattggaccagatgttaattacttttgtatcaggaaatataacatgttctaataagtaggcagataagtcacagttgaattttggctaggtgttggtttttatcttttttttttttaagacaagtatatgtattttaagtagtctagaataatacagatttttgaggacttttaggtccaggcagtaattcagaactctaaaggcacatcaaagttgcatagtgaacaaacaagctattgagctgtgagctttctgggaatacttggaaccataacatttctgtcaaatatgccttttaatctttggtttattgattgaagtattttggacttatactctttctgctatcaaggttttattctttttaaaggagatacactatcttttttacatttctggtaatgtgtttagtttaggtacatcatactgtgttgtttctgcttatttctgtagttctctacttataccttcagagttatacatagattttcctgaggtttattaatctaatatagctcaaaatatcagaatagatgttatagtaggtaacacttttctgaattagaatccgattttttaagaatctagtgttttggctggatttatgtaggtttctttatgagaaaacagtaaacattgcagaagaattacactttgctttttaaagtagaaatgtgtttagtttctaaaaatgctaatttttttctgagactattctttctttaaatgtagccactcacagcattgttaaaatttttaaatgttgattctgatactatatactattagtaactaatacattatgaactttttttttttttccttaggacatactgtcaggtgagattctcaaatggttttagtgttctggaagagttagtttacctttgtaatgaaaaatctctcatgagagtactgcactcaccgctaggatgaaaactaatcaaataaatataaaaaatggtagtcagtacccaggcatttcagacaggactgttgtctgacactagcctcccttggagttgaattgtcaccacagccaggttaagcttattacagaggtttaccttgctttggattgtgggtctgcgtctatcaaagtgaaaagccaactttttcccctcatggtagtggtatgctttttgcatggtgtgtttatgaaaattaacatcacaatggtgattttgtgtcgaggtttaccatttaactagattagagattgtattctttggtgcaaaatttaacctaaatgctttgtgaatgtacacaaaactgagtcctttatctcagaatcacagctgcaaacaaatgacaacccatgcttgagcattaactcattatcacttagacctttggccaagcctgtgattgcttagataaagccttaccctccacctttgcctacttctttgttttttgaagactgaagccatataaaaacttcaaattcatttaactgaatagtccatgtaaggaggatgtttaacttatttttaggacaatatttgattttaactaaatattatgtgagactattataagtgattataaaactatgtgatattttgtgttttataaaacttcaaatgttttcattttattatttctcattatttaaaacattttttcctcactaaatattgtgataaattagtatcagtaagactttaattaataatagccatctgatagcagggattctttaatagatttgttagagtatacatcttcacagtacataaaagttgagagatttttatgttttgtgtagtgacttaaaagtaagctgtttttcaggaaagtattaaataattgttactagctcttttttataattattttcctattcaaagtaataataaagtaatccttgaacatccttttagttaacacacgattttttaataattcactatttttgaccaggcatggtggctcccgcctgtaatcccagcactttggaaggccaaggtgggaggatagcttgagcccatgagtttgagaccagcctgagcaacatagtgagaccctgtctctacaaaaattaaaacaaaaaattagcagggtgtggtggtgcatacctataatcccagatactcagaaggctgaggtgggaggatcgcttgagcatgggaggttgaggctgcagtgagccatgattgtgccactacactccagcctaggtgacagtgagaccctgtctcaaaaaaaacaaaaaacaccactatttttgttaagtaatgtattttaaaaggaatacgagtaatgccctgaaaagtacagatcaagaaaagaatgcaaatgagacaaaaataatggttatcagtttgctgtgtatccttacagaagtttcctgtaaaaacatgcatatgtacatatatgcatatatagaaataattagttttctttttacaattccttttgtttttaagtcttcaggtgtagcaatgagacaagaagactagttctatattagcatgttagcaaataaaaattccattcttcagagataagttttgtcaagtttctctcatctttctgcttgctcctcccttcactcttattctgttcttaccactcttctccttgagaggagagaacgtatagtgtggtggattgcaacgctggcttggctatacattagatttaactgggagctttgagaaatatccacattctggctccaccttccagattcttaattaattggtcataatgatgcaggggatgtgggaggagaacgttctttatcttagcctgcatatggaagcttgcctcagcttcagagttcaaatatggtttgcgggaaagcaatggttgaatccaaggggccatcttcctcagtttctctatcttctagaaggaaggggtgtgtgcgtgtgtgtgtgtgtgcgcgcgcatgcacataggtctttgtaatcctttaaattctctaagaaatgtaccaccacagatttctaatttattctagtattggttcatccatagtgtttgtatactttaattctaaagaaaaataatatttgcatagtacagattagatagacaagaagatgactggtaaggcaatatagtattgtagttaaccacactgatgctagagccacagtgccagagttataatcctggctccataatttatgtatgttgagcttggacaagttagttttagcctttttgcctcgtctataaaatggggacagtaggctgggcacagtggctcaaacctataatcccagcactttgggaggccaaggtgggcggatcacctgaggttggtagtttgagaccagcctaaccaacatgaagaaaccctgtctctactaaaaatacaacagttagccgggtgtggtggtgcatgcctgtaatcccagctacttgggaggttgaggcaggagaatcacgtgaacccgggaggcggaggttgcagtgagccgagatcaagccattgcactccagcctgggcaataagagggaaactccatctcaaaaaattaaattaaattaaattaaaataaagggacaataatccccaccccatagaaatgtgaggattaaaaatactagtagatgtaaagtgctcaaacagtattttatgcatggtaaatgtacaataaataacagttaattagtttattcctttcttgtagtctattttctaacatttcttacccctttcttgcttattcctcctgaagttaatgcgtcttctgataaactagagtaggtgttaactttttttttttttttgagacggtgtctcactgtctcccaggctagagttcagtggcactatcttagctcactgcaagctccgcttcctaggttcacgccattctcctgcgtcagcctcctgagtagctgggactacaggcgcctgccaccacgcgcggctaattttttgtatttttagcagagacagggtttcaccatgttagccaggatggtttcgatctcctgacctcgtgatccacccgccttggcctcccaaggagctgggattacaggcgtgagccgccgtgcccagcctttttttttttttttttgaggcaaagtctcgctgtgtcgcccaggctggagtgtagtgtgatcttggctcactcctgggttcaggtgattctcctgcctcagcctcccgggtagctgggactacaggtgtgcgccaccacacccggctaattttttgttattattagtagagatggggtttcaccgtgttggtcaggctggtctcaaactcctgatcttgtgatctgcccacctcagcctcccaaagtgctgggattacaggcgtgagccactgcgcccggccagctaattttttttgtaaggggccagatagtaagtactttaggattttggggccatatggtccctgttgcagatattcaactctgctgttatagggtgaaagccatttacataagcaaatgagagtgattgtgtctcctttatttatgaacactgaaggtgtccttaaatatagaaacagtccttagttcacaagccacgcaaaaacagacagtggcccagatttggcctgtggttcatagtgtgctggcccctgaagtaaggtaaacaaacctgcacattctgataactattttagacgtcttttctttcttggacattccttcatttttaaatttctctgtacattgggatactctagaaagttaattttttggcatcaagtttagaactttaaaattctactcacagctttgagcttaagctgtttattagcactatttgaaacagtgaaactttgtgaactctctcctcctcaaacaatgacatatataactgtatttagggttctttggttgcaagcaacagaaccatcatggttcattggagattttattctttggtacagaatttaacttaaatgccttgtggatgtacatgaaactgagtcctttatttcagagtcatagcagcaagcaaatgacaacccgtgcttatcatcagcactggtgtgtagtaggtcttctctcagagaactgggcagatacctacagaacctataagaccatacacacattcacataccatacacacacatgcatacattatgtaaataaagatacttatttcaaggaattggcttatgtgattgtgggggctggaaagtccaaaatctatatggcaggccaacacattgcagattctgtagctgaagctgataatgcagtctttcagtagaatttcttcttcagcgaaacctgagttttgctcttaaggcttttcaactgattggatgaggcctactcacattattgacgataatctccttaaagtcagctgattgtggatgttaaccacatttagataataccttcatggcaacacttccatctgtttgaataactgggtactatagtctagccaagttgacatgtccaactaaccgttacatggttcaatatatatttgtccaataaaaggaagaacaaatggctaaaatggttaatttaagcagaaaaatgtttatttggaggatgttgaataacagaatttaagtaaaaagtgagcacttaggcctcaagaagtcccaagaagaaccagagcagtttgcaggggtagggacctaggtaatagtaaggaacaatgccttcagtgtaccacagtcataaaaaatcagctctagccattttgcttcctcacatcactctaagattcagcttcccgggaaactcagcctgattggtgtaggctgagtttaggtcacatgtctcccttgcccagtgaaaggtgggtacaccttgattgacattctcaccacaactgcattcaggaagacaaggattgtttcccaataaagtgtcacaaggctgttaccaaaagaaggaggaatactagacatgcacaaataaaagatatccacttcgccaactcttgatatctcacatagatggtcagctggtaaaactaacatggatcagagccagattatgtagaatgttacaaggcctgataatgagcttgggccttattctctagaataatgaaactttttttggggaagggggagggtcatagatctctttgaaattttgaaattttggggccacatattgggccctcttctctcctagaagattatgcttatgctttaaaaaagatttgtttttgttttgttttgtataacatttcaagagtttgttttacctcttgaagtatatccatagttggtgggaaaaggagctagtctcaacctgaaaaacaatcagaatattatatctctctcagcttctgatatttgcactgctgattctccttaatctctttgatttctcttggaggaatttggttaagagatgatgagggtcttattaacacagtgtggaaatagggataaaaataatttgcaatttaaagaattatttaggaaacaaaatatgcagaactagctcgactgttgattatatatggggagtacagtcaagtatgacttataggtttttagcttgtaggaattgcaggggaaatatatagggcaggtagaaaggttgaccttaaatgtgagaagggacagcctcatcctttgagtgggactttaggaaaaaagatcatagtaactggacttaagtttatcaagaaggaaggtaatgagagaggaagtggagtagagattggtaaaaggattgatgtgcagtactgagggtccaggtgagatttcagaccaggaatttgaagtagtgacatcagttatataataatattttctccaccaatgaagagaaagtttaagattcactaacagttgatgtgtactggctgatttgcgggtgaaacaacaggaatacatggaatagaggaatctgagcaaagactaactcaaagatggtggtgtataacttatagaactcccattctgtgttgggcgcataaatgatctttgtagataccatttcatttactcaaataaccctgcgagccaggcactgttatccctgtgatgaaactgaggctcagagaggttaagacacttgccaaggattacagagctagtaagtggcagaactgggctttaaacccaggaagctagattccaaagtcttgtgttcttaactactaagctacactgttgatcacccttggagtcgtgggttaggagaaaaggaagggaaacaataaggtgggagaagatgaaggacttagggctcaaagctgatgcttcagtgaggtggaaaacctgtgctgtggggttttcctcagattacacacacgtgcacacgtgtttatatcaggtgctgaaaaaaagataattaatttagatatttaccaggaattctttcagaagcatttttaatgagtcatatttgcactgcacaattctttttgcttcatttttatatagttgaaggcagtaaggaattcttgtacaagtaaacatcttttccttttgtacccctcatcactgcgaatttgatagaacccttagtaaatgaccaggttgttttttacacttttttttctctcccacaacgtaacatgggtttggcaagctttaaaaaatgttagtatgtttgtatccactagtatacctctgaccatttaataggagatccctgccaattagagctagtgatgttttgttctaatttggagagacagggtgtgtctgtctttaaattctctgtcagttttcctttttgtaaaaaaaaaaaaaacaaaacaaaacctcaattcccaaattataaataaatttgagcaattgcagactaagggaataagaatgaatgaatgaatgcatccattggagtagaacatcttctctttttctttctttttttttggacggagtctcactctgtcccctaggctggagtacagtggtgcaatctcggctcactgcaagctccacctcccgggttcacgccattctcctgcctcagcctcccgagtagctgggactacaggtgcccgccaccacacccggctaatttttgtatttttagtagagacggggtttcactgtgttagccaggattgtctcgatctcctgaccttgtgatccgcccgcctcggcttcccaaagtgccgggattacaggcgtgagccaccgcgcacagacgagtggaacaccttcttaacacagaactagttgatttattttttcctaatgcttggctttttccaagtttttgttacccaagataacattagtcaaactagcactttgagaaaaggagttaaagtttttttattgttaaatttgggtaactggtcatattttcctttgtctcttactgtctcatacccttagatcaggggtctccaacccctgggccacagactagttagtaaaggtccatggcctgttaggaaccaggctgcacagcaggaggtaagcagcgttgagtgttactgcctgagccccgcctcttatcagatcactagtggcattagattctcataggagtgcaaaccctattatgaattgcatatgtacataatctagcttgcacgcttcttatgagaatctaatgcctgatgatctgttgctgtctcccatcacccccagatgggactgtctagttgcaggaaaataagctcagggttcccactgattctacagtatggtgagctgtataattgtttcatatcattattattattacagtgtaataataatagaaagaaagtgcacaataaatgtaatgcgtttgaatcatcctgaatccatctcccacgcccactccagtctgtgaaaaaattgtcttccatgaaactggttctgccaaaaaggttggggatcgctgccttaaattatgtagataaacgtaacagatatttgtggttatatcagggactattataacattttttctgtattaatctagatatttagctaaagctcaacatgctttacagattgatatggctaatgtttcaattgtttgcttcttgctactgtaaggtttcttagaattagggctctagatctttttttttttttccttcttttaaattaagagatgaggtccaagctggtctcaaactcctaaccccttcccaccttagcctctcaaagtgctaggattactgacatgagccagtgtgcctggccagggatccagatctaatacatgttaagatcatagcttttagaatgtttagtcataggtatttaactgtagtttcttcctttgaaccccgaacttcaaggcgtttagtaacacttttaaggtctgtgttcaggtggtttttggtttgactgtaaatacttttttctgtttaacatttcttagttcaaatctaggtcacaacctgtctgtactcttgtagagaattttattttttaaattttatttatttatttatttttcacagtcttgctctgttgcccaggctggagtgcagtggcacaatcttggctcactggagcctctgcctcccaggttcaaacagtgtgtgtgtgtgtgtgtgtgtgtgtgtgtattttttttttttttgacttccagtgacctttgaactttttattggcttcctgctccccaaagggtaccctgcttctgctggcttaattctcagaactttggtgtcattggtctcagataccactttgccatccactatctggtggatggtcgtcttttggatggttcgcatggagttgctgctgtccagggcatcaccaagattgaagtccttgccatcttccagcaggtggtggtaggtggcgatctcagcctctagtttgaccttgatattcagcagggcctcgtactcactcctgggcctggcgttgcccctctgcccgggtctgtgccagctctgactgcagttgcagcaggatcccgttaagctgctccatctgcaggaagtagagggcctccacctccctcagtctgttctacaaactggccttcacatttctcactgagtccaggtcaatctttaaggactggactgtatgtctcagctctgtgagcgtcatcttagcctctccagcctcagcagactgcgtggtgaccactgtggtgccctcctcaatctgctgagaccagtacttgtctagctcctgtcgattctttcaagccagctcattgtattgggccgagatgtctgccatgatcttgctgtcctgagatttgggggcatctgcctccatggtcaacccagagctggcaatctgggcttgtaggccttttacttcccctttatggttcttcttcatgaagaacagctcttcgttgagagcctcgatctctggcttcagctgcagccaagtgacattgatgtcatcattgaccttgtggagtccgtggatgtcactctccacagactggcacatggccagctctgtctcatacttgactctaaagtcatcagtagcaagatgggcattgtcaatctgcagaacgatgtgggcattgtccacagtatttaagaagatctgagctctcacgtcctcgatggtcttgaagtaatggccccagtccctgagctggggtcccttcttctccaggtgctcctggattttgctctccagcttccggttctcggtttccaggctctcactctgtccaggtaggaggccaggcattgaggcgttgcatggtctcctcattctggatgcctcccattcctgccagcccctcggccatccctgcagccagaccccaagctgtcccagaagctggtggagtgggacacggagatctgggaaccagagcccccagcacctggatagacgctggccaggcgccatagctggctgccttgacagagctcagggactggtagttggtggataaggtgaagcgagtggtaaagctcatgctctctggggaggagagtgagaggataggactcaggctttgccgacgaccagaatattagatattatcattgcctaatatccctttcttcttttgctgttgataatcaaaactttattactgattctgacttgatttttgaggtttggttcccatagaatttttagcagagaggttagtatttaaagggatatttaatacattatttcttttagctagaataagctaaaggtgcaaaagaatgaatgttgtcttaggttcctaagacctggaaaaccggtctgaatgcttttatgcactgggttaacctttatgccattcagaatgtgagaccagtttggtctgattttcattcctctgttaggcttaaaaaagaatcaccacactgttcattgatgtcattaggattattaggaaaaatgtttgttatgagtatgaagacccagagaactcttgtttacacttattttaatagtgaaaacttggttttgatttagaattcttctaacaatatatataagtaatatttgtggagtggtagagtgctttttttttttttttttttttttacatttactaagtttgtctcatttgatcttcacaattctgtgaaaaaggtaggacagatagtgtcactcctacttttaaagataagaagtttgggcttcaaagaaattcagtgacttgccctgagataaatagctagttatgtctgctatcttttgcattagttttcattctcctatatcaaagagtttctatgcagaaagacttctatatgatttacttataatttctaaaatataaaattcaaattgttgaatttccggcttttctgcatttaccagaaaagtatgccatttaaaaaaatagaccattgaaaaaacatggaatgcttcatgaatttgtgtgtcattcttatgcaggggccatgttaatcttccctatatcattccaatttcagtatatgtgctgccaaagcaagcatgacttaatttttttagagcagttttaggtttacaataaaactgagcagatttctcgtatatcttctgcccccacacatgcatagtctccttcattatcaacaaatcccctaccaaattggtacatatgttacagctgatgaatgtacattgacacatacttattatgcagagtccatagtttaccttagagttcacttttggttttgtatattctatgggtttggacaaatgtaaaatgatgtgtgtccaccttatagtttctttcttttttttttgagacagagtcttgctctgtcgcccaggctggagtacagtggcgcgatcactgcaacggctcactgcaacctccgcctcccaggttcacaccattctcctgcctcagcctcccaagtagctgggactacaggcacccgccaccacgcccggctaatttttttgtatttttagtagagatggagtttcaccatgttagccaggatggtctcgatctcctgacctcgtgatccgcccgcctcggcctcccaaagtgctgggattacaggtgtgagccactgcgcccgtcttcaccttatagtttcatacagatggttttgctgccctaaaagtcttctgtgttcctgtcttgtttgtttgcttgttttggctatatataaagaggaacagatagcaagttcttccacattgtattactgtaattttaatcttatttgtagttgtgggatttagaaatacttgattcagaagtatgtctttaagttaattgattataattttgactcttaagggcattatgaaaaagtctttttctggttcttaacaaaattctttcaagttagctagtttcaaaaaagaaaaatgactttgtacttttaataatcacttaaaaaaccagtaccctttatattgcataatgcctatgggagatatatatataattttttttttttttttttttttagacagagtctcgctctgttacccaggctatagtgcagtggcacgatcttggctcgctgtcacctctgcctcccaggttcaagcaattcttgtgccttagcctcccgagtagctgggattacaggcatgtgccaccatgcccagctgattttttaatttttagtagagatagggtttcgccatgttggccaggctggtcttgaactcctgacctcaagtgatctgcctgcctcggcctcccaaagtgctgggattaccagcatgcgctgccacgcccagctaatgtttttgtgtttttagttgagacagcgtttcaccatgttggccaggatggtctcgatctcttgacctcatgatccacctaccttggcctcccaaagtgctgggattacaggcgtgagagaccgtgcccggctccaaatatatgtattttttaattgacttttttttttttgtgcaaaaagtttagttcaagtatttttatttttatttttttgagacggagtctcgctctgtcacccaggctaaagtgtagtggtgcagtcttggctcactgcaacctcagcctcccaggttcaaatgattctcctgcctcagcctcctgagtagctggaactataggcttgtgccaccatgcccagctaatgtttgtatttttagtagagaccaggtttcgccatattggccagtctcgtctcgaactcctgatctcaggtgatccacccaccttagcctcgcaaagtgctgggattataggcctgacccagttcaagtatttttagaacctctgttcttgtattcatagaccctgtgcaaatctctatgtggaaatacaaaataatccttaccttgcattcagcaaagttgacgttgacagcaaaggcaaggctaattatgaaacagttagaggagaggtcaccaaactttggtccaagacctgttttgtatggccctcaagctaagaatggtttttactttttaaagagttttttttttttaaataagaaagaataatatgtgacataggccatatgtggctcacaaagcataaaacatttaccatctagctcttcatagataaagtttgctgactatgaattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaagaataaataaataaaaataaaagaaaaatatagagttatcttacgacccagcagttttgctgctaggtatatacccaagagaattggaaacgtatgtgtacactaaaacttgtgcaagactgttcattacaataaacaaaaagtggaaagaacccaaatgtccatcaactgataaataaacaaaatgtgatatagccatacaatggaatatgatttagccataaaaaggaatgaaatactgacacaacttcaacatcgatgaaccttggaagcatgctaagcacaaaagccagacacaaaaggccacaagttgtatgattccatctatgtgaaatgtatagaaaaagcaaatctttagagacagtaagtagattagtggttgccagagactgtagggagggcaaatggggagtaactgttcatggatatgtttttttttgggaggggtgatgaaaatattcagaaattagatagtgatggtggttataacagccttgtgaatataatttttaaatccactgaattgtgtacttgaaaatggtgggccaggcgcggtggctcacgcctgtaatcccagcactttgggaggctgaggcgggcggatcacctgaggttgggagtttgagaccagcctgatcaacatggagaaacccccgtctctactaaaaatacaaaagattagctgggcgtggtggcacatgcctgtaatcccagctacgtgggaggctgaggcaggagaatccttgaaccgggaaggcggaggttgcagtgagccgagatcacgccattgcactccagcctgggctacaagagcgaaactctgtctccaaaaaaaaaaaaaaaaaaaaaaaaaggtggattttacagtgtatgaattatatgtcaacaaaagaaaatttaaccagagattaagtagtataaaagaggtaatgagaggtcagggagagaaaagaagactgtgggcatgaattaatggatacaactctgaggttggggcttgaaatgcacctcaaaaggcacagaggatttggatagatagaggaagtggttaaggcattacttaggaaggggtataaaccaagatattattttgacataagagaagtggcaagatgtaagtggaagaaaagacaaggcgagtctcttgttttcatggggcttctaaactggcatattaactgatctggcctgctaaggataatgctttgcacaattattttcatgggataaattgcatatccttctagtctcaggcaagaagtttttattccagccagagagcaagagcctaaggactctccgccatggtattcttaacgagttactgtaaggattttagttcattgcatatgctttgtggaatttgccatcttttttattttttttaacctattttaaatcatacaaagtgtctatcaggttttgttgttacttcaaacaaacccccctcttaatactttcttgttcttgccacttcacactttcatgtatactgttttatttaatccttccatcacacctgagttaggtggtatcattcccattttaaagatgaaagaggccatataatagagtgcttaggagccaggatgggagcactggaggcagaatgcctaggttcaaatcctcgttctgccatttactaattgttttgtgagttttgttgagttattgaacttctgtaggtcgtatgttttctcttgtccaaagtggtgattataataatattatagaattgttttaaataaattgactaaaagtaaaattcttagaaacatgcttgcacataataagtcctcagtaagtgttaaactgctactgttggttatagatcatgagaactgagtaagtttaagaagtccagagacttctacctgataagtggtagagccagtgattaaatataggtgatctgaatctaagtcctacttgctaatttatctagttgcctttaccatattttattatatgtttatttacttattggacataaaattattagccttctaaactttgatttaaatgtggactggctgaatgcggtggctcacgcctgtaatctcaggactttggaggttgaggtgggagggaattgcttgaggccaggagttggaggctgcactaagctgtgatcgtgccactgcactccagcggtgacagagtgagaccctgtctgaaaaaataaatgtgggccagaccatagaccaagtagttatagcaaaagagagtttctaaattactcacaacagaacttccattcttaaactagtcttttgctttaatccactggtacccaatccttagcagttataaaccaaactcatgagctatgaggggaaaatgaccatgggaaacatagatttaatgcaaaataactgaaaaaaaagaaaaaaaaacaatgcaataaaacaaaaaaaaaacaacagaaattaacttgagcgtgataaacagctaaaagcaaacaatatctgagggaaaacgggataatcaaaaaaagtggctattcttaataaatagaacagactgcttgataggaacaaactttttttaaagataaatgaaaaagaatacgcattcacaaaagaaaaaagcacatgactgataaatatttgaaaactttaacctcactaatcggagaaacttagagtaataaaattttgataatacagttaactaaataggaacatttatgttgaaactgtgctattagggatatggtgaaatgggacccacacattcctgattggaatgccagttgataaaactaatctccatgaagaaccttaaaaatgttcatagtcttttttttttttttttttttttttttttaagacggaatctcgctctgtcgcccaggctggagtgcagtggcgcaatctcactgcttgctcactgcaagctccgtctcctgggttcacagcattctcccgcctcagcctcccgagtagctgggaccacaggcgcccaccaccacgcctggctaatttttttgtttgtttttttgttttttgtatttttagtagagacggggtttcaccattcacaggatggtctcgatctcctgaccttgtgatccgcccacctcggcctcccaaagtgctgggattacaggctgagccaccgcgcccggcctcctagtctctgattaattaatgttccatgtgagaatataagacaaagaaaaaaatgacaactggataaaagtgtattatataaataaagattcattgcagcattatctgtaataatagaaaacactttgacatgcccagcaagaaggatagttaaattactgtacatttattgcaatatctgttaaaatagttatgaaaaacttcagtgaccttggagggagatgaagtaatatcggcgggggtgggggttggtagtaataaaaaacaagactcagaattgcaacaccttaacctctaatgtcaagcagtaaacctagtcttgagaacagttcattctggacaaatacttactgagttgctcttaaatgtttgattaataagtatctactataaaaataaataaggcaaaaccctttttgaaaccacattcccctttcccttgtagtagtgaccacctgatttttctattcctccttaaagcaaactcctcaaaaaaattgtccataatgccatctcccaatttcttgcctcccaatctttcctgaacccagttgtgcttttgtcctgggttattacactgaaattggtttatccagtctccagtgacctccagtggtcaagttctcagtcgcatcttaatttacatgtcagcatttgataattgatcaattcctcctctttgaaatattttcttctctttatcccaagaaactatatacatggttcccccccgccactgcctcactcactagttgctctttcctgacctgctttgatggcttctctgctctgattgttttttttttgttttagttaatatggagaattgtgttgtatttttttatattgtggtaaaatacacataacataccattgtaattatttttaagtatacaattcagtaaaattaagtacattcacattgttgtgcagacttcaccaccatctgtttacagaactcttttcattttgtgtaactgaaacttgattccattaaacagtaattccccatcccccttctccgcccccaacaaccaccattctattttctgtctctgaattttttactacaataggtacttcatataagtggattagggatacctatatgtcaaaattgcaaacttctgtgcatcaaagaacacatcaaggttgagcgtccaaaatccatatccataatccaaaatccaaaatccataacttttgagtgctgacatgacaccagaagtggaacattttatatctttccccatgtgggttgcagtcaaaatagtagtcaaaactttgtttcatgcacaaagttgttaaacatattgtataaaattactttcaggctgtgtatgaagtgtttatgaaacagtttagacttgggtcccattcccaatagatctcattatgtatatacagatattccaaaatctgaaaatatttgaaatctgaagcacttctgttcccaaagggatactcaacctgtagtccaatttatctatttttttcttttgttgcctgtgcttttggtgtttatctaagcaatcattgccaaatccattgtcatgtatctttcctcctatgttttcttccaagaattttatggttttgctctctcacatttagtctttgatccattttgagttaatttttgtatatggtggggcccaactcttcattcttttgcatgtgaatatccagtttttctagcaccatttattgaaaagaccatcctttcccaattgaatggtcttggcctcattttcaaaaatcatttgaccatatatgtgagggatttatttctggactgtcttattttataaattttaatatgttgtgttttcattttcattctgttcaaaataccaatttatcccttttgatttcttctttgaactatggattatttagaaatatgttgtttagtttctaaatatttggggattttcttgatctttctgttactggtttctaatttaattctgtagtagtcagaaaacataccttgtatgatttaaatttattcaaatttattgagacttactttataatttagaatatggtctatcttggtaaatgtttcgtgtacacttgaaaataatatatattctttcattgttggataaagtacagtcatacatcacttaacagggatacgttcggagaaatatattattaggcaatttgttaaattaatctctgagtagtttctttttagatacttttgtaagtgattttttaaattttatttttcacttctttgccaatatatagaaatacagtcacacatcacttaacaacatatctcctagctgtgatcacaccactgcagtccagcctgggcaacagagtgagaccctgtctctaaaataattaagtaaataaataaagtaaatcattcaattcaaccttagcttattgtaacttttttactttataaactttttgactcctgtaataacacttagcttaaaacacaaacacattgttgtctgttaaaaaaaatttcctttctttagttccttattctataaactttttttctatttttaaaattttttactttttaaacatttttgttaaaaactaagacacaaacacacatattcacctaggcctacactggttcaggatcattaagatgtcactaggcaataggaatttttcagctccattgtaatcctatgggaccaccatcacatatgcggtctaaacaatgcggattaaaacaatgtcctgcagtacctggctgtattctgtaaatgttgattagatccaattgattgatggtgttgtttacttcagctacgaccttactgattttctgcctgccggatctgtcagttactgacaagggtgttgagggctccagctataataatggattcatctgtttctccttgcagtatccatttttgcctcatgtattttgacactgttgttagatgcatgcacattaagaattgttatgtcttcttggagaattgatgcctttatcgttatgtaatactcttcttcatacctgataacttctcttactctgaagcctgctttgtctcagaataatatagctactgttaactttctttttattagtgttagcatgatatatttttcttcatctctttacttttaatctctgtacagtagtccccacttacccatggaggatacatttcagtgtcctctgtggatgcctgaaaccgcggatatagtaccaaaccttatatgtactgtattttttcctgtacatacctataataaagtttaatttataaattagtcacagtaagagactgacagcaatacctaataatagaacaattctaacaatatactttattaaaagttatgtgaaagtagtctctctctctcaatattgtaatatttttcagatacctgttgactgggccactgaaattgcaaaaagcaaaactatggatgggggggtctactgtatttatatttaaagtgggtttcttatagacaacatatagttgggtcttgtttctttagtccgttgtgacagtctctttttttttttttctcttattattataccttaagttttagggtacatgtgcacattgtgcaggttagttacatatgtatacctatgccatgctggacagtctcttttaattggtgttggattaatatatatctaccatatttgttactgttttctattcattgccctcccttgttgtttcctttttttgccttctgatttcaattgaacattttatgttacttcattttttctcctcacttactgtattatacttgtttttacttttttttactagttgcccttgaatttgcagtatacatttacaactaagccaagcccactttcatataacatagcacttcatgggtagtgcaagtaccttggaacagaatattcttaattacttacactagtcccttataacattgctgtcattcattttacttatccataagctatagtcacctaataccttgttgctgttattttgaacaaactgtatatgtttagatcgataaaggataagacaagtaaaagtaaagtttctgacctaagtagttttccttctttctgaagaaattttcacatttcttgcaaggcatgtctgctggtgacaaattctctccatttttgtttgaaaatgtgtgcatttctccttcatttggaggatagtgtcacttaatacagagttgtaacttggtggttttttctgggaacactttaaatattttacttcactctcttcttgctttcctggtttctgaagagaagtctgatgcaattcttgtctctgttctgctataggtaagatgttttccccccctctggcttctttcagcattttctctttgccttgattttatgcagtctgaaatatacctaagtgtagatgttttggcatttatcttggttagtgttctctgaacttcctgggtctgtggtttggtgtctatcctctctttattttttagcagtcttttttttctcccaacttgtctcttcgtttggccctgtcttcaaaatgtatgtggaagttaaccaattcttactacctgcactgctactcctttggtcaacattcctatctcttgcattatttcagttgccttccagttcttcctgattctgcccttgaccttctcttttacaaccagagagaccttttaaaaatttcagtggaaacttgacatcctctgctcaaaactgtccagtggcttcccacgcataccaagtaaaagctgaagtccttaccgtggcctaaaagcctgtatttagctctctatttaatatcttaccttctcttctcctaatgacttcctcattgtcctccaattatagtgccctacttgttccttatcgaagtcaccaggcatctcaaggcttttctgcttccctcagatgtctgcccaactctgtcctctaactgcccatcatctttagttgtttactcaaacatcactcttctagattataaacctacatgccatatggactacgatctccccattgctttttgttttctggaacactttaccagctgacttgtttctggcaggagagtgcatgatgcattggagaagatgtaagaaagccagttggctggagtgttgagaatgaagggagcactgttgtgaaataaagccagaatgggagttagggacccaactgtgcagacccttgtaagccatgttaacatctttggtctttatctttaagggaaatgggaaatcactgaagtatctgaactggagggattcggaggaggtcactaagtgattaaatttgtcattttacaaagttcattttagcttcattatgaatatattggagggggaaaagattggatgtagggagatcagatgagaggctattatagggatccaggtgtaagctgatggtagcttatttagtctgttatggttgatggccatacaaaaagaatgattctctgaagtaatgtatttatatacatctgtggtcagcaattcataactcctgattgccaggttaagatttccaatttaggggccgggcacagtggctcatgcctgtaatcccagcactttgggaggctgaggcggggggatcatgaggtcaggagttcgagaccagcctgaccaacatggtgaaaccctgtctcaactaaaaatacaaaaattagccgggcgtggtggcgcatgcctgtaatcccagctactcaggaggttgaggcaggagaatcacttgaaccctggaggcggagcttgcagtgagccgagattgcgccactgcactccagcctgggcgacagaacgaaactccgtcccagaaaaaaaaaaaaaaaaagcaatttccaattgagaggatctctttttggttccatggtaagaaagtagaatgactttcccaacgtaattcttcagaataaaccctagaaattctgttagtcaaatagttatgtatctttttttgtgtatttcttagcatttggcacaaaatcaaagattccttattaaaccaattattatttaatggtcacttctagatcctgttcaaactgattcatctctcatgaaggcagggctttaactaatttccttgtttttcccaaccttctctcatctgaaaaaattaacttgattggccgggtgtggtggctcacgcctgtaatcccagcactttgggaggccgaggcgggcagatcatgaggtcaggagattgagaccatcctggctaacatggtgaaaccccgtctctactaaaaatacaaaaaattagccgggcgtgatggcaggtgcctgtagtcccagctactcgggaggctgaggcaagagaatggcgtgaatccgggaggcggagcttgcagtgagcagaggtagcaccatcgtattcaggcttgggcgaaagagcgagactccatctcaaaaaaaaaaaaaaaaaaaaaaattaacttgatcagggctaagattgttcctcaatcagatgttttcaaaacaaaggtgtctagggggtgttatttctcttcacaaaattaatagctctgggaacaaaaaatttgtgtagaactgtagcacttacgaggataggaaactcataacactctggccatactaagagagatttgatgctcttatatgagcaaacagatttaataaacagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctcagcctcctgagtagctgggattacaggcacgagccaccatgcccagttaatttttgtatttttagtagagacagggtttcaccatgttggccaggatggtcttgatctcctgacctcatgatccacccgccttggcctcccaaagtgctgggattacaggcgtgagccaccgtgcctggccaaggctctttgtttttgatcagaggttgttaatttgggttccctggtctccaacatttccctcacttcccccagtgtatatattcttttcaaataactggatttactggattaaggaatacaataaagttaagaatcaataaatttgattatactgcctcctgatttggggttcctaatctgacagtgctttccattcttgtcttgcattacctttccaaaattcttctcaaaatatcaataacactctagttacattaataaagtagtgatagtagtatttttaagtggataattgccaggcactctcctaagtgctacatatgcattatctaatttggtgttcacagcaacattgctgaactatgtcccttactttaagattagccctccatctaaatggtctcaccacattttaaagattgcttggattaattgaattaccgaatatagtggaaaaggtcttaggcattagtgttagacgacacctagctttgaagccaaggtcaaccccttttttctttcattcaataaatgtttattgagcatctactattttccaactattgttctgagcactaggaatggcatcttttatctgcattttgaagggaagataatgtctgccttgaaggttgctaaagtctaagaaaaaggcacttaaaaaaaaaaggtttgcttccttgccctcctaactgatcttccttctctagtttttcattcctctgttgcaatctacagagtactcatagagctttcttttttctcttcaaactcttgctcaaaagccttagatggcttttctcatctgataggaaagtttcaagttcataggatgtcatagaggaacttttatagcctgctatttaaaaccatatatgggccaggcacggtggctcacgcctgtaatcccagcactttgggaggccacggagggtggatcacctgaggtcaggagttcaagacgagcctggccagcacggtaaaaccctgcctactacaaatacaaaaaaattatccgggcatggtggcacatgcctgtagtcccagctacttgggaggctaaggcagaagaatcgcttgaaccaaggaggcggaggttgtagtaagctgagattgcgcaactgcactacagcctgggcaacaaagtgagactctgtctcaaaaaaaaaaaaaaaaaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctataacattctgtctacctacacccccttcctctccctgggcttcaagaaatacatacaaagtacacagtgaaaaatctcttttctttccatgtcctgtcattcctcagcttccttcccaaaggtattctatgcatatacaagttttatgtacatgaatgaatacaggcagattggcatgttagattgtgaaccctgaaaccaggttgcctgagtttaaatcgtggcttttcttcctagatatgtgactttggggatattactagtatctgccttgtaagcttattgtgaggatttcttacagcacttcctggcacatggtaagcactcagtaaatgtttgccattactattgttgtgttgttgttatataacagcataatatattcaaaagagagcaacatttaaaatctagagacataggtttgaatacagcttcctaattactttatgcttaagtcatttaatccaagttaagccttgtatgtttctttatagtgggggtaatgacatatagttttggttttgattacctaaaaaataaaaaggaaagagcattgtaagtgacagaatgctatataaagtttagttgctgttggttacacggttttactttcccttcaaggaaaggttataacattttagctggataatagtttgaaaaacaaagatatcagaaacttagttataattatgcatttttacttataattattccaaatttatactttttcattagctttggcatgctttagttttggtcatatatagtttatgtggcagtgctgttaagggaataaagttagagagtgaatacctctatttatggaaatgtatcaagattccagaattgataaacttagctatacttggcataatttagtacacctgaccaaatgtatcttttaaggaaaataatgttttggtcaacctagaaagtattagtcatggccttaaattttttctgcatggtttacaaattttttgtttgtctgcaatgataatagttatactgaagaatattcactttacttaagtagatggtaatacatttaaaaagcagtctttcatttccatttcacttagtcaaacatttactggtgatgtgcttttgatgatttgctatgttgctaaaacaggatatgcattcactgttttttgacagctcatggatccaagagcacatgtagttcctaaaggcacagagtataggatatttttggatactgtgatattcccccctttcttctggtaattagaagcattcccagtattaaacatttaggaggaaaagttatagtcaaagaagaccatctctttcttttaaatcattttaatatgaagcatatattttactttagagctttaaaatgatttaaagtaacaattttagtaacctttgggtttgtcttgaaagtattttcatttcatttgtttctaaaatacttgtttctctgaagagagaagatggctcaatctgatgacatacgtaaccgtgatgactgacagtttaaactgaaatcaataaagggagaatagtttttaaatgcattgagacaaagcatacaggaaagatataattttgtataatcttttgttgaagtcttcaaaacagtacaagtgttatttgcctcatgacatgaaaattcacagtaaacaaagctattatatttgaatttcacaaaaatgtttactttcttagttatccttcagaaaaaaattcagaatgatgactcttctcaaattaagtatttatactaatacctgcaaaaactgtcatttagggattatttgtacagttctatgtggtaacactcagccatgcaacatgtgcatatattagtttccatatgtaaaatctggaattactgaaacaatctgtcttagactttttttgatgaagaattagattaaaaactccttatttataacaacatggtagtcattgaatgtaagaactcagatcacattgcagatattctaaaaatagaatgtaaattaggttttaacactaattctgagattattatatgtggcaaataatttgaatgatattcagcagtctaatttaggtaatcaaatcacagagatttaaaaaaaaaaagcattgatttgcatttgtgatcagtattgcttaggaaaaatgcctgatactataagagtatataaagttttgactcaaaggggtcagggaagcatatcttagggaattaatacttgtgctcagatccaaggaaaagagcaggcattattaactaagtggagaaggaagaagtcattgcaggcaaagggaatagcttctgcaaaagccctgtggcagaagggagcatatcaggtttaagaaactgaaagatggccagtgtggctgtcatagagagtaaatagggatatggagcaagatagggatatggagcaagatgaagtggatacaggccaaatcattaggagctttgagaacttggagtttaatctttaccctatgagcaaaaggaaatcatttaattttctgttttgaaaagatcattctggctgcaatgtagaggaactcaagtgagcaacaatggactagttaagaggctatttcagtagtcccaggaggttgcttaggctagagtcatgtagtggaaaagaaaaggaactgacagattctttgcctggagggtaacggttctttgctcaggtcattctgacactcctaccctcctctcctgtttctccactctttaaaaaaatggcgatagaaaatacaaagtagtattctgtgattaaattatcacacttttattatagattatattcttgataactaatattcataattttatgttgagaatattataaagaaatgttttcatcaaatgtagattcatggctgggcatggtggctcactcctgtaatatcagcactttgggaggccgaggcggctggatcacttgacgtcaggagttcgagaccagcctggctaacatggcgaaacctgtctctactaaaaatacaaattagctgggcgtggtggcccgcacctgtaatcacagctactcgggaggctcaggcaggagaattgcttgaacctgggaggcggaggttgcagtgagccaagatcgcgccatcacactccagcctgggcgacaagagcaagactccgtctcaaaaaaaaaaaaaaatgtgggttcatgacttctcactgtgaagaagtgcatattggccatttaagattttttaaatgaaggtcccattttacaactggaaacctaaaggaacagtatcaaggaactgacataagatatgctcagaggctaaaaagtaagtgaaagctagactcagcactcagagcctatttttgtcttgatggcacctactgaaccagctaaacctgggcttatggtttcattgccttcgcagacatagaggataggagactaagctcagtctatgaggagactccaccgagtgtctgtgcacccctccccacccctactcctgccaactccgaggaaactggactgtcacaaatgttggcactaagttgaagtggtggtgcaggtttgggggttgttattctttgacattttatagttgcaacctagcctttatgtttccatatctaaatcacactttttgggttagcccaaaagtatcttaaaatttgactatggttcaaagtaattctggccactagtaactccaggcacttgcagaagcaaatgcacatcacagtaaaagatcacacaactcaaaaagaaaaagagactgaaaatacggattatccaggataacagacaactgaattggacccccattgacttcatattttggaattattagacaggaatttaaaatcagtgtgtttagcgaggtaaagattaaaaatataagaatgatgggattatgatagctaacattttgtagtgcttcctatgaaccttgaactcttcagtactttacatgttaattaatcctcacaaaaactctaaagtagggtttattattatccccattttacaggtgaaggaatgaagcacagaatggggatgtaacttgaccaaggttagtaaagtagtagaaccaggattctagccaggcggtatgggtcctaaagtcaggcttttaaccattttactatactgcttataagaaagatagcgaggttatgagaagttacaaatagcttttttgtgtttagggggagaacttttagaaatgaaatatataggctgtatgcggtgatgcacatctgtaatcccagcactttgggaggccaaggcaggtagatcacttaagcccaaggagttcgagaccaatgtgggcaacatggtgaaatcccatctctacaaaaaaatacaaaaattagctgggcatggtggtgtgtgcctgtagtcccagctacttgggaggttgaggtatgaggatcccttgagtccaggaggtcaaggctgcagtgagctgtgccactgcgttccagcctgggcaacagaatgagaccctatctcaagaaaaaaaaaaaaaagaaaaaaaagaaagaaaagaaatgtataaataaaaatcttaaaagtcaatggacaggcttaacaatagattataattagtgacctggaagatgacctgaaaaataagttaaccaagataaagagacagaaatggaaaatatgtaaaaaggaaaaaagaaaattggacaaccatagcctaaattgctagttttccctgataccattctgtgtctaataagtagtggatatattagttggatgctctgttgcctagctaaaacttctgtttcattgccttcctgatagtgagatttgactatgtgacaaggctttggtaatttggggtgcaaattgaaatgtgtgtaacttctagatcatgcctgtgagaggaaaggggatatgccgttttctttatctttcttcctgcccatgaactggaatgtaaacatggcaatgagatatttttgcctgtgtagaagggggcaatactctaaggatgacagagcaataagacataagagcttggctctctcagactacctagctgccaaacaagagtgtcatgtgagaggaaaataaccctgaattttggttaagccacttttgagtctcttattaacagcagccagtgtctacatcttaactaatccaagaagagcgtgaaaaggtctaatagttgtctaaccagaatttcagatatgaagaaaaatcaagtagatacagtatttaaggagattacaattagaatttccaaaactgcaaaaagatacaaattcaagaagtcaaatcctaagcagagtgaatagaaatgtaaacctaaagtcttcatagttaaatttgcagatgatcagagatgtcaaaaataaccagaaggacaacacagatcactttcaaaagctctgcaattaggctagcagctgacttattgaaaggaaagtagaaatcaaaagacagtagaatagtaactacagtgtactcagagtaaataactattaaagctaaaatatccttgaagagtgaagcaaagttttcagataaataaaactgggagtttttttttgttctcactatttgcacagcactaagaaagattccaaaagatatactttaggtagaaggaaagtgacccctaatggaggatctgaaatattaattaggaaagaaaaatggtcccaggcgcattggtgcattcctgtaatcccagcaccttgggaggccaaggtgggcagatagcttgagcctaggagttcgagaccagcctgggcaagatggcgaaaccctgtctctaccaaaaatacaaaaaaattagccggacgtggtggcatgcacctgtagtcccagctactctggaggctgaagtgggaagattgcttgagctcaggaggcggaggttacagtgagccaagatcatgccactgcactccagcctgggtgacagagttgagactctgtctcaaactaacaaacaaaaaaaccaaaaatggctgaaattattgaggcaggtatccaacttaggttagaaaaacattagaataaactaaagaaaggaaataataaacataaaagcagaaattaaagaaatagaaaagaggtctacaatgaaacatcaacaaagccaaagttggttgtttgaaaaagactaataaaagtaacaaacctggtaaaatgaccagaagtaaaagaggaagggcacagataaacaatccgaatgaaaaaggagatataactaaagatgtggcagatttttataaaagagagaaaagtgcacacactaacacatttttgtgcagggaataatttcagatggtagattattgtatctgttgtcataatagtatatcaagtctatcaagacgacttgtcaaacttgccaaaaattttactcttgaatatgtaagatggttggattaaatattttaatcctttacttgaatatttggagagttacaaaggtgcaatgaatcacataactctgcttcagttatactttactaaagattgtggtaaagatttatctggggatatagatatggataaatttctttaaaacagtagaatatgtgttcccttttaatacataaggaagatgaggggaaatgcgtaaacctgagaaattgtggaaaccttgtatttttaaaaggctggctggagtacagtggtacagtcacagctccctgtgcccatagaactcctgggcccaagcgaccctccagcctcaaaggtgagagccaccacgcccaactaaaacatactgttgtgtgaagatagaattcaaagggctagatgaccatatctagatatgtttttagagtggattgccacaaatgaaagttgctgtatttcaggaattctgttgtttttaaatactgacttcatttaaaacaagaaaacacaaaatcagctattcataaaaagtttgcctcatgtaagtcaagtatactattttcttttctttctttctttttttttgtttttgaggcactctcactttgttacccaggttgtcgtgcagtggcgtgatcttggctcactgcaacctccgcctccctggttcaagcgattcttgtgcctcagcctcccgggtagctgggattacaggcacatgccaccacacctggctaatttctgtattttcagtagagacagggttcaccatgttggccaggctagtcttgaactcctaacctgaagcgatccacccgccttggcctcccaaagtgctgggattacaggcatgagccactacgccctgccagctccagtaatttttgacatgttacattttaattattatttagttcaaattgtttaatttccatcttgatttctttcttcacttatggattatttagaattctgtttcatttacaaacatttggggataatgtggttatatttttatgttgatttctagtttaatttcattttggttagaaattacactctgtatgatttcagtccattgaaatttcttgagacttgatttatggctcagcatggtctgttctagtaaattatccatgtacactggaaaaggatgtatagtttgcagttgttgggtgtggtgttctatatgtctcttaagttgattcattatctgctcaaatcttctatatatccttcctggttttgtcttccctttctgtcatttactgagtaagttctgttaaattctattcatgattcccattctgtcaagttttgctttgtatgctttaatttatatttaaattttatttttctattgagtgctattaacataaattaatattaacatatttatatacatggattgtctgacatctttccatttattttcagtttgttgatctgttctttgtttctttgagattgttatttaggatactgcaagaaattcataatgtcttgggtataaaattagggagtagctcagctgggtgaatcgagtctaagtctctgatgatgttgcagtaagatggttgctgtctgggatcatcttgaagcctttattattcacagatgtgggaagacagaaacagctgggactctggcaaccatgtctttctctgtggtctctccaaagtggtggctgcacggcagcctaacacttaggactccatagataggtatccccaaagagaaaaaattcaggaggaagctctgatgccttttctaacctagcttaagaattcagacagcagcaccatgttggctggattttgttcattgctaaccctgcctgtattcaaggagaggggaatatgttttttctttctacaagttttttaggattttgtctttgtttttagggtttggaattttaactacaatatgttcaggtgcaagaatcttttttctttcctcttcccactgtgtttggcattcattgggtgtttgaatctgatgattcctaacttttcttagtttacctctggaaatgttattctgctgttactttgggtctggtgttctttctacattcccatcagatagctggtgaaacctttgggtgtatcctccttacctctgtctttcatacattccatctctctgctcttttgttcggcactctctggtttgtgtattggtatatttatgtgatttcacattaccaaaaagtacagtttttcttatgatgtactctaaagagcactgtcctttgttgtggaaagttaaatcttaccatgatttccatattcactcccctccccaccagcatgttgtggtgagttgccagttttaaatatttatgatccctgtaaatatttaaagataactaataatatactgcttaagaaactaccttcactgttccttaatgtaaaaaatttttctccaaagtttctgatcactaaatttcctttaatgaattttgttttataagttcagttctacaggagaaacttttgtctgtaatacattcatttatgttaaaaattgcagaaacaacaaagttgggatcaatttaattcacaaagacaatcaagtcatattatttttgtaaatgttagaagtaggcttcctgaaggaagaatgaagagttagattataacttggaccataatgttagggactcagaattgacttaaaatttaaacatagtgtaatgtttattcctgtcttccatatttgtcagggaatcttaaccagagtaagaaattttctggtgctgtgtcgggagtgcagggcacaagagatttccataaaaaggcatgggatttgcttggaagaacatagaggttttctaacttggcagtaatgagttagaactaattccccttagaaagaaaaattaacttacattcttattgggaattcatttgtgtgtatgctttcttgtgtgacctatttattatatttgtgagtgtacctgtgtgtatacattcgtgacccatggtgtttgttaggtgtaaataaaattttctatacatactctgtgaaaaatggctttggaacttgaatgtcttgccattttagttgaggaacaggggccaaatattttgttgttgcagaatatccaaaataatttgaccatctctgagttctttccctagtttctgttgctgtagaaaagctggaggcatttggggaatataaatgatccatgctatattaggattctgtcttgaaagatacgcatttttggattagagagatgatgaattcacatcttgttaaaatgtcagcgatccccagactggaaagggggtagggatgtaggcatccttttacgtgaaatatatgctcttgtgtttagctgtcagtatttttcttttcatggacatcactttttttttttttcatggaatcacctaatacagatagaggtataagatgcctagtgtcccacacaaaactctcccacctcactctaccttttcaaaaatgtggtggttatttttaaaggctcacccagttcttaccttgcttctctttctcattggttgacctcatccactgctatggtttcaatgctaccatcttgaccaccattgactcccgagtctgtacctctagtccattggtttctacagaacctccagacttggcttttaaaatatctatcagatacctttacttgttcttcccataggaatctcatagttaatttttggaagaaagtattatctttctttttaaacctccttttgtatttcctgtcttaattggaggtaggctatcaaccacttacttgctcaagctagatacctaggagttatcactgactcttcttcattccttttagtagcttatcagttatggagtcctgtcagttttatcctcagaaaagcattgcccctcttcagccctattgctcctgtacaggcccgtgtcatctctcactcgagttactgcagtagcttcctagctattctccctgcctctagtctcttctttcttcagtccatcttgcatactgtcagttgtttttccagaatacaaatctaatcatattaattgtttttaaatcactttgtcttttccccgttatttactagataaaatatgagctctttaacatgacaaatgccgagctatgtagtatccctggatcttttgtatttaattctttagtgtgtttgcttaagctgtttcctttgcttggaatgtccttctaagcattatagctgaaatattcctattcagttttttgcttagctcttcatatgagctagtcaaaatttaaaaaactgtcctgggccgggtgtggtggctcacacctgtaatcccagcactttgggaggccgaggcgggtggatcatgaggtcaggagatcgagaccatcctggctaacatggtgaaaccccgtctctacaaaaaattagccaggtgtggtggcgggcacctgtagtctcagctactcgggaggctgaggcaggaaaatggtgtgaacccaggaggcggagtttgcagtgagccgagatcgcgccactgcactccagcctgggcgacagagtgagactctgtctaaaaaaaacaaaacaaaaaaaacagcctggagtctcctctgttcgtccatccttccctagcccattaattttgtcttgtaccagctttattcccattgctttgtagttatttgtttctttctcctttataagctccttgaggatggaaaacacatacttttcatttttgttaccttgacacctagtacagaactggtacctagaaaatactttgcaaatgcctgattcagaataatgatatttgccattatgtctgctttatagtgtcctcactatgtatgtatattagttcattttcatgctgctgataaagacatacccaagactgggcaaaagaaagagatttaattggactttgagttccatgtggctggggaagcgtcacaatcgtgacagaaggcaaggaagagcaagtcccatcttacgtggatggcagcaggcaaagagaaaatgagaatcaagtgaaacaggtttccccttatcaaagatcttgtgagacttattcactaccacaagaacagtataggagaaactgcccccatgatttcaattatccccacctagccctgcccttgacacgtggggattattaaatttaaggtgaggctgggtatggtggctcacgcctgtaatctcagcactttgggaggctgaggacaggcggatcatgaggtcaggagttcgagaccaggctggccaacatggtgaaaccctgtttctactaaaaatacaaaaattagccaggcatggtggtgggcgcctgtaatcccagctacttgagagagtgaggcaggagactcacttgaacctgggaggcagaggttgcagtgagccgagatcatgccactcaagcctgggttatagagagagactctgtctcaaaaataaaaaataaataaggtgagatttgggtggggacacagagccaaaccatatcagtatgtaactggtattctgagaaatttcccaaataaataattcaaggtgagatttgggtggggacacagagccaaaccatatcagtatgtatctagtattctgagaaatttctctctttcccgcattgaattaacttaaattaactttttaagctgtgatttacatgtaataaaatgtatatattttaaataattcagttcaataagttttggtaaataaatatacctatacaactattaccacaatcaagatacagatcattctcatcaccccaaaaagtatcctcatgctcctttgtagccattatccctgtgccaccaccactggccccaaacagctttctgtcactgttttatcttttctagattttattttatcttctctagatttttttttttttaagagaccaagtctttctctgttgtgcaggctggagtgcagtggtacaatctcaactcactgtaccctccgcttcccatgttcaagcaattctcctgcctcagcctcccgagtagccaggattacaggtgcgtgccaccacacccagctaatttttgtatttttagtagagatgaggtttcaccatattggccaggccggtctcgaactcctgacctcaggtgatccgcctacctcggcctcccaaagtgctgggattacagacatgagccaccgtgcccggccttttctagatttttataaaagtagaattacagaatattactctttgtgtctgtcttattttgctgaacatgtttttgagattcatccatgttgcaagtaattcattccttacattcattactgagtagtattccgtcagttggatatatcacaatttatctactcacctcttgatagatacttgggttgtctgtagatttttggctattacaaagacagaagttgaagttaacattgtttctcagcttggcttgttgaaaataatgtcttttacacattgaattacttgtgttaatgatctattgctctgtaaccaattgacccaaattttattggcttaaaacaacaataatcattttttttctgtcaacagtttctgtggatcagggatttgagagtgacttggttggagggttctagctcatgatatctcacgaggctgcagatatttgttttaaggctaaaatcaagataagcttcaaaggtggttcactaacataattggcaagttggtgctggttcttggtaggagtcctcagctcctcttcaggtgtgcctctctgaagggctggtgttcacctgacatggtgactggcttctctcagagcaaatgatccaagagaccacaccacaacctgcggtgccttttaggatctagacttggaagtcacatattttagcttctgccgtatcgtattggtcacatgacgaatcttgattcagcatgggagggaacttattcaaggatatgtataatgagagggaacgatacaaggtatgaatacaaggagaccaggatcattgattgagagctgtcttgcaggatggggtgtcacaatatacctttattaaaaatgaattaatgtgttgctgtgtttcgacttctggacttaatttggtttccctgatttgtatgtttgtcgttatgctgatatcacacaatatgtattactacagttttatagtctagaaatcagataatataagactttgttcttttttaaaaccatattagcttttctgaattatttgcattttcatataagttttaaagttatcttgtcagtttctacaaacactgctgattgagtttgcattgaatctgcagatcaacatgaagagaatgacatcttactaataatatgggcaaatactaatatatggcatagctctctattaagtctttaatttcagccatgttttgtagttttggtatataagtcttgcacatattttgctaaatgtatctctaagtagtttcttactggatgtttttgtaaatggcattttttttaatttcaattttcagttctttgccagtgtatagaaatacagtcacatgttgcttcataatggggagaaatgccttgttagtcaatttaatcattgtgtgaacaccacagagtgtacttacacaaatctggatgtataatatagcataccacatacctaggctgtattgtatagcctactgcttgtaggctacaaacctgtacatcatattactgtacagaatactgtaggcagttgtaacacaatggtatttgtgtgtttaaacatagaaaagttacagtaaaaatgttattataatctataagaccaccaccgtatatgtaatagagtctgttgactgaaatgtcattatgcagcacatgactgttcaggtgggtttttttttttgtatcaactttttatcctgcaacttcgctaaattcacttgttagtctggtagcatttttgtatattccttaagatttcctacatacaggattgtcatctgtggataaaagcagttttacttcttccttttgcatatgtactatacctagcttagtgcaatgtcaatagaagtggtaagagtagacatattgatacaataaaaagaaaaaccatatactatcagtaaatgcagtaaaagcattttgggaaaaaaaatccaacatcttttcctcagaacccagataaatgaaagctcttaagaatgtaaaagtgggggttccgggtaagatggccgaataggaacagctccggtctgcagctcccagagagaccaacgcagaaggcaggtgatttctgcatttccaactgaggtacccagttcatctcactgggactgggttagacagtgggtgtagctcatggagggctagcagaagcagggtggggcatcgcctcatccgggaagtgcaaggggtcagcgaactccctcccctagccaagggaagccgtgagggactgtgccatgaggaacggtgctattcagcccagatactacccatttcccacagtttttgcaacccgcagaccaggagattccattgggtccctacaccaccagggtctggggtttcaggcacaaaactgggcggctgtttgagcagacactgagctagctgtaggaggtttttcttttcttttcttttctttttttttgtacccagtggcacctggaaccccagcaacacagaactgttcactcccctggaaagggggctgaagccagggagccaagtggttttgctcagcaggtcccaaccccatggagtccagcaagctaagatcactggctggaaattctctgcacagcattctgaagttgacctgggacactccagcttggtgggaggtggggcgtctgccattactgaggtttcagtaagcagttttcccctcacaatgtaaacaaagcctccgggaaggtcagactgcagcatggcaaagccactgtagccagactgcctctctagattattcctctctgggcagggcatctgaaagaaaggcagcagccccagtcaggggctttatagttaaaactcccatctccctggtacagagcacctgggggaattggcagctgtgcacacagcttcagcagacttaaatgttcctgcctgccagctctgaagagagcagcagatctcccagcatagcactcaagctctgctaagggacagactgcctccttaagtggatccctgatccccgtgcctcctgactgggagacacctcccagtgtgtccagagttggttccttccggtgggttcttggtctcgctgacttcaagaatgaagccacggaccttcgtggcaagtgttaacagctcttaaaggtggcacggacccaaagagtgagcagcagcaagatttattatgaagagcgaaagaacaaagtgtccacatcgtggaaggggacccaagcgggttgcgactgctggctggggtggccagcttttattcccttatttgtccctgcccatgtcctgctgattggtccattttacagaatgctggttggtgcatttacaatcctttagctagacacagagctctgattggtgcttttttcagagtgctgattggtgcatttataatcctttagctagacatagagtgctgattggtgtgtttttacagagtgcatttacaatcctttagttagacgcaaacgttttccaagtccccactcgacccaggaagtccagctggcttcacctctcaccagcaggggttgacagacgcctcatacaggagaggttcagctggcatttggcaggtgctcctctgggatgaagcttccagaggaaggagcaggtagcaatctttgctgttctacagcctctgctggtgacacccaggcaaacagggtctggagtggacctccagcaaactccagcagacctgcagaagaggggccagactgttagaaggaaaactaacaaacagaaagcaataacatcaacatcaacaaaaaggaagcccatgcaaaaacctcatccaaaggtcctcagcacaaagactaaaggtagataaatccatgaagatgaggaaaaaccagcacaaaaatactgaaaactgctgggtgtggtggctcacgcctgtaatcccagccctttgggaggctgaggcagacggatcgtgaggtcaggagtttgagaccagcctggccaacatggtgaaaccccgtctctactaaaaatacaaaagttagccaggtgtggtgcatttataatggttggtgccagctactcaggaggctgaggcaggagaatcacttgaactcaaggaggcggaggttgcagtgagccaagattgtgtcattgcactccagcctggacaacagagtgaaactccgtctcaggggaaaaaatgctgaaaattccgaaaaccagcatgcctcttctcctccaaaggatcacaactcctccccaacaagggaacaaaattggatggaaaatgagtttgatgaattcacagaagtaggcttcagaaggtggataataacaaactcttccaagctaaagtgcatgttctaacccaatgcaaggaagctaagaaccttgataaaaggttgcaggaactgctaactagaataaccagtttagagaagaacataaatgacctgatggagctgaaaaacatagcacgagaactttgtgaagcatacacaagtatcaatagctgaattgatcaagtggaagaaaggatatcagagattgaagatcaacttaatgaattaaagcgtgaagacaagattagagaaaatagaatgaaaaggaatgtacaaagcccccaagaaatgtgggattatgtgaaaagaccaaacctacgattgattggtatacctgaaagtgacggggagaatggaaccaagttggaaaatgctccaggatattatccagaacttccccaacctagcaagacagaccaacattcaaattcaggaaatacagagaacatcactaagatactcctcaagaagagcaaccctaaaacacataatcgtcagattcaccaaggttgaaacgaaggaaaaaacgttaaggccagccatagagaaagatcacgttacccacaaagggaagcctatcagaataacagtggatctctcagcagaaaccctacaagccagaagagagtgggggccagtattcagcattcttaaaacataattttcaacccagaatttcatatccagccaaactaagcttcataagcgagggagaaataaaatcctttacagacaagcaaatgctgagggattttgtcaccaccaggcctgccttacaagaggccctgaaggaagcactaaatatggaaaggaaaaaccggtaccagccactgcaaaaaccataccaaaatatgaagaccaatgaagctatgaagaaactgcatcaactaatgtgcaaaataaccagatcaaattcacacataacaatattaaccttaagtgtaaattggctaaatgccccaattaaaaaacacagactggcaaattggataaagagtcaagacccatcagtgtgctgtattcaggagacccatctcatgtgcaaagacacacataggcccaaaataaagggatggaggaatatttaccaagcaaatggaaagccaaaaaaaaaaaaaagcgggggttgcaatcctagtctctgataaaacagactttaaaccaacaaagattaaaaaaagacagtggcattacataatgataaagggatcaatgcaatgagagctaactatcctaaatatatatggacccaatacaggagtacccagattcataaagcaagttcttagagacctgcaaagagacttagacttccacacaatcatagtgggagactttaacacaccactgtcaatattagatcaacgagacagaaaattggcaaggatattctgaacttgaacccagctctggaccaagcggacctaatagacatctacagaaccgtccaccccaaatcaacagaatatacattcttctcagcaccacataacacttattctaaaattgaccacataattggaagtaaaatactcctcagcatatgtaaaggaacggaaataataagtctctcagaccacagtgcaatcaaattagaactcaggattaagaaactcactcaaaactgcacaactacatggaaactgaacaacctgctcctgaatgactactgggtagataacaaaattaaggcagaaataaataagttctttgaaatcaatgagaacaaagacacaacgtaccagaatctctgggacacagctaaagcagtgttttgagggaaatttatagcactacatgcccagaggagaaagcaggaaagatctaatatcaacaccctagcatcacaattaaaagaactagagaagcaagagcaaacaaattcaaaagctagcagaagacaagaaataactaagatcagagcagaactgaaggagatagagacacaaaaaaaaccttcaaaaaatcaatgaatccaggagctggtttttttaaaagattaacaaaatagaccactagccagactaataaagaaggaaagagaagaatcaaatagatgcaataaaaagtgataaaggggatatcaccactgatcccacagtaatacaaactaccaccagagaatataaacacctctatgcaaataaactagaaaagctagaagaaatggataaattcctggatacatataccctcccaagactaaaccacaaagaagtcaactccttgaatagaccaataacaagttctgaaattgaggcagtaaataatagcctaccaaccaaaaaaagtccaggaccagacagattcacagccgaattctaccagaggtacaaagaggagctggtaccattccttctgaaactattccaaacaacagaagaagagcgactgctccctaactcattttatgaggccagtgtcatcctgatacccaaacctggcagagacacaacaaaaaaggaaaatttcaggccaatatccctgatgaccatcgatgcaaaaatcctcaataaaatactggcaaactgaatccagcaacgcatcaaaaaccttatccactgcgatcaagttggctttatccctggggtgcaaagttggttcaacatatgcaaatcaataaatataatccatcacataaacagaaccaatgacaaaaaacacaagattatctcaatagatgtggaaaaggcctttgataaaatccaacaccccttcatgctaaaaactctcaataaactaggtactgatggaacatatcccaaaataataagagctatttatgacacacccacagccagtatcatactgaatggacaaaagctggaagcattccctttgaaaattggcacaagacaaggtgccctctcaccacatagtattggaagttctggccaaggcagtcaggcaagaaaaagaaataaagggtattcaaacaggaagagaggaagtcaaattgtctctgcagatgacataattatatatttagaaaaccccatcgtctcagcccaaaaactccttaagctgataagcaacttcagcgaagtctcaggatacaaaatcaatgtgcaaaaatcacaaacattcctatacactaataatagccaaatcatgagtgaactcccattcacaattgctaccaagagaataaaatacctagtaatgcaacatacaagggatgtgaaggacctcttcaaggagaactacaaaccgctgcacaaggaaataagagaggacacaaacaaatggaaaaacattccatgctcatggataggaagaatcaatatcgtgaaaatggtcatactgcccaaggtaatttatagattcagtgctctccccataaagctaccattgagtttcttcacagaattagaaaaaaaactacttcaaatttcatatggaaccaaaaaacagcccatatagccaagatggtgctaagcaaaaagaacaaagctggaggtatcacactaccggacttcaaactatactataaggctgcagcaaccaaaacagcatggtactggtaccaaaacagatacatagaccaatggaacagaacagaggcctcagaaataacaccacatatctacaaccatctgatctttgatgaacctaacaaaaacaagcaatggggaaaggattccttatttaataaatggtgttgggaaaactggttcagaaaactgaaactggactcattccttacacctcatataaaaattaagtcaagatggattaaagacttaaacataagccctaaaaccataaaaacccgagaagataacctaggcgataccattcaggacataggcatgggcaaagtcttcatggctaaaacaccaaaagcaatggcaacgaaagccaaaatgccacaaatgggatctaattaaaccaaagagcttctgcacagcaaaagaaactatcagcagagcgaacaggcaacctacagaatgggagaaaatttttgcaatctatccatctgacaaagggctaatatccagaatctacaaggaacttaaacaaatttacaaaaaaaaaacaacctcatcaaaaaataggcgaaagacatgaacagacacttctcaaaagaagacatttatgcagccaacaaacatatgaaaaaaagctgatcatcactggtcgttagagaaatgcaaatcaaaaccacaatgagataccatctcacgccagttagaatagcgatcattaaaaagtcaggaaacaacatatgttggagaggatatggagaaacaggaatgcttttacactgttggtaggagtgtaaattagttcaacctttgtggaagacagtgtggtgattcctcaaggatctagaaccagaaataccatttaacccagcaatcccattactgggtatatacccaaaggattagaaatcattctactataaagacacatgcacacatatgtttattgcagcattattcacaatagcagagacttggaaccaaccccaaatgcccatcaatgatagactggataaagaaaatgtggcatatatacacatggaatactatgcagccatgaaagagaatgagttcatgtcctttgcagggacatggatgaagttggaaaccatcattctcagcaaactaacacaggaacagaaaaccaaacaccacatgttctcactcataagtgggagttgaatagtgagaacacatggacatagggaggagaaggtcacacgccggggcctgtcggggggtggggggcaaggggagggatagcattaggagaaatacctaatgtagatgacaggttgatgggtgcagcaaaccaccatggcacatgtataccaatgtaacaaaccacgttctgcacatgtattccagaatttaaagtataataaagtgattattgatactgttggaaaaaaaagaatgtaaaagtgttggctaggcatggtggttcacacctataattccaacactttgggaggccgaggcgtcttgagccttacttaatggcctctttcattatgttgcgcaggctagtctcaaatgattcaaattcccaaaagtgagaatcacttgtgcccaggagtttgagactagcctgggcaacataatgagaccccatctctgcaaaagagaaaaaaaaagaaaaagaaaaagaaaattacccagttgtggtggtgcatgtctgtagtcccagctactcaggaggctgaggcggaaggatgacttgagcaagggaggtggagactgcagtgagttgtgattgtgccactgcactccagcctgagcaacagagtgagaccctatctcaaaaaaaaaaaaaaaaaaaaaaaaagttagtttataaagaagacctggaaccaaaaagtttgagaactggactaaagtaacctaaaatggtaactgtttaaagtaggtagggattcttaatccagggttcccaatactcttatagaaagaaaaaatatttttatatctatatatcttttttttttcactaacctctgaatgaaattcagtgtttctattttgaatgcaggcaacaaaacacagcagtaatattagcagcaactgtgactttgttgccaatagatgttttttcctatatccatatttaaagattgtttcttgaagcaacatatagttaggtcttgcttttttatattgcctttgaattggaatgtttagacaatttgcatttaaggtaatgatgtgatttcctttcaattctaccatcttgccttttgccttgtatttgtcccatttttttctttgcttttttttgcttatttgtttgcatttttcatactttctttttgattgagttgaatttttttttttttttttgacatggagtctcgctctgttgcccagggtggagtgcagtggcataatcttggctcactgcaacctctgtctcctgggtttaagcaattctcctgcctcagcctcccaagtagctgggattacaggcgcctgccaccatgcccagctaatttttatatttttagtagagatgggattttgccatgttggccatgctggtctccgactcctgacctcaggtgatccacccacctcagcctcacaaagtgctgggattataggcgtgagccaccacccctagcctgagttgaattttgtttgttttttagtggttgctctgggacttacaatatacttctttaacatatgagaatttactttcaaaacatactatattacttcatatataatctaaggaccttaagtattctatttctctctcttctactattgtaatatattttacttctacatgtaaaccctgtgattgttaccatttttgatttaagtggtgaaattacttttgtggctgggtgtgctggctcatgcctgtaatcccagcactttgggaggccaaggtgggaggagcctttgagcccaggagtttgagaccagcctaggtaacatagtgagactctgtgtctacaaaaaaaattagaaacattagccaagtgtggtggtgcactcctgtagtgccagctgctcaggaggctgaggtgggaggattgcgtgagcctaggagcttgggatcttgggtgagctatgatcacaccgctgtattccttgtactccagcctgggcaacagagtgagaccctgtctcaaaaaaaaaaaaaaaaaaaaaaagacttgttcacgatttaaatgtatgctggtgaactttttgcctccagcttttttttttttttttcctgcccccaccaggaggataaggtctgggaaaaatcttttactttcatttcttcaacatatattcattgtatttatcgttgtaggttgaccagttttttctttgttttatagatgttctattttcttgtcttgcatagcttcacaagaagtctgtgtgtgtgtgtgtgtgtgtgtgtgtgtgtgtgtatatatattttttttctttctttcttttttttttttttgagacggagtcttgctctgttgcccaggctgcagtgctgtggtgcaatctcggctcactgtaagcactgcctcccaggttcaagcgattctcctgcttccgcctcccaagtagctgagacgacaggctcacaccaccacgcccagctaattttttgtactttagtagagacggggtttcgccgtgttgcccaggctggttgcgaactcctgagctcaggcaatttgcccaccttggcctccgaaagtgctgggattacagacgtgagccaccgtgcctggccaaagtctgtatattttaactttgtttctatctaaattttttccctctggcttcttgtaagattttctggttttgacagcttttcaggaatttgattattgtgcctcgttgtggttttctttgtgtttatactccttcaggaggggggctcattgagttacttggatgtgtagatgggtttttgtttttgtttttttttttttgttttttttttgtttttggtttttgagacagggtctcactctatcgcccaggcaggagtgcagtgggacaatcacagatcactgcaacctctgccttccgagctcaaggggttctcctacctcagcctcccaagtagctgggaccataggcacatgccaccacgctcagctaattttttgtatttttggtagagatgaagtttcaccatattatccaggctggtctctaattcctggcctcaagtgatctgcccatcttggcctcccaaagtgctgggattacaggcataagctactgcacctggccagatatatcagttttatcaaatttcgaaaatgtcattatttcttcaaatgcactgctccccattccagttacatatatattatactgcttgatagcttggtattgtcctgtagttctagtcttttttttttctttttcttttctttcttattacacccctaacccttctacccttgcttctttcttccctctctcctgtctccctttccccttctcttctttcctcttattctcatcacatttgaactttgtttaaatttgtgtattttctgttgctgtgtcttcagatcccctgaactttccttctgcagtatttaatatattgttaataccctccagtgatatttctatttcacatactgtttttgaatactgtaagttcttcttggttcttattattatgtgtgccattttcttcctcatttttttctttaaatttttgagcgtatttataatagccgttttagagtcctcattggctaatttcatcatctcgtttctgggatggtttcagctgatttatttcactctggtttcaggtccctttttttttgagacgcagtctcgctctgtcgcccaggctggagtgcagtggcgcgatctcagctcactgcaagctccgtctcccgggttcacaccgttctcctgcctcagcctcccaagtagctgggaccacaggcacccgccacccgccaccacgcccggctaattttttgtacatttagtagagatggggtttcaccatggtagccaggatggtctcgatctcctgacctcgtgatccacccgcctcgacctcccaaagtgctgggattacaggcgtgagccactgcgcccggcctcaggtcacattttctttcttcacatttctattaattttttattggatgctggacattgttaattttatatggttgagtggtggaattttttttttctgcttcttttaaagaattttggactttgttcagacaagtggttgagttacacgtggatcaactccatccttttgagccttgttttaagctttgttaggaagcatctagaatatcatttactctagagcttatttagctttgctactaagataagagtcttttgaggtttctactgaattcctagtttttcaacaaggaagacttctagtcagaaccatatgactctgggaattgttccacctgtaaatctctatttattctttgccttaccttttgaagttagtctgtgtgctgggcttggccacagactcaagtgaatccttctgcagatttctggaattttatatgcttagcttccacttctctggcccacttccaagctctgcttgagttctttctcccttcaccacagtctgaaaaatgcctctaggcagaaagccagggcagtgttaggtctcacttcatttcttttgcatctcagaaatcacagtcctacactgcttattatccaatatctaaaaagagttttatatttttttgttcactgttctggctgttattgtgggttgaaaagtctgtttctagttattccaccgtggccactgaaaattatttcctgtttttataccttttaagataatcatggagataaaaaataaagtttacgttccttttattttctctggctatttgggccttatggcgtatattgctaataactgcctatagtgtttagcaatttcatctgatctcctgttcacatctttaattattttcaagatgacattttaaatggttcagctataatacaataatgaacaaaatagtatagaattactgtaggatattttaagcaaataaaatagcatgtacattatattaaagctcatgagtgaatgtttttaaacagtacataagttgtttaaatgatagctttgcaaagaattgggtttatcattgtagtcataaggttatcaactgttggatttaatcatcttgttttctaatcaaagatttttagaagtaatatgaacataattgatgcctagtcaaagatgatcttcggtgaattaaaatatctgaaagtaatcctataaacttatgttaaaatctgtatggattttgccatgtagcttctgttgtccctttgatagtcttacaaggaaaaaaacaaaacaaactcctatgtttgatgcagtagtgtacattattagactgttagcatgtttcttaatctttgatttttttgtttgtttttcagatcgtcagtatttaaacagatcacatcatgcgtgagtacaagctagtggtccttggttcaggaggcgttgggaagtctgctctggtaagttagccacctaactgtaactgattaatataatacaagaagaattttgacatttccttgctttcagacttctagatgccaaagagaaaaggtggcattattatatatctgatatctgtcccacaaaggacaggaaatcatttaataaccacagatgtatatagttttataacattggctcatttattcttatatttaccaaatatttattggctatcttatatgtcaagcaccagtgttgatgatgcagagaggagtaagattgttctctttttaaggaatttacattgtattgggggaaactgattattacagattctagtgggataattcctcacctgcttccaccctagacttagatggaatgaaggtcattttttgtgttcatgctgtttttatttagtacatagttactgagtttctatagtgtcagattctagggtcacaacagtgaatgaaaacagtcatagtttcttatggagcttgcattatagtggaggagatgtaataaatacacaaagaactacttggttatacttgtgagcgagatactctgaaagaaaaatacagattaatttagaagaaaggcagagtggatgtgggagacaaattgggagttaatactgtataccagataattgtttatggaagcttggattaggaccatggcagttaagaaaagagaagtaaatgtttgaggattgagtaagtggtagaactgacataacttggtgctagattgatatggggactaggagagaaggagctgtcaaggatggctcccaagtttctagtttgagctactaattttatggatggattaaaagaagaagggaaacagtggagaaggagcagtgagagtccaaatcaaagagtcatgtcaaattttatgtttgtgacatgttgaagtaataaaaaagagaggccggtgatatgattttgggtgccatcaatatggtgatgatatttaatttcatgagagttacattgctgttaggcatgtaagtcagtacctctgtcaagaatgtttgagaatatctgtcatttttaatggcatataactttcaattcagcgattccctctctaaaaatgtagcccacatataagttcacatgtgcaaaatggtgtggtcagggaacatcacaacattctttacagtgactagagtctggaaacaacctaaatgtattccattaaggggctagttaagtaaattttaatacattttcagagtagaatacagccattagaatgcaatagctctatatataccgatatgtaatgatatccaagatacattattagagagaaaaaaggtactaaacagtgtagactataatttgtgttttatatttaaaaaaatgtaggctgagggtagatacctgtaaaatcatagagtatctcttcaaggttaaataagctatgaataacatcagttactttcttgggagtaggattggatagctgggaacaagggtggtagataagcttagttatcactgcatagccttttgtgcctttttgaatttagtcctatgtccatgaattaccttttcaaaaataattttggaaaaagtccataggagtgaaagaggtctagggagatactagagagagaagagcagagcccaggactgagctctgagtacctctcaacctttagaaagtagataggattggaggatctagcatagaagaaggtgtctttacttgattcctcaaaagtcaagtaaaaaagaggaaagagatgatcagagagcatagaggcagttggacatgataaaggaagcagctttagtcaggtcatgttgccataaccataatggggtgggttgaagattaaatgagagctgaggaaatggaatatagacatttgaagaagcttgattatgagaggggacagagaatgggggcagaagctggagagatattggggttaagggaggtttttgtttttgttttagaattggagatagtaaagcatatttgtatgctgggggcaattcctctccactggagaggaaaataaggatacaggagagggaaagaggagatgatccagtacaaaaacctgaggaataaaattataatctatgtgaatgaatgaatgagatgtccctgaaaattaagacagaggataagattcagaggagtagtcaaacattacttttagtaagaaagaaatgagaaacgttggattgttttgcatttttgcaagtcttattaatgtctggcttatagaaggcacatgggctcttatgcctgcttctgtatccagtctctttcaatagcacatgttctataccctttggaagattccactgtaaacttatgagagaagaagaagagtacctcttagaatacatcttagtattgttaggaagatagtttgaccttagggagcctctgccttggaccatattttgagactctctgctctagcctaaagcatattaggaagctgtattagactgcctttttttttttttttaaatcttgaatcagcatcttgccctggagtgcagtggcgtgatcatggctcactgcatcttcaacctcctacacttaagcaatcctcccaccttagctacccaagtagctgggactacaggtgcatgccaccacacctggttaaatttttaaattttttgtagagacagtctcactatgttgcccaggttggtttcaaattcctgagctcaagcaatcctcctgccttggcctcctaaagtgctaggagtacagcatgagccactgcatccagcgtagactgctttgtatatttaaattatgtgtcgtacttagaagatgaggtgattaaatccttgataaaaatcatgattaaggtttttggtgtgattatatcttgagttgcctttgaataatagaagcttagtaggagaaagaagtttgtttactatatttgagttaatctctttagctcaagctaaaatagtatatcaaatattcctctgagtaatttaagtgtagatgacctcagtccacattcttacccttgctttttaggcaataatgtaccagaccctgttttaaagttacctaggaaatatcttaaaaccgtcttctgtacttttttcacttactgaatgataaatacgtattttctagtatgtgcttttggatgcctttaaaagttgataatatctgaaaaagatgaatgggcaatattttccaatggaaaaagtaaggctttggaatcaggaagatgtatgtttgaatctcagctggcaaataggaagaataactatttctgggacaaatgtgaaatttgaatgtggttataaattaaaagtgactagcttaatgtctggaacataatagacattcagtaagtttaaatttccctttctcttttccaccacaatttagaaaggctttaacaaatttacaagatgctgcttgaggtccagctacctgggaggctgaggcgggaggatctcttgagttcaggagttcaaggccagcccaggcaacatagcaaagaccctgtgtttaaaaaaaaattagaacctttgtcactccattaagggcagagggcatgggataaaagttactatagatatataaaggggcaataggagtttaaatattgataatttttcatgttttaattagttcagatatgttatttgtatccttgtatattaagacttaatgtaattaacagtgtattatcagtattgatgacagtttttaacatgactacctcctttcataataaatgtactcttagttatggatgtatccttatattgaaagaattaataataatattatactttacatttacgtgtttacccagaattttcacataatttcaattaatcattataatttgtaggttaagtaacattcaaaggagttttcctttaattttttaatatttctctttttttttcccccagacagttcagtttgttcagggaatttttgttgaaaaatatgacccaacgatagaagattcctacagaaaggtaaaatgtgaaacttgtacacacatgcttacaagtagttccttatgatgttaaaatttgatctgtagatttgctttttgaaaatagttttgagaaataatacaaatattgtgcatctgtttttaaaagtttcatcaagacagaacatttcttaacagaatactactttgatattcagagctctatgttctgttactgattagtgacttgttccttaatgtggacattttcctggtggggaatgttgccacatatgaaaaaattgcatataaatagtaggtgtgttttcaacttactcttttgttaccaacaattaagaccacctttatgcttgaagttatccagtgactgaacatttttatttttgtttagttttataagtttaaagatatctttagactaccaaaaaattagagtctgtgtaatactataattgggttatatgccatacatttgtcaaaacccatagaatgtaccatgccaaaagaaaatcctaatgtaaactgtggactcttggtgataacgatgtgttcatgtgggttcatcagttgtaacaaatgtaccactctggtgcaggatgttgatggtggggtgaggctatgcatttgtggtggcaaggagtatgtgggaaatctctgcaccttcccctcagttttgctgtgaaactaaaactgctctaataaagtctatttaaaagggaaaaaaaattaggtacttggtcttgacaaaaaatattctgtagaagaccagccagagttgtggaaaattttcagtattttctatgtcaaatatattgggtggggtggaggttataaaaggctagtagccaagaatattttttaaaaagattaaactttaataggaaaggattgcttttgaagacatttttagaatttacctttaatagtgctgtaacttttgttgaattaatttgttagttcatgaaggactactagtagagcagtttcattgtcttcaaattggaaacagaattatgctctagatacatcaagaaactatagtcctaattgattattcactgaacattcccagttacaaattttgcagattatcacacttgtcccataagtggtggggtggatgagtttgtggtctgaccagtggtgcccctcatcaatgtctgatctgacacagaagcagagtttaaaatagtctttaggttagcacatttatttttagaagacagtgttgctctactgaaatttccccaaagtaagttgctagttaaagctttaactgcaaagcaagatctgtacctaaaattctaagggactaacttttcttaatcccttctttattaaaacagttttccacacagttgatagttgatactttcattagaccaaccttcttttcttttataagaccaatgggtaaatagaactcagtgtataaaatttcacctttcacatagagcttttctagaaaagtgcctttttcttgaggcactgttttagctcattgctgtttattttagtactcctgtgtttcttttatgtcttaaactcagattttactgtgtatttaattttctgcatattttagtaaaattttaacaacttgaacatggtaagttggcaagattttctttaccccaaaatgttgtgcgcattttgagccatttaatatttttgtactttgttttctttggagataatataaatacacatatgtacttttttttctgttagaactatacttgttcgttgaagttttccttaaatttcaaaatatgacttttgccttttctaataacaaataagaatcgttacagaggtcagaaaatatctaaactcagcattaaccatcttggcttctgtaatatgaatagactgtacttgagaccgctgttctttattgtggtaccaagtttacccccagccattacagcatactgctggagacaggctttgtatttgttaatagttactttgatggaagaggtgggaagaaaacagaatgagattttgatgttactctttaaccttttttttttttttgcccccacagcaagttgaagtcgattgccaacagtgtatgctcgaaatcctggatactgcagggacagtaaggatgttttctctttttttgatagattttaatttgtgagcaggttttgtcatctgagtaggttttgtcatccagataattctgagtaaaagtaatcattctgattaagaagaaattctctgaacatagggattcttaagtatatgaaatcaactctgatgtagttcatgctcacatatcacaaagttcacctgtaataatctgtgtgttgggtttcttcctacattgaggtaaggattatgctgtcagtgattttttaaaatttattttaaatttagagctttagttaatatttgtatttctatgggtttaaataagaccttgtctcttggcaccatagtcattaatttttataattttttcttttcactagcattttgacatctcaaggggctggtgacagatacatgttttctgaggaaggcaaaaatcttcctcagaagatttagaattattttgagcctcctttttctaatctttaaatgagtataatgatgttagtacatcataaggtgtttgtgataagcaaatgagttaataattataaatcattaggcataatgtctgttacacagtatggaattgtgtatttgcttttattcttcttcattaataccatcacctttataatttttattaataactgatggtttccagttatactgccacataaaatacatacattaagcaatctttgcttttctttgtttatttttctccatgcacatagacttgacacattaggcaattcttagctttaaaatggatgggttcgttttttgttttgcttaagagacgaggtcttgctctgtcacctaggctagggtgtagtggtgcaatcatagttcaccgcagtctcctgggctcaaacagtcttcctgcctcagcctcctgggtagctagaattaaaggcacgtaccaccacccccagctaataaaaaaattttttttgtagaggtggtttcgctgtgttgcccaggctaatctcgaactcctgacctcaagtgttcttcctggctctgcttctgaaagtgctgggattataggtgtgagccatggcacctggctggcatttttaaatgtgataagttgtttaaaattcagcacaaagttttccactataatttttataaatgatggaaacatttcagatagttcaaaaaagcatgtaagcaaattggagtgattttatacaacaatatagtactaattatactgtatttttccattcttttttgggaaaatggcttaactcttatcagggacctttgccctcacaacaagcttctggtaaagaccttctgaaactacattttctatcagctgaatcaagctatctctccctctcccaccctcctgctctctaatgtttttagcttctgaatcagcagaattcccctttgtttccagagaccctaatagctaaaatgaatactttctgctttttttttttttaaatcacatccacagtgtacgggcattcttctttctctgtccagattgtaagaaggaagttctctatcacagagatctttactttgtgctatccaatatcgtgtctgtctcccatctagcactcaacacgctgtgttataaggcctatttgcttgtttgtgtccccagtaccttgcataaaaccttacaaacagctgcataatcttgtctcaaaatcactccttacactttgaagatttttgctttctctctttcacatacactgattcaatcagaattcttagtgattttactatccatatagaatctatatggatattataaatgatttactaccctggcttggcctgtcatttccttgatgtccatcctacctttaaggcattcataccatggttttactctaggctatgtgattaccaataagtataatacctctctaatctaatttccaagcatcttatcctccattactcactacttttttctttatccatctcacttcctcttttttttttttttttgaaacagggtctctctctgtcacccaggctggagtgcagtggtgtgaacacagatcactgcagcttcaacctcccagggtcaagaaatcctcccaccataacctcctgaggagctggtgctactgcaggtgcataccaccacacctagcttttttttttttttaattttttgtagagacagggtctcactatattgtccaagctggtcttgaactggactcaagggatcctcctgtctttggcctcccaaagtgctgggataacaggtgtgagccactgcacccaggccatctcatttcctttagtgcccttcaacttcgttacaacctgtagtccatttatcctaacatctttttattatcccttatatcttcaaccccctctgcatatagcttcaggtccacggtccatcatttataattctcttgaatatatcctcaactcccttgacttttcagcagcctttgactcagtttatcattgctttctaatgtaaaacctttattcatttggcttccaagaaacaatacttgcctgatttcctctgtctcattggttactcctaagtctcctttcctaattcctctttatctcccctacctcttaatgttggaggacctcagggttcaatacttgcacttctctttcctaacaacactgctttggagatcttgtagttgcttggttttaaatacaatctgtatgctgataaatactaactttgtaaccctgtctgtattaggccgtttgcattattgtaaagaaatacctgaggctggataatttatgaagaaaagaggtttaattggctcatggttctgcaggctatacaagcatagctccagcatctgcttctggtgaacacctcaggaagcttacaatcatagtgaaaggcaaagaggagtaggtgttttacatggcaagagcaaagagagagcgggagatgccacacacttttaaacaaccagatctcacgagaactcataattgtgaggatagcaccaagctattcatgagggatccacctccatgacccaaatacctcccacaggcctcacctccaacactggggattacatttcagcataaggtttggaggtgacaaacatccaaacaatatccctatctctcatttcttttctgaacttcgagctcttatatctaactgcctcttcaatatctctttttgtatgtcttataagcatctcaaatataacatgtccaaactgaactcctgataacctttccctgacctgggtctttccagtctttcccatctcagtaaatagtacctttttagttggttatgcctgaaaccatggagtcgtccttgactgtattttttgttatattatgtgtacatccaaactctcagaaaaccctactggctttaccttaaaaacttacccagaactcagctaccaccactagaatctaatgacactatcttggtctaaacagttgtcatctctcagctggattatttcaataacctcaaaactgatctccctgcttctcttcttcacccccttcagattgttctccacacagtaaccatcataattccatttaaatgtaagtcagatcatgttttcctcagcttaaattatgcattaaactcagagtaaaagcccaggtctttattacatttccctgaaaggtccaaatgagaatcctctctctttgtcccttctctggcccccactgctatactcacccactaggtaacaatgtttcaatgaatccagcctccttacagcttctcatacactttagacatgtttccctttggggcctttgcatttgctctttcctgtgcttggggtagtcttcctccacataaccatagagcttattccctcacctccctcacatggttgctcaaatgttacccgtgaggccttccctgagcatagtcttttaaaatataactttatattcctaccctcaaaataaactcccaacctttacttttctctataacatttattaccatcttgcatacttgatttttgtctgtctccatgtatactcctccagggcagaaatttttgcctctcatgatcactaacatatccatagggctacaactatgtcagtggatatttgttgtgaatggatgaaacttgtagaatgtccttaagaaggaggttggcattctcaataggagggaacaccaaccacagcagttctgtaaggacttttcttaaactggattttcagaactcaggttgcctgtatgtttattcttttgatttaataagaagcagagaccatgatctctagagaacatcatagaaatagtgttgctagtatttgtagcacttaacatttgtaagtaaactcatttattatataaacatttggacagtggcagaatttaattggttaccatagtggtgcaattctggaatatgcaaactttatcaatgaaaaatccaggaaacttccagtttttacatctttcccagaaaatacactggcagcagtataggaagctcagccatgttcctgtggcacaccttagacgaatttgaagctggggaaatggctgagtggtagcatagctaactccctggaatacaagaaagagtacatcagccagggtagaacaaccagaactattttagatgtagtagacaaaatagaggtagtggtcatggggaacaaggaagccaaggcacaacaagcttaagaaactttgtggatttatcttttacgtttaatgcatccagaggtaaaaagatccaaactgtatagttatttaatataaagacccaagacatacacatttttaatattctgccatatgtgctttttaagtaatatatatatataataccaaaacttttctaaaagaagattttgtcttatattaacctccatagttacaacataaagtaatgattgtcaccaaataaaaggaagtttaaaattaagtaattttaatttggcatgactaaagctcagtaactaaatgttaaccattagtaaatttaactaaaggggatagatagtcattgcactattctcacatcttttctaaaggtttggaatgagggggaaaatgaaaatacatgaacaagctcttttttttttttttccgagacagagtttcactcttgttgcccaggcttgagtgcagtggtgcgatgttggctcactgcaacctccacctcccgggttcaagtgattcttcttccaccaagtagctgggactacaggtgtgcaccactacgcccggctaatgttgtatttttagtagaggcagggtttcactgtgttggccaggctagtcttgaactcctgacctggggtgatacacctgccttggccttccaaagtgttggtattacaggtgtgagtcattgcccctgaccattaacaagctcttataaagagtttattgactgtcaagatgataaaaatattgctatgccatgggaatagaaaaagaaagatgataaaatctgccagtagagatattgattctggatgatgaagtcatagtttagtattgggcttatacctcagattgttagcacttgggcagtagttgtgtcataaatttgcaaataaaattatttaggatcaaaagatctgtttctaaaaaattatatacagctctaaatcacacaaaagcaaattaaagtggttaagaattcctttttaattctagtttactgtcattgtttctagtcacctcagttgctagaaacttgtgttatgtcttgttttctgtcaggatagcaagtaataaaaaatgttactcacttgtaattatgctgttttaaattgttgcagtatacattcaagaaatttatatatttataattgcatattttttaaatcataggagcaatttacagcaatgagggatttgtatatgaagaacggccaaggttttgcactagtatattctattacagctcagtccacgtttaacgacttacaggacctgagggaacagattttacgggttaaggacacggaagatgtaagtattttttctctctgtaagatgttatgccatctctctgtggccaaataaaaaagtgcctgttttctctattagtagaggatttggaagctatctaccacatgcctgaaagagcccctgtgaccaaaagaaaaaaatttaactttcaaaattaacctcaaaattatgtggtgagatgtttagaaaatgaggacatatgtgataaagtactcattgtgctataggttaaaaagtgcagtagaggaaaaagaggagccaaagaatacttcatagaagtgggacctgagttgagctttgaaaggtgatggttgtgtcagaaacagtgttcaaagaacattattaagatccatagtggtgtgtttttatttctaaaattccattggtataattcacacatcacagtctacctcccgggctcaagtgatcttcccacctcaaccccctgagtagttgggactacaggtgtgtgccaccctgcctggctgattgtttttgaattttttagtagagaccaggtctcactatgttacccaggcttgtctcaggctcctgagctcaagcagtcctcctacctcagcctccctgggattacaggcatgaaccattgtgcctggccaggattatattcttaaaataatttggcatatctatgtagtaggatctcttccatttttttttttttttttgtctcttccttcttccttcgcctcttcccctcaacatatacttttcgttagtatttgatgaagcttgcggtcccaactaatgcatttcagttggtggcagataattgcttatttatttttttaaaaggctaagtaatgagtatgttattgttcattttacgtttttttcttcccacaggttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgaggtaacctacaactgctgggcagcacaaacaagtgcctttttagtttgctttaagttaacagccagacttttaagaaaaaatttttatcttttaagcaatcttgattccataattttataggaaacactaagtaattcctggaaactatattttttagcttgcataaggtcactttgatggctgtatgaggatacttaaatttaccttattgtaaaagaggaagctaaaattgaagaatgtgtgtaaaatcctgctaagcctctaagtgatatgcgataaagtggtgtgtaaaaattgttacatcaccttatattgtaataattatttacccaaatgtgtataaataggttgtaaagtcaagttggaaaataatatgtttttatggatatcacagaattgtgttctgagtcttacctcacctttggtgcatgactcataagtgggtaatctgtgtgggtatggacatgtacctggaattcactcagtcctttaggcctgatacagctgatgcacaaggcttttgtgtggggcatgggggtggggtcactgggttaagcactccactatcttgaaaacagctgtggacaagaatacttagcaaataagctgcatgcctgggtgtaaagggccaacagtttactagtttactgggcccctaaaaatttagagcaatttccaactgtccccaccagtcaaccttaaatagttcccttgcttttgttaaccttaacataagccttttaaaaaaataaaaacaacagagtgggcttctttcctgccgttgcttttgccatttgtagcattacaggtaatcagtcagaattcagatcacttaactacataggtgagagtgagagtgggttaagttatgagtcctctgtttttgctattctctctggcctgtggttctgctggccactttttcttgactaatattatgcttatagactatttgacttttaaaaatgaccaggttactttaaacacctggcaggtaaaaaaaaattaagcttgcttcaacttctgtattttacagataatcaagaatgccaaagcttgtttttttatgtgaaaccatttttaacaagtacataaaaacaagaaatttataaattgtatttattcagcaaatatttattgactattgtgtgtctggcactgtgtcaggccctcaggtaacagtcactcagacagacactattcctgccctgaagaagtttgcatcctactgggggaacaagtctttcagcaataattaaagaaaaaaagtgattttgataaagaatttgttagaaattgtgaatatgtttggctagcagaacagtgacatgaggtcactatctacaagataattggccttacgggatgtggttccttgctgtccttgtccttacctccatgggacccaccaaccaagttcatcagactccaggctccggtggggctgggttgggcctgagtccagtgcataggacttctccctttgggagccagaggacagtacactacatgtttgtgagaacctacatgctattaaacttcctctggattagtttccaatgcagcagagatactttttcatagcagtcttgttaaagcagagagtttataaacgagggtttataaaaacaaacatagaaaaaccataaaatgaaatgcattagccatctcaagaatctttactttttggaaaacatacaaactttatgctcagttcttgagagtggggagaatggagcagataatttgagtttcttttaatatttttctctttataacccaataatccagctacaggatttctttggtagttaatagttcctcacacaacttttgccttgtaaatttttttgtgagttttgaatgcctgaagtatagagagatactttcaaaaattcacctcttggccttaaatttgaaaacagacaccaggacatactgcttggctaaagagccccctaattcattcatatatatatatatataatttttcaaaaactcttattcacaccactttgcaacgttcttaaagtagtatatggctatgccagaatcacagtagtcttaatcaagaattaattgttctttgctgaggctggaatagtaattggaatcaagacaacccaatttaggaatgggagagggattgagaaactctattctgtgttccctttagatttttctatagttcagagagatgaggaagaacctaggctggggcctttcagcatttctaaccaaatattatagttcgaacttgccctcatcactgaaccatctgctgctgtgaggtaggcaatgttttccaaagaaataatttagaataatactacaagcattagttacctttctatatagtaccagaaaccagaaactggctagtatgaagaaactgaaatagaaactacttgtaatttttattaacttactgttttagtttacttttattatttttttatcttatagcttatgcattgagtatagggaactaatgaaaactcatttgtggcttaagcacattgagttcttgaagttttcagagttttgaaacaacttggacttcggagttgtaaaacagaaactacaattttgtttataaattctgttttcagactttctttagaaataagatgacagagagttaaatgatttgaagaggatgggagtgggaagaatggagcagaaagaaaagaatttaaatgagtcacttttgtagcttttggataaatcattcaggtttttttttaacggttaatttagtcttgtagtctggatcatttaaaaaaggaaataggtaattatcattttaaagaaatacaattatttgccatctatcttaaaatacatgtagaccgataatttaaaaatattttactcttaaaatgtactcaaatgatgtaagaacaataaagaagaatttgtttacccttcatcagattcacccattattaaaattttgccacttgtttacagaaattacacttctttacccctaaatattttagtgtatgtatcctcagatcaaagacattgtcttacacaaccacagcacaatgattagaatcctaaaaattgatgacacagtctgtgtttggtatatattcagattttaccagttgtccctgtaatgctccttaaagccagtccattttttaatatactgcaaagaattatttattccagattagtatcaataagggacttctgtgatatttgtttttattccaaatcattagtaagtgttgtatttcatagcaaagcttatctgtttcatgttttaatactttggcatcagaattaaaatagtctgcttttatgagataagtagcattgtatttttgtctttgatactttgcacttttcatccaaaaatgaatccacaagatgtattaacaaacattatttgggctgggcacagtggctcacacctaaaatcttagcactttgggaggctgaggcagccagatcacttgacctcagatgtttgagaccagcctggacaacattgcaaaacccttgtctgtacgaaaaatacaaaaattagctgggtgtcgtggtgcacgctgtagctcccagccgttcgggaggctgagatggaaggatcacttgagcctgggaagtggaagttgcagtgagctgattgcaccactgcactccagcctgcgtgacagagcaagactctgtctcaaaacaaaacaaacaaactaaaaaccacaaatatttgttatttcaaatcaaggattagcagactttttctactttttactttaaccaaaattaacatcaaaaaaaggcaaacaaaaatcatgcgcctccgcatgtgataccttgaaagggagacagtatctcttttgtcctattttagacaaaaatgtatataacctgaatctaatcacgagaaaacctcagataaacccaaatcaagggaagttactagcctttatttttcagaaatgacaatgtcctgaaaggcaaaggccaaagaactgttccagatttttaaaaactaaagtgagaggaaataaactgcaatgtgtgatcctgaatggatcctgtccttggaggggaaagttactataaagtacattattggggcagttgacaaaattggaatttgctctgtagttatacaaaataatgtgtcaatccttaaatgtctcaagtgcaataactataacgtgtttatgtaagagaatatccttgttcttaggaacaacttaactgttaaaggacttaatagttaaggtctactctcagatgattcagaaagtgtgtgtgtgtgcacgtgtgtgtgtatgtatgtgtagtaaaagtggcaaaatgttactaattggtgaatctgggaagaatagaaccgaagttgttggtactatttttgcaacttttccgttggtttggagttttcactatttttcactaccagttctttttcttgatttgatgtcgaatatctaggagcaagggcatttccttcattataaataggtaagtcctgctttctaccctgattgaaagtcagcagagccttctaacaaacctgactttaaaagaaagaagcagaatgcagatctaagaccagaatagtacttaccagaattgttttgtggaacaaagtctcaaaaactggtggagtaagtactttttttcttgtttttacttagatattttatgacctggtcagacagataaataggaaaacaccagtggaaaagaagaagcctaaaaagaaatcatgtctgctgctctaggcccatagtcagcagcagctctgagccaggtaagatgctaaaagcagaacaagtgcctttctcatgctcctattttggctttttccagactttagctacttcccatttcatctgttatggtatttctaagcttctgtaacttgtaaatgtgatatataacttgtaggtacgtcatctgttggataacttgccctctccccttgagattctaagctctctgacagcagggaccatttctgttttttcttgccactgtgtccccagtgcttgatacagagttgggttttaaaaaatagtagttgaatgaatagaacgccttcctagatgactcccaaattcattcttaattgaagtgaaacagtagttgctctgaaaaagtttaagtgcacatttggtgaattatcccaaagtgacatacccgtatataacaacaagagtcacccttccccaaattaaattaaaactctgccctgatttctaactccatggattagttttgcctctctttgaactttacataaacaaaaacgtagtgtatttcctgtgtctggcttcttgcactccaaaatatgtttttgagaattatttatgttaaatgtatcaatagttcatttttattgcatgacagtactggcagtatgtttatgtattcttctgttggtgttcatttaagttctttctttgggggaattagtatgaataattctgtgcacattcctatatgtctttgtgcacatgtacatgcatttctgttgggtatatatctaagaatggaatggccagatcatatactatacatatggacagctttagtagatactgctaaaaagtttttcaaagtggctgtaccagtttacacaccctgcaacggtttttgagttctacattctccccaaaattgatattgtcagtcttcttaacttgacccattccaggagatgtgtggtggtgtatcagtgtaattttggtagttatttccctctctggtatgagtcaacttctttcaaataaaggttttctatttgggcttctaagtattagttgactttaccattttagtttccactaagtgaccccattggaaagaaatttatgacagcatttaagctgactctcaagtgagaaaccaggatctatggggacttttttctttaatttgtattgtatttaaatcccctgaaggtttctacttaatcagttctataaataataccataaaagattattttcatggagtggatttattacataatttggtgcttattacatgattattactaaacttggtctccagttggagtaaactggtcccactggaaagttggttacactaactcttgtaagtctcttggtccatttagtagattatcccttaagagctcccaattaactactgtgtgcttccttagagatatgaatctctctattaagggaaacacctgagtaattgtagttccttttttaaatgaaggtacatagaggaaaaatgggcagaaaggagaaaagggcctagggattatctctggtagtcagatttagaaaagacagcatctggctaatgtttgctttaggcttttaatgaaatcttaattcaataactttttttcttttttttgagacggagtctcgccttgtcacccaggctggagtacagtggcacactctgctcactgcaacctctgcctccctgggttcaagctattctcctgcctcaacctcctgagtagctgggacttcaggtgtgcaccaccatgcctggctaatttttgtatttttagtagagacaaggtttcatcacattggcctggctggtctcaaactcctgacctcaggtgatccgatccacctgcctcgacctcccaaagtgctgggattacaggcgtgagccaccgcgcctggccttgattcaataactttaaatcatcagttccctgaaagtgattattaagattactggtgtatgtatttgtttaggtaaaggtgcaaagatagagaaaatgaagactccagttccagttcttaaatactatattatttaactctgttatagttgactggcttattgacagctcattaccatggctggccctaatttaatttccagttctcacaaaatatccttttagcttatgttaaaggaaaaggtgccatctcctggcctattacgatttttaaaattcatttatacacacccaacaatgtgacagtcccttgtgagttttaccttagagaagataaatcttgacctagatctggaataagactttagtcttgcttgcataaattcttagactctgatgtgtgataaagtttacttaataagtcatccaagatctctgtggatgtttgataataccaaataataggtgacttagcaatcagactgctttgcatacattttagtgtgattgtagatttgaagtgccatgttgttcctgtacttttaaaagtactgagatacaggatagatttaaatagaaattataaacgtttttagtaagagtacatgaactctgaggccaccttatctagtccatagcctttaggcaaaattgtattgaatcatgttaatctcctttttatatgtcccagttttaaagacatctgagagaaattcatcatgtggattattttacctgattcttgtctgttgacaataagactaactttgattcttctgctcttgactatggggattagctctttctgtatcatcccttgccttaacctgtattagaaatggtaattctaatatataatcataaaatgcttgaataaagaatatcttatggaaagtttatggaggcaggtgtgtccttcagtaaaaaaggaaagtaaaaataagatggtaatgagatagaataaaaatatcattgtcttcctttgtacagacaggattgtcagatgtaatgggaaacactataattgagtataactaagtataactgaggataattcaagttgatcagttatagactcctcttgtaaacttctatttttgattttttaaaacatttttaaagggaatttaaaatagcactgttactgtagctgtttagcataatttagttctcaagttatgatcagctaaaatcattatttttttattttattgaatacctgcttgtttagtaccattttctgacatcaagagattaaccatacatatatgtatatctgtatccaatgtcttagattacaggaatgaagaactgttgcctaattggaaagtgccagcattccagacttcaaaaataaaaaatctgaagaggcttctcctgttttatatattatgtgaagaatttagatcttatattggtttgcacaagttccctggagaaaaaaattgctctgtgtatatctcttggaaaataagacaatagtatttctcctttgcaatagcagttataacagatgtgaaaatatacttgactctaatatgattatacaaaagagcatggatgcatttcaaatgttagatattgctactataatcaaatgatttcatattgatctttttatcatgatcctccctatcaagcactaaaaagttgaaccattatactttatatctgtaatgatactgattatgaaatgtcccctcaaactcattgcagcagataacttttttgagtcattgacttcattttatatttaaaaaattatggaatatcatctgtcattatattctaattaaaattgtgcataatgctttggaaaaatgggtcttttataggaaaaaaactgggataactgatttctatggctttcaaagctaaaatatataatatactaaaccaactctaatattgcttcttgtgttttactgtcagattaaattacagcttttatggatgattaaattttagtacattttcatttggtttgtgtgtttttgttattgtttatagattaaagcgtttattttataatgaccacattgttttaaatgcgacagtagctcctttctgcctagtatctgcagaacactggctttaaactatactaagtaactggtgatttctctaggaacagacctcgcactttctgttctaaatatatttattcctactatacagtaaaatacatcagacaacatagaatagttttgtatattctctcttgatcttaaagattgtatcttattgaatatcccactgtatattatttttatatgtaaaaagataagtttaatactgtatcagggtttaacttttactatttcagatcttccacagcttgtaatttcatcaagggaatccttttgcattgttaatttgttgggtgtgagtccaccaatgaagtgttatgtgaaaaatttcaaacttgctttataatagattgaagaatttgagagaagtgagagaaagttaaaacacataaaaggaatgtgttacttttgcttaaactacttatgaaatagtatggtagtagtaatatggaagagattgctaagttaaaattgtagcttcctatatagtggtgctttttcttttccttcccagttattttcctctttacaaaagatagggcttaagtaagacatggacccagggtgatactacttatgtagtctctataaagagaggtagaacaaaaagcttgttagccaattaagttctggaaaaggaaagaaacaagcttagaaaaccctgtgccttgtcctcaaatattaaggaggagacagaccagtcctagaaagtctaagtcattgctcagggatctctagatactgtctctttgcaactaggtatgaagaagtgttcatgccttgctgagattttccaggcatgtggtcagcctgtcacttactaaactgaaattttaaaatcaggtttcaaatgttaagctttgaccaacctgagaaaatgttaaagtattgtttttaaaaaaatggaaattttttttgtttgtgtttttgttttagtttcgaataaacttagttaccttacacttcccttctacttatccaattatgcatatgtctgggattgaggggccaaaactatagcgaacttgaatgaagtattagggccagttgtcaggtcagggtggcatcttttattttaaggtcctctaaagtcattctgctttaaaacacccctcaaacatacctttaaacttaagatcatagacagacatctcatcaaccagtaaaactttctaaatactaccttgtcacatctattgtgtagttatttaacagattaaatagaagtcatttaataagactccaagtctcagtctgcttgactagtagcataaactcagtctattctattttagaatgtggtggagaaagatgatagttattagattcctttgtcacatcttatacagtccacttgggttaaaggtggaactgtcaagaaaaacgcctttctggcacacagtgatatgcagagcaggaccagctgaagtcagatgtgcaaggaaatctgtggttgctgagcaggatgaaaagtatcctgttagaaagtgagataggtgtgtttttatattgtcctaatgtgaactccttagtcttggttccaaagggaagggtacctgaaaataaatgtatttttatagctgaaaaatcaagagtttctaggatattgtgtgaatgtcaaatgataaatatctagaaactgatttcatattagtatgtgtggctatttaaagtataatgactttggtttggttatatgagtgacacagaatttaaggaggcttcatgccatagttcatagtttgctctaatggcttggtggtatccctgaacagtctacttttagaaattaacagtaaatacacaatccagctgtaatcttaccctccaccagggggagcttcaacatcggttaatactttttttttttttgagatggagtctcgc

SEQ ID NO: 16510 - DNA, 16047 bp, Human
catactctgttttacttctgatgtttattgtttatggtctatcctcctgcaatagaaggcaaactccatgagggcgtagactgttcaccaatgggtccctagtgcctagcacagtcctggcatgtggtaggaaataagtatttgttgaattaatgaatgcactcatcaccttaccacagaaagtgggggtaaaggagtgtcactgtaggttggggacaggagggaagtgcttgcagccccttcccactctgcccgcccacagaagttggggctgcggagtgaggggcgctaggacccggaggcggtggggagagaggttaaaggttcctctgaaaccttctccactatctctgtctctgagatgtctgcagccagctgcaccccatctgcttacactcgggaggcacctctaacgccaccaccgccccccacccccaaccaaagactgacagtgaatttggagttgggggcatcggcagttactagtaagttgtttaccccaggactttaaaatcatatgaggaggcaggaaagacacctgcgaggtgggagaaactgaggctgaagaagcgactggagccagatcccaggtgaactctgaactctcgaagttaagcccaggattttaaaaagaattttacttctgacggagggccacagtgcccgcagggcccgtacctgctatcctgggaggtttgagggttggggtggtggggagaggagagtctctttcggcagactgcacctccccaccccttccctatttaccacgcccccaggcgctgtgcgggcggagggagggtgaaggagcagtggggaggaggcagggcgagaagacgaaggagggaaaaagctccagggcttccactctctcggcaggacccccaccctggcctctggtgcgggaaaacctcccagctgtttctgattctttcatactctcagccccgcccgagagggtggaggaccgaggcacagagggggagcggggagagactgagctccgctgagcccaggagtaaggggcggggagtccgcaggtgcccccttagcgtcggcagtcgattcccggtccgtaaagaaaagcacccgggccgggcaggccgggcaagcaggagccaggtctaaacgtgatgcattgggggtggggggtgcagtggctcagaagaagcaggggcgatgagctctagctgaaagcatcccctgctagaagccgactgcccacggcgctcctgtaggcagtgttgaaaaggtagttaagacctccaactcccggtggcagggactctacccatttcacagaagcgcaaggatggaggaaatgagtgcatcctccgtgctcagcgccggtgtcactgtaggttggggacaggagggaagtgcccgcatccccttcccgctccgccagcctggccgtcacccatagaagtggggctgctgagtgaagggcgctaggacccggtggcgcggtgtcggcagggactgggcgcttggggcgcaggagggagccgcggcgtcccgtcgcagcgtgcgggagcaggtgggggtgcagcgcggtggcgcgcgggagccccgaggggcggaggcggctgctacacctagggcgtcgcggagcgccccgggcttggcgcgggcggagccgccctaagggccgcgcgtgtccccggcctcggccccgccccgtcccgtccaatgagagcccgcggccgaaggggctgtccgcacactaggcccgcagctcccttcagcgccgcagaccccctgacaccgcacccggtcctcaggcagcgcgccccagaccccgggttcggcacgccgtcgtcggcttccggacatcgcaacttgcgcccctctcggggatcctcctcccgggctctggaccccaggtgatcctaggtccccagccgccggcgaacaccatggccccccaggggggtgaggtaggagcagcctgagtacccccagaaggtgccccgtccacgcccctccgggctgcgcggcgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtaagtgtggctctcaggctgggcgggtgaggcgcttggtaggagaggccggaggcgcctggagggactggctgctcacgggaccaggctgttgcttcgacgggttggagacgattcgggcaggactgtcactgaaatctgaagtcgcggggtggcgggagggtgaggcgccgcgtcttacacgactggtgagaaaggcgctgggcattcggagcaaggatgcccggtggtcgcggctccttaggcctccacgtgctgtaccccctctatttcagctcaagccccttagggcagaagctaccttccgagtttccctcagggtgagttcaaggaacgaataaccttccagggcccgcaatagcttcgccagggccccaatcgcctaaggtcgccctctgagaggtggagaaaggggcagctcgctagtctagcccacccataccacaggaaggctttggtgaggcagcagcacccagccgaggcttagaaatggaatcgaggcaaaatttaccccattaactcccacaattaaaacaaacaaaacgcatgggtttgcattatctaggcatttgtcttcagccaccgttttgaggatgtcacttaggaaactttgcctccctcccttcttcctattctttcccatctcccatttctcccctccaagagccagagggctgcggagtcccaagatactaagagaccccctccccagatttcttgcaggccctagactccagacacttcacaagagggcagatgaggcaaaaaggcattacagatccactggatgtctcgtgtctgttctttttagaatcctccctgccccctactccttggatggcactcatcaccttcccgtaggagaaggagctgctttcccttcttccccaccatggggagagggcaaagcagggagagttgaacctagaaaagactcagtctttcctcttcaccccacaatcaaactggcctcttggactaggctattgcccctctccaccaggcagtgcctcccgtcctttccttactccgttcttcttcccgtgcaagcccccctccccgaaatgtggtctcttctctccttgcaccctgtggcttttctcctcttgacttggaatcttggctgaagggtgaggggtagctggccgaggggcccgccagcttgggctgcagattcctatcatttcaagatgccgtctctccttatcccaacccccaccccctgttttcctgtttcagaaaaatctcttttgaattttttttttttaaatctctgcagtgttggggaaggcaaggagggggggttctggttgggggaacagagaggcctatatcttacatctggcttgaaacattcttttagaaagggaaaggggagaagggggatgaggagaaaaacctttcaaagttctgagtgagatcaaagctaccttttgccttcatgagcttggtctggctggggacttggcatcttcagggtctttgttgagacaacatgaagtaaccgctgcccatctttatctggctcagacagcagtttgctttttgggactcttgattgcttcttaccagtttgggatatagtcttggggaccaattggtgtttgggtgaggaagtgtcactctggtaatttcagcatcctggcagtggttcctaaagacccaaatgggggtcttcctagttcccattttgtactcttgactactccctctcccttttcctttctccctctactaccctcccctgatgtggttcatattaaagattctggaaaaattcctgggtgaaagagctagggagggagggagggagggaggtgacacagagtgacttagcagcccctgtgaaaaggaggaaggctgcaacagggccaggttgggaagtgggtacagaggttgtttcagcctccttgctccacacctgtcatagctacaggcccagatgcctgcctcagtgatcaccacttgtgggataaggtgaaaagctaccttctaagggcaggctaagcccccaagcctttctcttaggaaaaaaccagcaagattgatgttctgtacaacccgtggaagagaaatgcctgttgactctggtgtgtccatgttccactctggagcagaaggccatcattttcaccagttaatatttggatttttctcatagcttgagattcttccccttactctctaaccactgccctccctctatctatcctaaacagaccaagaaatagggagcttccggcatgtgctttcctgtttcattttgcattctgtagggggttggatgtagggaatcacaagaacaggattgtattcataggctcacaaagggagagaaacacaaagtggtatcatattgttagcactacttttaccaacagcagttgcttttaataagcccttactgagcttcaggcactatggccaaacaccttatgagcatgatctttgtcaatctgaaataatccagtgagatgggttctattatcatccttatttcacaaatgaaagtgagggatgctgtggcattaagagcagattcatggaggctaatagtgttatctctgtgttcaaagttctatatgtgctgggctgaatcatgtacactaggggctgtacacgaaaggaggaaagaaaaaaaaaaagcagatccctggcccgtttgtgtctttaacatacaaacataaaacatctgcagataggctggcaactgttgacaagtaaagctgtaatggaaatgggagttaatggctggctagagggagaagggagttggggataaatcagaacagttaggtgtttattcaacaaatagtgattgcatacctactatgtgccaggcactgttctcagtactggggatattgaattgaacaaaaccgacaaaaatccctgcctttgtggagtggtgcatccaaaccatgtgaggatcatggtgaaatgcagattctgttacggtaggccttgggtggggcctgaatgtctgcatttctaacgaatccccacatgatacagatactgctgttctggggaccacactttgagtagcaaggggctagagtagtgtatgcctcactttgtcaaatgaagggatgtgaattggccaaaagcaggtgaagagaagcattctggggcaggaagctgggaaggaagtgaagaacttccagaagggaaaaacaaagctagagtcagggcatctaacactctaccagaccgtgaggtgggagatgccttaaatatctttgtgtccctgacatctgagctcagtgcttggcacatggtagacattttgcaggcatgtgttgaactgagaggaagatgtggttagcctcaggctcagctttattggaggctccctacactaactacaaggggctgactactggagagcaagcaagcgccatgctctgtggagtcttgaagccattacttagtggagtaagggtggtaatagagacatttaattatcttcccatcttagatactgaacagatgttcccacactcagtgaggatgtaataaaaaggacctatgtgggctgcagcagaatggatttaagtcagaccacaagaaggacttgttgcccgagtttggcctgccccactccagactgtctcacgagggctgggttattggtctctcattcccatccaaccctcctcacccaagccccattaaaaaaaaacaaaaaaacacacccattgcctagagcagtacttgggctgaactagggaagctgaacggtggtgagacagggacaagctccaactccaacggtcttgattctccaaacaaagcaccacagcagtgggtgtaactctgggctgtgcgtcaggcagcctttccggcctggccctgtctggggtgtttattttgtttgttcctggaagctgttgccctgatggacagtgctggggatgctgattccatgggatttgttaggggagggccagccctctcaccccttccccgggacagatgggccccatcagccctgctgagttcccgaagaggcaagcatcagccctccttgtgtttgtttgagttggtgtcaccagtggtgatccagtctgtgggtgagggccggctgtgggaatgcaggggggtggtggggggggacacagagcccagggcagtctagcttttcccctccccacaccagctgccctcccttctcctcacccacttctaggcccattttggggccgttcccaaaccacaggctcattcatagctcaaaccaagtcttttctgtctgcagtaacaattgctctccatggccccacctgttcaaaacaggggagggagggcagccctttgatgcgttctggacaggagaataaaaagttcccagcaaatcaaggaaggtgctatggggttaaagggagagaaagagaatgacaagtggagctgggctgttgagctggaggaagtgggtgaatgggtcagatctcatttggtggcctcttggggaagaagggtgatatactcctgttttctctctgaaatattcttcctgaggcttgtggtgggatccagggttaaaactgagtgaagagaaaatattgccttgagaaacaataatgactctggcaacccacctattctttagtagcccatctcaattgaccttcttttaattgttcatattggacagactggagactgcagtgtggggagagtcatcctcttacttatcttggcctttggcttcccactgcagacagcccttgcaggtccatccaggttggggaagatggttttaaaaggttcattagttaagaaaggccctggggcctggaaataaagggtttgaggaggagagtagagggtggggtcttcctccccggacctcacgattgggaatgaggattttttttagctacacgggtctgactagagctgtaaacgttactcagattgctcactatgtctcttcccacgagcccctccctgtcaccacccccctgctgtcaaaccatatcttcgtggaccagccatgcgggacatccctcttaatgggagcataagagtgttgtctcagacccttattttgttagtttatgtttccatgaagctcttaatgtttattaaataaacagacaatgagtttgtgtgacatgcccacagcttctgtgtatgtgacacatgcctagcctgtgttctgggagtgtatgtcactttggcctttggctggggaactggtgatggtgggaggccactcaattactctctctgcaactgtataactattaatacttcttcagaactgtgggaaatggttctactcatcagctttatggaatgtgggttagggagaggggacagaatctcttcaaggtctggatgctaaacgtaccccttccttattccctcccaatgcagaaaaaggtctgggatgttctgacagggccatctctgccttgcaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtaagagcctcttccatcctgtgtcagctccttccctttctgtgctgggggtggtgagtgggaagagtaggcaagatctcccctctcctctcccacacactgtttcatcatcagagaaagaactgtgggcagagcccaggatataattgggaacagactcttagcatcttagatttgtagacaggggctcctctaaatcttagtgctctgggacaagaccaaggtaaagcattccctagaacctccatctttctccctcattttccttgtcctccccaatccccagcttgggaggctaccatgtactgtaaggctgaggtctatgataggccctctgttcttaacaccaccatcactatcgtcaccccaacactcccaacactacagtaatgggaacaaaagataaacagaaaggtgatatgtaaatatttggagagtcagtggcttggcctcagctcagcaaaaaagctaaatagagctagacagtaaactaggagaaagggaacaagatgggaatctggaggtgtcaggcatacaggggcgataattcatcagtctccaagagcagggagggagagcaagcaggcaagggagggtagcatggatctctaaacaggctgacccctgggctggggtctccattgtgggggaactgtccagcagagtgggcctgaaaaggcctggaatgtggactaaggcaggcttagctgagccagtgctggcactcagtgggaggggatgattcaccaggagacttttcaatggatggacacagggaatttggcaggaaacaagagtataggtcagctcaaaaggtcagatatacaaagaagtggatagagagtagtgagggctgaggggaagaggtcagatactctggggaatgctcttggaaatgaaaggcaccttgaataaagggggtgtaggggtgactctgggaaagaaaattagggaagaggtttcagagtcagaggttgtatgggctgaagaaggggacagacatgggcctctttcctgaagcacacctctacaattctctctctaggtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggtcagtactcatgtctgtgtaagtacactcatatttgctgggggtgaccagtgtgtgtgaccatggactaaataaatgtgaagatggaagagctgaaggcttctgggtcacttccaaaagccccaacatcctgggacaggagaactaaatgcaagggagcttaggaatgcctagggtcaatcaggtgcgtgaagagtcttcacataggtggaaagtaggaaaaggtggagaaaagaagtaactttttaagaaggaaaagaactgccttcataaagactgagaggataagaggttgttctagtcagttccctggtatttgaacatcttctatgtgcctagtactatgctggaaaatggcacaccactaaagtagaaggcatggtacctggcactctaaaacgtgaaaagtagaggatgtgcaagcacactgtcatcgtgaacagaatcctgtggctctacagttcagtgggctgtcatgaaaaggaaagcactgttggttcaggcagatttcctggaaaaagagtttcttgaacttgatcaggaagaatgggtgggatctgatgtgggagagaaccgagagctcaatcggccagccagggccaggtccagcctatctcagagcactcatccttttggacctagggatgactaaaatgtgtcctgaccagctacttctcccttaactgccttccccctcccccaggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggtgagtaaggaaggcaggcagggacatgcagtcccagttcttagtgcaggcacccctggttaatcatggtctgttcagtctcaggagttagggaagggggtgctgtgggaggaggcagtttcctctccacatgaacacctggtcatgagattgttgcagtccaccaggcccagtgctgcccaagtagagaggaggtcactcagctccttgaggcctgaggtcatgcatcgctcctttgtatcccagcatctgggatacagtaggcattattcagggtatgtttaacttagttacctgttttcagttttaagcaatgtgtgggctgcacagaaacataagatgcagccctaagcctttggctcttcgcaatctacttaaagaaatgagacataatgggtagacaaatgcaaagagagatggagaaatcaataaagtttatttgaaaatgtagggaaaaaaaagaaactagaatttaagctgctccttgaagtgtagggagtatctggatagcttgagagacgagtgggcaatttcttatcagagagtagtaggtgggaaagcacatgatctgtcccagggacagagaacagaccaatctgctgggtaaaggttctctctaagggagattaaagctagaaagatgtccttgaaaggctttatccagtgtgctgccattgaagattctgaaacagctgaaaaagaaacgaagaagagatccctaccaaaggcaggtaaagcagcaaatggttgtttttcagtctgttcgaggtatttgtggtgggattcttggaggtgctggaagttgatatggtttttccccaagggaatgaaagttaccatcctggctcacatttctggttcagataggttaaactaggaacatgcaatgcagcagaactcttctcctctggttattgctgtggggctcccaggctcttttctacaggctcagcgtcaggacttgggtgaagtggagccaaaaaacctcagctatcttcggtactgtttgttttcacccatcactgtcattcctggaagagtcaagtggcttggagtaaaactgggcacagaaaaagggtggggctctacccaattaatgaagaaagtagtctgtatactttgtagggtgctagaagaaaaaaacttggagcccttctgattttcctagtgatttcctgccactaagtatactttcctcccacttggtctaattcagagggtcactctctggatacctagaaataattccataacatctgaggtgtaaacctatactaccatactgaaaatacacctttagggaaggaactttggagttaggagggaggataagtcaaatgtgtgttcgtttttctcagaggcataaaattaggcctcctaaaacccaaagtgggccctggaattcaaagaatataagtcatcccagaaagaatatggagccaggaattccctccaaagcaatagagtccaattgaactttctgtgatgatagaaatgttttcctatctctgttgtccaatacagtagcaactagccacatgtgattactgagtacttggaatataactagtgtgactgaggagctaaattttttagtttaattttcattaatttagatgtaaaagaccatatgtgactagtggctgctaccctggacagcacagctccacagtgtagaaggggtttttggtgcccaagaggacttaagacccagcccttggagttaggagactaacatatacagtagacctagtcagtccacattccagaccagtggtctcctaacattctggatcctttactcctatcattaaaacaatttgagcatatatctccattatatgtatatttatttatacctgtgttccactatatgaatatgtatattataaaacgtaaatattttaaattgatgagataaaaaacatagaagttctagcattttcctcccgtatcccagtgacatttggagactaattctgtagaaatcagttaatctattctccgttttgaacctaggctagtcagtttcccatctctggattcttattaaccatggaaaagcttggagtagatgctctcatgggcccaactcatccaaaagtctattgattttatgatctgttggcaggatctcttttgctaaaatcagtcagaatgaggttctaagcattccctatgcatggggaaaacatgatccctatcctagagtttccactgtaaggggaagggataatgcttagggataatagcaataataataatgcaagggatattacttaggaattccttaggaatatgcctccagccagtcatggtaatcagttcacctcttcagatgaacagagattatatctaacaatctattattgtgcttattttcatatgagaaactaagttaatgtttcattttgactaaatcacacaactaagagtggtagaactgggatttgaatccagacaagatgatgtcagagcccatgcttcttcttttttttttttttttttttttttggagacagagtttcactgtcacccaggctagagtgcagtggtgcaatcttggctcactgcagcctcgacctcccagcctcgtgttactttcacctcagcctcctgagtatctaggactacaggctcatgcccatggcacctggctaattttttaagtttttgtagagacagggcttgctatgtttcccaggctggtcttgaattcctggactcaaggattccttctgccttggccttccaaaatgctgggatgataggcatgagtgagccactgtgcccagcccaaaaaagcgattctttttatcttccttctgagaatgtggttaagggtatccagggcagctgaagagataactttgttctcactccctctcttccccaacccaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgagcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgtagtaagtctggctaggccttgtgttgcctttttttttttttttttcttttcttttcttctcttcccatgcactattctggaggtttgccaggtttggggagacatggagtaaaagaaagataggcaactcatggatggtgggagagcaggtaagcaggtctgatctcaagggcccacatgaggcatcagtatatattaggcaggtagggatctctggctttggtaattctttatgagaggatcctagcctttgaagctgggagcaggagtcagtggctacagtgggaaggagtactgcaggttggggccaaagtgatacacagcttagaaggcagccttcctccacttactcaacaaatctttatttagtgactctccaagtcctagtgattattattattgttcactccacatttggcttaatgggtaatgctattacccattgcctaactaggtttgcagtagtggaatctccagagatagcaggcttagtaagctggaggtaggacatgaagtcccccaaaacttgatgtcctatttttatgtgagttggacagtggttatcttttgcctgttgatatcttaaagcagcagagtggtatagaaatttgcggttatgacagacccgggttaaaaatcacagctgtgccatttgctttgatattttgagcaaggtagctaaattttctgagcttctattttctcatctgtaaaatgaggatacgtacctgttcttttttttctttctttttatttcttttagagatagggtctcgctttgttgcccaggctggagtgcactggcatgatcatggctcactgcagcctcaaattcccaggctcaagcaatcctcccacctcagcctccccattagctgggactacagggccatgccatcatgcccagctaatttaaacatagttttcagagatggagctcactatgttgcccaggctggtcttgaattcttggtctcaagcaatcctcccactgcagccttccaaagtgctgggcgtacaagcgcaagccactgtgcccagctgtcagacgctgagttttaattatgcaccaaactccagcccgcagatcctcttcaccaaagcccctggctggtctagcccatcatgacttctctaggaacagtccttctttaggactataaagtattaacaaaagtctgtagattaaggagcctgcataaagaattctggatacaggcccctgtctttccaaagttcctctccaatatcccttggggtcctcatgtttttgaagcagcttcactctgcacaggcagcaggaggttgggggagccatagctctgggccacgggggcagatttatttggatgataggactaatatttgtgtaacctgctgagacctgtgtgggagagtttagggtggtttttcttttggtgaggggatttgctctggtttcacatccattaacacaaaacatgagctagtcagggcccttgtggtctgcggtaaggggatgcctgtggagaaatgggcctgagtgagtcaggccaagagaatgtcttccttcagaatggagtcaactggataactgatgagccaatggtgggattaaggagggggaaatgggaggggaagagaacagctgacatcttgaggaaagctttggggtagtggagaggtaagggggtcatggtcagtctgaactcaacaatagggctgaatgaatttaccaaaggaagctgccttatattatatgccaggctgctggggaaagcctcaggtcctggccagcccctgttctcacaagaacatgcaggttaccacataaataatggcatatgccttccataggacgtcaacctgacttaaatctacctataccctactctctattctttggtttttggttctcatccctgtggaaggaaatgggcctcttctggcatctcatgctactctgtgcttttccttgggctccaaattctagctcataaagatgcaagttttgcaatttc

SEQ ID NO: 16511 - DNA, 16047 bp, Human; identical to SEQ ID NO: 16510

SEQ ID NO: 16512 - DNA, 57218 bp, Human
tcttggatctgagcttgctctggctgagttttaaagttgttgttttttcttgtttgtttatttttaattaaaattttttttgggcggggggcaatttcttaggaattctgccgctaccccaaagttgagcccatttccccccacccccggcatgtcggttctggcatacttagcactgccttcctagccgcaactcaggggagcaatgaatctgcgcgtacgacatggtaactttttaactcctgcccgcgacggtggagtgcttaatctaaggtttttaaataaaaagggctcaggggttggttttattataacgtttatttcatttcagatttcatgcgtaatttagcaaacgctagacagactcgggcgataaacactttcttttgtggggggggaaaggcattttcatacaccacgcttaattttatttagatttaatagcgatatcaggggcacttcaaagaaagttcttttttcgcccttctcctaagaatgcgaatctgctagcaaaatcgcctcgtgctattttatggcaaggaaaattaaaggccttctcccccctccttccctacacacactttagggaggaacacacacacacacacacacgcatgcacaaacacacgcacgcaggcgcgagcacacgcacacaggcgcacagaataaacacctctatcctccatcacctctaacttccaacttctaattgcaagatagatttcagcctctgtggggatcaggacgatctaaacattttaactaagattattgggataaatatttcataaagagcagggcagatattaaattactcctattgattttagtatcacagcccaattccattcctcggcctcttcagtttaattgatctcttaaggaggccaacttcgcacccgcagagggtctgggtcttggaccgggtggcccagggcaaggtgtgcggcccggcgggtgcgccctcttcgtgcgtgtcttctcggggttcccagccgcctcgcaagtcgctccggttactgggctcaaccgatgtgctcccccataaagtggctgagtgactgtgactccttggagcccacgccggccggtgagaaccgggaaccccaggcagtggggaaggggaacaattgtgaacgccctagtgacggaggagtgagcaagcgcccaggtctctcgaggagaaccctaacttcgaggttccccgtctgctttaccctccaagaaaatcccagggccggctaacttgggcgccgctagcggagaacggagtgttcaccccggagccgaagtgcagtagacacttagcgactttccgtggcgagtctagggtctttgcctggcgacctcattgtctgagcgccccgtaccgctcaccgcccacctccccgccccctgcccacccggtgggtctcgctccagttgggggtggggagttgggaacagtgtgaatgggaagggggtgaacaaagccaagctcccgccattctcctccgcctgcaccctctccagctcgatgcgcccggaggccggggcgcgcccccagcgcactgacgccggaccccgaggagaggcgggcgcaggggaccccagagctggggtagtgcgggttcgtggcgggggcttcggcagccaggaccccggaccaccttaagagcgagccccgccccgagcccggaacttgggcggcgctgattggtgcaaatgtaatggctgaaattgattgctgaaatgcaaaacttgttgctgcttctcccggcgctgggcgagaggcagacacagagaggggagccgagaccctcggaacgccccacgcagagcccccccgctagtcgggagaggggtgcgcagaccccccagagctgcccccgcgcccccctccccccattccgggctctgagagcgcagcgggaacgccttagcctgctcgcccggcgtggccccccgacccgcgtacgcccccctccctcaggtccgagagggactcgcgaagcacctcagcgcggaggcagggaaccggagccttggagcgacccaacccctcgtctcgctgccctcccgcgcctgcaacggtgcgcggagactccggcgaactcagacacccaacggcggagaacagaagcggcaggcggcggacgtggccgcgaagctgcgcgccgaacgcagcgcacccgctgccgagcagaggagccgcgcctttccccgaccctcggctccagcccccggcgcctgccgcctcgcagcccctctgcgtcctcggctcgggggccggcaccggcgatgccgagcggagcctccagtcctccgacccgctgaagaagcagcagccgctcgcccggagcctacggggattgtgcgagcggatcgtgctcggtggaggctcgggctgcggggcgcggggactccggggggcggggggagggaccgctctgtcggtgcccggcgccagccgcggctttgaagggtctccctcccctgcccttagcagctctgccacggactccgggaggctgcgggcggcgtcctgagggctccccagcagacccaatcggacttgagaaggtgatcgctctgctctcccaacccccttccctccccattccccccacttaactttttgtctccgttcatccgcggcttcgtcccctccccgcagacccacccgcggctgtgacaaccgcccggggcatgggccccccaacacggctcctagaggccccgcggcctcgcaagatgtgagaggccctccccgggcagaatcggagcttcaggagaggagctaataccccgccccccgtccctcacatcaggcggggtggaggtgcgcgctgagcccccgcggtgctgagcgtcccggagcgcccaatcctgggctggaacgagtagctggccggaggcgcgccgcggagagccggctgtcatgccctattgatccccctctgccccccgccaagtatgtttgggctggaccaattcgagccccaggtcaacagcaggaacgctggccagggcgagaggaactttaacgagaccggactgagcatgaacacccactttaaggccccggctttccacactggggggccccctggccctgtggatcctgctatgagcgcgctgggcgaacccccgatcttgggcatgaacatggagccctacggcttccacgcgcgcggccactcggagttgcacgcaggggggctgcaagcgcagcctgtgcacggcttctttggcggccagcagcctcaccacggccacccgggaagtcatcatccccaccagcatcacccccactttgggggcaacttcggtggcccggaccccggggcctcgtgcctgcacgggggtcgcctgctcggctacggcggcgcagccggaggcctgggcagccagccgcccttcgccgagggctatgagcacatggcggagagccaggggcctgagagcttcggcccgcagcgaccggggaacctcccggacttccacagttcaggtgcctccagccacgccgtgccggccccatgcctgccgctggaccagagccctaaccgagccgcctccttccacggcctgccgtcctccagcggctccgattcccacagtctggagccacggagggtgacgaaccaaggagccgtcgactcgctggaatacaattacccgggcgaggcgccctcgggacattttgacatgttttcgccctctgactccgaagggcagctgcctcattatgcagcgggtcgccaggttcctgggggcgctttcccgggcgcctcggccatgcccagagctgcgggcatggtgggcttgtccaaaatgcacgcccagccaccgcagcagcagccccagcagcagcagcagccccagcagcagcagcagcagcatggtgtgttctttgagaggttcagtggggccagaaagatgcctgtgggtctggagccctcagtgggctccaggcacccgttaatgcagcctccccagcaggccccgccaccccctcagcagcagcccccgcagcagccgccacagcagcagccgccgccgccacccgggcttctagtccgacaaaattcgtgcccgcctgcgctccctcggccccagcagggcgaggcgggcacgcccagcggcggcctgcaggacggaggccccatgctgcccagccagcacgcgcaattcgagtatcccatccaccggctggagaaccggagcatgcacccttattccgagcctgttttcagcatgcagcatcctcctccgcagcaggcgcccaaccagcggctgcagcatttcgacgcgcccccctacatgaacgtggccaagaggccgcgcttcgactttccgggcagcgcgggagtggaccgctgcgcttcgtggaacggcagcatgcacaacggcgctctggataatcacctctccccttccgcctacccaggcctacccggcgagttcacaccgcctgtgcccgacagcttcccttcggggccgcccctgcagcatccggccccggaccaccagtccctgcaacagcagcagcagcagcagcagcagcagcaacagcagcagcagcagcagcaacagcaacagcaacagcagcagcagcagcagcgccaaaacgcggccctcatgattaagcagatggcgtcgcggaatcagcagcagcggctgcgccagcccaacctggctcagctaggccaccccggggacgtgggccagggcggcctggtgcatggcggcccggtgggcggcttggcccagccgaactttgagcgcgaaggcggcagcacgggcgccgggcgtctgggcaccttcgagcagcaggcgccgcacttggcgcaagagagcgcgtggttctcaggtccgcatccgccgcccggagacctgctgccccgtaggatgggcggctcgggtctgcccgctgactgtggcccgcacgaccccagcctggcgccccctcctccgcctggtggctcgggggtgctgttccggggccctctgcaggagccgatgaggatgcccggagagggccacgtgcccgcgctgccttcaccgggcctgcagttcgggggcagtctgggaggcctgggtcagctgcagtcgcccggggcgggcgtggggctccccagcgctgcttcggagcgccggcccccgccgccggactttgctacgtctgcgctcgggggccagccgggctttccgtttggtgcagccggccggcagtccacgccgcacagcggtccaggcgtgaactcgccccccagcgcgggagggggcggtggcagctctggtggcggcggtggcgggggtgcctacccgccgcagcctgatttccagcccagccagcgcacctcggccagtaaattgggcgcgctctcgctgggctccttcaacaagcccagctccaaggacaacctgttcggccagagctgcctggctgcgctctccaccgcttgccagaacatgatcgccagcctcggggcccccaacctcaacgtgaccttcaacaagaagaacccgccagagggcaagaggaaactgagccagaacgagaccgacggcgcggcagtggccggcaacccgggctcggattacttcccaggagggactgctcctggggccccaggacccggaggcccgtccgggaccagtagcagcggctccaaagcctcggggccgcccaaccctccagcccagggggacggcaccagcctctcccccaactacaccctggaatccacgtcggggaatgacggcaagccggtctccgggggcggcggccggggacggggtcgcagaaaaagggacagtggtcacgtgagccctggcaccttctttgacaagtactcggcggctccggacagcgggggcgcacctggggtgagcccagggcagcagcaagcgtcaggcgcagccgtcgggggaagctccgcaggcgagacgcgcggggcaccgacgccccacgaaaaggcgctcacgtcgccatcctgggggaagggggctgagttgctcctgggggatcagccggacctcattgggtccctggacggcggggccaagtcggacagtagttcgccaaacgtgggtgagttcgcctcggacgaggtgagcacgagctacgccaatgaggacgaggtgtcgtccagctctgacaacccccaggcactagttaaagcgagcaggagtcccctggtgaccggctcgcccaaactccctccccgtggggtaggcgccggggaacacggaccgaaggcgcccccgcccgccctcggcctgggcatcatgtctaactctacctcgacccctgacagctacggcggcggtgggggcccgggccatccgggcactccgggcctggagcaggtccgcaccccgacgagcagcagcggcgccccgccacccgacgagatccaccccctggagatccttcaggcgcagatccagctacagaggcagcagttcagcatctccgaggaccagcctctggggctgaagggtggcaagaagggtgagtgcgccgtcggggcctcaggggcgcagaatggcgacagcgagctgggcagctgctgctccgaggcggtcaagagcgccatgagcaccattgacctggactcgctgatggcagagcacagcgctgcctggtacatgcccgctgacaaggccctggtggacagcgcggacgacgacaagacgttggcgccctgggagaaggccaaaccccagaaccccaacagcaaagaaggtatatgcacactcgttttcctctcacttcccgggtgacccgccccatccccagggcaggacttagccttcgccttttggggtcctttgaggtttggagggcacaaaccctcctaatccccaactaggagctggttatcccacctttgcttacaccaagggctgtgaggacagacccccccacacacactgcccccaagccccccacatgttaccaggtagattctagtgccacagggtggcaaaaacttagatggcagccctttgggaatcttgtagagtaccccgcccagccgcccccacacccccagttttagctgaattgccccttccctttcacactaagacccctccccaccctcaacattgaggctggctccactttttagcagctgtgtgccgccttccctggcaggacacctgggaagttgtgttaacgcctcccaccttttcctagttagtcagcctctagcgctagttcttttaggtgccagcatttttaggaaaaaaaagttaccagccctggtgtcggcagcatcactcagaggcaacgcctaatttgacatttgttcctaatgaatagctattttgtctcttcttaactatcagagtttcattgaaaaacgggagacctgtgggggttgcaggaggcagggaaccttttcagggcgcatccccttgacatttggtggggttggggagggggagtgctggggtggggtcggcttggacatcatttgtgtatggggatatggatatatactcttaagacacaaaggatccgtgtttgtcaatatctcgcttggctttggtgacagatgtcctgtcccagctttcgtttgcattctaagcaccccctccccaccaggcctggaggcctttaaggtgggaggggtggggttagtaaatgggctgccattccagttaaagtaataacagttctttttaacctaaggatgactgggttgccgtagatatttattttatctgaatggaggtttaaaatgtctgtatataaagtgcgtgtgtgtgtgtgtgtgtatatatataggtgtatatataggtatgtgtgtctatatatgtatctatatatatctaatggcttcttaaaatcaggtaacatcatttctttctttctatgtctttcttttaaactatagttgaattcccttggtttccctagacagactatcaccatggaaccagtggctggcattttaaccttgtttttgaaaatgtgtccccccccagtgcaattcttgccctcttttacagttctttcctcctctgccttcgtttccctcatcctccccacatcctgccatgtcttgaccctggatttaaggtgagggtaggttttaggagaatggcatgggggctgggggaggcaagaggagaggaagcgagagtgggctgggagttgggtggttcagaacttggggctttcaaggcgcgcatcccgggtagctttcccgcttaggttttctaattcatgaatgcggcctctctgctttttctctttgttccgcggttactgcccagcccaggacgcccgggacgcactctctcatttgaagccgggtgtttagcatgcacagcagacgctgcggccagcatcagcattctccaggcttctcccaggcaaggccataaattggttagtttgggaccctcagcttcttctcccttttttccccccctttttaaaatcgagttggacacagcctcctgcttgctccccccacccctttattttcttgtacacgacatctcgatctggcccgatcgatagctggttagcacaaatctcagcccctgtcacttctacctggcctggcctggcctagccgcccctcccccttccccttctcatcctcccctcccactcctagtaattaagaacatattggccaaaatgaggtgagaaaagttaaaaaaaaaacaaaaaaaaccctgatttaaagaatccatttaagaaaaacagtagcacttcatcttcaagtcttttaaagggccttcatagactaggtggacaggtatagggtcattttaatgagatttttagaagttgtctctccccatcccctttccagtccttcctttagagatgaagatgcaggctgtgaatgaagaaatgtcaccaaagaaatgttttgtttgtgtcatcatcacagtcagatgaatgaaaatattttttagaaacagatgctagtcactttagggttgatttctcctgtaagctaaaggaagccctcccctgcatgcggggcgacagggacttccatcagggaccagcagggctggctgtcttataagcaccagcagggacacccacttgacctcctttgttttctactctgtggtgtgggaaggacagtttcctcgataaagcagcgaattgaggtcactcgaagcttctgtagccttggggttgctagttaaggctttataaggtatctgcatctgaatcctgctcccttactggtagtaaataaggatgattaaacttttcattatgataacaccctgtagttccatctgcacacgttgtataaataggtacacagagctttctacaggcccctgagtcccctcactgaaaatcagagtgaagtgtgccacttcgaaatagagacagaaaaaaaaatcatagcaaaatgttctgcttttcctttaaaaacatgctcatggtcccattagccttgagcagtggtgtccaatggctttgaatggaccttctctaggtaccagccccagcatttttttttctactccccttgcaggcaaagcccatttttgtaatgatattttattttgtcacgccgtaaaacatgccagtactaatgtgattaaatattaacaccgtttctgaaattcttcgctccaatgacaaaatactagtcggtatttaacaaaatgatccgtgctcggattggagggaacgaataagtcttcagaactgtacaaggcgtgcagccactgggacgtgcccagattgtcttatgggcttgagatgtcctttggaggggagggaacttgactggcaagttgtcgttctcgcaaagtctaggccaacatcacatgggatgatgatttttttaaaccaggaaatctagctagtctctccaaatcatgcttctcttgacttcttaatcaacccacccaacaacttttatataatgcaactttacctctgagcatgaggctctatttgtacaaagttgtggtgggggaagggtgagattgtggaaaggaaaaaaacaaaaaacaaaaaacaaaacccagcctgagtttgggcctattcaaacatcaattaaattggtgagaattatatggatttaaaaagagtttgcaaaatcatccgcctatctttgtaacacactatagaaatgatccctgaaagtatagtcttcatccacctatctttgtaataggtgtgtggctacggaagaatttcaacacagagaggagagataatgatagattatagataatgcatattaagttggaaaaagtacgttttctcccctcctgccccttacaattttcaaaagttgaattaaccgtattctgtaatacgtttatctttgccaaacctcctttcccctggtagctctatcttgaaacccagggcagtcttgaagtactctttcacatacattgaaatgggagcagtctcggtacacactctgcaagcaatcctgccctttttggaagtatgatatttttacagtgatgccagagaaatttttggaatttcatgcttctctcagtgttgcagtcagaacacagtaacagcactgagcaatcctaggcaggcaagatttgaacatggaatttctttagacatagggcagacttggggcgggggggcaggtaggtcctagcctcagagcaaagcactgttttcctgagagaatttttaaggctcatttgaacttgtttgggggaaggcaaagagctttgcaatcctgtttccctgtgaaattacccagcacgagttgtatgccttcatgtgacttttgcgcctccggaagatgtaacccaaaacttcgcaggtgttaataagggataatgtaaacagatagggccccctttgtgcagctgacgtttgggcctccctgctccctggatatcccaggacatcaaactactgttctttggtgcttgtttaatatttcatggctgtaataaacctgtctactttgcccgcctcctgacataaaaccccaacctaacacacatctgcaatcatacatttctactaaatattaataaaggacaaggatgttttaaggggctgaaagctggcagtgttgaacttgtcatggttttctaccactgggttttctggctgttttgattttaaatagccattgctttctaatatgcaaaatatatttatatattcatatatatatatatatatatatatatatatatatgcaatttttatagattgaagggctttcctcaagtatagctttctttaatataaattcatttagatttcttgtgaggccccttcagaccggaaataaggaactattgaaatgtacttctagtttattgaggtttctaggaaaggagtgagagttagttaatctaatttctctttctagcaaggaaattctatgattcctgatatgattttgtttgcctgacagaggtatttaaatttccacaaagaatcttaataggttttgaaaatgcggctactcttgccaagaagttacttgataccctgtgctgatataaaatatacatttttaataaatagtccggcaggaccaggtgaaattagaggaggaaaattcttcccactgtggaagggccaacttgagtgggtcactgggatttcacaggatctcctaaactcactttatgctggaaaatgtagcagaatcacttgtgacccgtttctctccacctgaatgacaatgacgtcggattgtgttctttgcccagggagtgatcagctttgccgaaagcatttaggagagataaacactcttggtaaggaatactgtatttacctctgtttggttatttttagagattaaaaggctgtagctttatataataggatcaaatgtctggggagtgtgtgggagcaagcaggcctcccaagcacaccgcaacataaaaacaccaaatcctctcatgccagagcggtcctctgtttgtcggagggggtggggggctgcaaccagtggtttcaccttctgtccttttctcactacccgctgcttgttccacccagttctctggtctggaggggccaggatcgcccaacctcatcattttgactcaagtcaggattttgacttgccgacgatgtgtttgttttaggatggtgtctatatttaggcgcgtcttgggtggacagatttgagtgtgggatttgatcgctcttggtggagatgttgatgtatacatgagtgcgtgattgagaagagggacatttggaggaaatttttcaagcctcctcgccttctcacacacactggagccaaatgaagtggtctgggggccagctcgaaagagcacagctgaggtgggtggaagctctgggtctgtatctcaggggagcaaagcagggccccatgcagttcagtgtgtgaagaagcccccctctctccccctcgccccatcccagcatccgcatatatacatatgcatggccgagtgtatttccatccaatctggagtcactcctccagtttacccttaatctgctttctgaaggcgagcggggaaaggagctcacccttcagtctcaatggccttagctgacaggttctgattctgtaaaggactgaatgagcgtgagtcctaaaaatagagggaggattttgaagatcctaattacgaaatctcagcctcccgggcctcctgggctgtgggtgactttgatctggagtatttcagtagcagacgcacgtcgcccctcgctgggttttgtgcgtgagcgtacgtggaggtgtctctctggctgagttcagctaacaccagtttcctgccaggagaggaatctttgaatcagtgccccctccccttctttactccccccccacctacccccaccagttgtgggaagcggacgctgcttctcatttatggaaattcctagcctttattgtaatctttttgtaccaacgacgtggcggagacgacactgggctttcaaattagtcatggtcctgcctgcagggaccctctgtgtcctgatgcagaacagctcagccacagtccccagctcagagccacccagggccccgagaaactgtgaacaggcctcaaaaggagagatggttctgggatcctggcacattgtgcccgatgggtcaccccgcacgaaggtggccctggtcatttcctgccatcttccgatgacaggacagcatgcagcctcacctgggtgatcagccgctttgcagagcgtgggtgagatgataccctgccaagtgtgcgcttcagggggcaaaacctccaaacttattttgtgaccaggattgagaagcagagttaagtttcatttacttgtgtggggagggacttttgaaaggcatcatgttctcgggatgtaattattataggatgctgagacccgctttgtgtgccggccttcattttaatcagcagcctccgaggtttgagcagccagtgaagtatctgctcccaacccggtgtttgcccaaaagggcacagaggggagaaatggccacgggtttctcccagtcttgaaatccaaggggttgaaactgggttcccgatagcttccagtttgggcctgacaagaccatattggactggcaccctaggtacctcctgagtcaggacttgtcctagccacagcatcccaaattgtcattctctctaggctgagaaagctggtgggatttcataatcaccacttccttgagaagccggagcagagagaactttatagtgattgcatgcgtatcttttcacgatttacgcatcatcgtagggacccaaatgccctttaaacataaggcaactgaatctagcagtttggaggtcttagagcatttgtaataacatgctggctctctgtgaatgtcccagaaggaacatcttccatggaatggacttgtccaaaaagggagaaaaaattccccaataaacatccccatataaactcacattgttgagggaaatcacgttttcgtgttctcatcttgaaagctctgagtccagcgaactcaccttgccctacttcccctggagtttataggatcaactatgtgcccagaagcttccatcttattcccatctttgatctctctgtggaaaatcttggactcccccaaaatgtttgctcctaggattttgctccttctgtctatctcggtttcttgggctacagtttgacttacctatgctggtatttggtttgggagatgcaaggtgtgttgggaaatagtttagggaaacagggagaccccttggcggaggcgtatttgggacccattgctatagaagatctttggaaagttggggacttcaaagatacccacaagagaaccaggtcttgtttttatcctgcatgtctcaaaaacaatctgcatagttactcagaagtatatggccatggtcatgtctttggaggaaacgtggactaactttggtgctgaggcacccttgcagctttgtttttcctgctcgctcttcgagcagcctgactcatgagaactaagtggcccgttgatgcattcaattgtgaggatttaaaagtagtttttttcttctcagtgctgagaagaatttaaagagttttgggcatgatggttttgtttgatctcaacacttgggacaaaaatttccctggagtgacaccgtctgggggggtctttctgatgccactcgttttgcgtggtatgactaggagaaatctctctgcgtcaaagttgagggccccagtgtgcctggtctggttttcttggtcctatttgggaactcctggaacgtgagatgacagttaataagtgaacccctccacgcatgcgcacatgcgtacacacgtgcgtgcacacacacacgcgtgcacacacacacacataacttcttgctcatccagtcattcagggaaggatgagatgtcaaaaaaaaaaaaaaagatatgacccttttcagttactgtgaagcagtgttttcagacgcccttggatcttggaacacaagcattgttgagtgattggcagcgaccaccaggagtaaaatacttctgagggaccatcttatgatcagagaaggggtggggaagtcggcagaaaacctagcctgctttgaaatccccaaagctcagtcttccagagaaagcaggggttggttgagaatttgctgagaagttagtgggttcttcctggtccctgtgtgctgtttgaaagcgtccttgcaagttttagggccccgatcctgatgtggacactgtaggtcctcatttccaaataaatcagaaggcagagagagaagcacctccagtgaggaagactagatggaaattggggtgcggcgtattttctcaggataggggcatggcagagggacggatggggcagggagaaatgcgtcaacatgagttgaagtgtcgtttactgactcttggggttcgcgagtggaaaataatttataaatgtggaattcatttataacaacatcacctgggctaggctgagggtgtatgaattacttggcggctggtgtcggccgtcacaaaggacagaaggttcttgcccaagctttccctgtggggctcggggctcccacatcgctgcacatgcatgggggaggtagatccggaggacccagcctgagactggatgaccgcattgtgggtctgttagcagtcaggacccgtttctgttgagttagtggccgaggcaggctcaaggggatgaagacccagatgggccctgggtaggtcaggacccagacgtgcctgtggccaattcctgcagaggagctggtcccttgaggcccagatccttccataaaagagggatgatgggggtgggaaaagggagtgacctttcccctggtgatcctgtaaggtggccactaaggcttccctcctagcaagaccctcagggatgatcttggctttcacagaccttgtaggcaggtcccaatgccttgaaatgcaagtgtgccccatgatgccctcccacacaatatatatatttttcctttctctgaatggtaggcaaaaaggggaccaaagtaagtgacaaatccagcaagaggaagatttccctgacttgagataagccaagtgtggaaaggagctggagaaattaagagtctcttctttcctcccttccaggagaccccaggtccagccttcagaagcccttaatgcttttgcagtgagacctaattgactaaaaacaaattggccattttcatcccctgcaatgtaacttttggcgattgtttagtatttgaaggaagggaggctgcagatcaaaatttggctttttagaacaggagcaatttcacgatccttatgccatgactatttctaaattgtctgggcagaaagctttgaatgccttttgccgggctttgcttgcgtgcacacacgcacgtgcacgtgcacacataccacacaggcctgagaagtcttaataagaaatgaataaataattttctcccccaagaagaagctcatgcaaagttttggcctcgttcagtttgaagtagacgcgtattgatctccatgcggtcaatttttgccgaatttgtaatcctgttaggcctccgggaaaggcatgattaatttacttgtacatttcactattttgggtcagtttagttaataagcatttattttgtgctcagcgcctgtgaagcattttgctgggattagaagtgtgtgtgtgtgtgtgtgtgtgcgcacgggcattaatgggcccggattgcctggcatagaataatggccaccagtagtctaggttcccaccacctcctcaggacaggaagaggaggcgagtggcgcctttcaccatcactcgtccaggaggagggagaaaaagcccagtcgttgagcaaacccagcctcccagaaccttggagacggccaaagaacacgggcttccttctggtgccttggttctccgaccctgagagtttcccagcattaattcttaattgactgggagttgagcactcgtgtgggccagaggtctctgcacatgggtggacagttgggaatcttcaacctctttgcagtaccttttatgctgcttccttgacacatggtggtggtggtggtaggaggatgtgtgtgtgtgtgtgtgtgtgtgtttaacttttaagaaatgcatcgtttgacttccaaagaaggaagaaaaagtatgcataagtctcggaagctgagaaaaggaataacaaagcaaaacagccctcagctttggcctttcctaacactgagtctgtaaaggggagcatgtgtcattttgatggtgcgagcacttcagcctggcttctttggggggcccccctcttcctctctgggctccccacagccttcctgtctctctgccttcagaagatgggctaaaattccactcaaaaaacaaccatcaaaatgccagggttcggccataacagtttttgagaaatggtgttttcggcaccccccaccatttgcttaattcctcgctcatctcgtcggttcccaccaaggccttgcctttgcagagtgagggccagacggagtctttgcggcgctgagccagcctgaaatgaactgaaggcgctgaggaaacaggcatttggagagatgaggatacaatttctttttttatgtgggcccgttaaagtctaatggacattggtgtctggccttaaatttggagagggtctttatctaacccttaaaactggagtcgtttccggtaattacgacaccccaggcaagaccactaaatcttccagaggcttgtctggatggccgtggtggggctgggaggggccatggggggggggcacacctgttacctgtatcagctataattatgacatttctagactcctggttttaaaggaagaatttatgggctaggtaaagccggaagagagcagccagaggcgttctggcttatggcagcgaagttgcaagagcccccacgctcggtgcccatcacggcccctgcatttccttaatgaactaatttagttccccaacatttggtattaagtaagtagttattttgggaatcgaagagagaaagagctggaagactttaaaaaaactttttggaaaaaagaaaaagtattgcattttgaagtttgagacgtcttggcgtccaggcgtaagatgtaggggaggactcctttggtgcgacgtggccggacgtggagaagcggccggccccatccctgcctgtgtttttgcttctcgacagagggggtttttccgttgttaggaacggcggaggccacaacacccagactccgagcagtttgtttggaagtattgtttagattattctcgcttttcaaattgagacaaacttggtttaatgggaaaatagcagtattactatcttggtgtgtttgctttagcgtttaaaaatagtttgttttcatatcccaaatttcatcctttccttgtttgcttgtttgatggaaacccgtgtgtgtgtgtgtgtgtgtgtgtgtgtgtgtgtgtgtgtggcggatgccagcacgcacatctatatagatgccggcgatcaaatagttgcaatcgtccaaccaaaaaacgattgcaattttacatctggctaaagggactcataccatttgtttttaacttaaaccatcttgtcccttccttcggcatcagcacaccactccccaactccccccgacccacaacccagcagtatttatttcttccttaaaaaaaggaatgccggcctgttcgctaaggtccctgttggaatagattttcagaggttatgtattaaatgtgtttgagggcgatttcagccctcagcctggttgtcccagtactaatggtagcagggcctattacagacaggcaaagaatattgtaaatggcttatgcagaaaaaccatttagataaaaatgcaattttcccctctgcatagagtgctaagaattaatagcacattctttctaaatgggtatttttatattatattttccccctaatgaaattctttccccaaacaagagcatgtttcattttaaactttagagtaaaattgatctgtttttaagcctgcaaaaactggtgtcctagttctcagcaggcccctaccttccctcctctgcgtctgagatttttgacattagattgtgtagcggatggtaatggcggttgtgttttttgacagtccatccacattgaggctgaaatagagagaaaggctgggtttgcccacattttgggtggatatgggggtgtttggcggtttcaacaaacagagaaactggtcctgaaatctgagccgtgtgcactcaggcctggcctggcctgggaggaggctcagttccctgctccctgggagtgcctgtgatcccctaggtgcatcccctgctcctggcttctgtatgactgcaggggagatccagggtccccagtcctgctcccctttatacgacttctgggaaaggggctgcttccagctcccgagtaccctctgaggggcagttctcaggggccggctctctgccaaggcctctgtggccattttgggaggaatggaaattcagaacttcttagaaggctgacttcaggcagaccagcaggagcctgcggcggcatcatcgtggaaagtctttgagagcttgttgcactggccgccatgggccagtgtctgctgacccagttttccctgcctgggtgtgtgtacgtggagatattcggactcgccttggcagcttaggcgtccagacttgacagtgatagaccctgtgacattgtagtaggtgaacatctaaaacacaagcttgtggtttttcactatcaatatggcactgatgtgaaagtttaggtagaattctagaatgggaaagaccttctcctgttttttgtgcccctcccctacaacattttccagttgagataacgaaagcccagagagggcaggcaacttggccaaggtcacacagcacaggcgcagagccaggacaggactatagttgacctttggccttgggcttcccttcctgccccttaatgccctcacctgagagctaggatttgattttatctggctaagcctcgtgcagaccagaactgggtcttaaactagaggtttccaagcctttttaaaaagcaccatgacagggccgggcacggtgtctcaggcctgtaatcccagcactttgggaagctgaggcaagtggatcacctgaggtcaggagttcgagaccagcatggccaacatggtaaaatcccatctctactaaaaatacaaaaatgagtggggtgtggtgggtgtctgtaatcccagctactcaggaggctgaggcaggagaattgcttgaactctggaggtggaggttgcagtgagccaagatcacaccactgcactccagcctgggcaacagagcaagactctgtctcaagaaaaaaaaaaaaaaaagcagcacgacgtacatcccctggttggtggttggtgatggcaacccttgttcccttcctcttgtggaggtggacatcgtgcaggagagaattcttgaccttggggaagccgcagtagcaccatagcctgtcagatggttgctgtgggtttcagccctggcgttttgattcttccgagctgggtgatctcagacaagccacttcactgctcccagctttctttcctcatagataaaattgacaagaggaaaaaaaaagtgtgtacctcacagaaatattgtgaggaccaaatagtatgttttagctagcattataattatgtgactaagggcacaggctttgaagccagactacctgggttcaaaccccagcaattccagttcctggctgtgtgtccttgggcaggttacttaatctttctgttccttcatttcctcatcggtgaaagagaataataatagttcccgcctcatggggctagaaggattcagcaagttaatatatatatgagttgatactcagaagcctgcttaacacagagaaagtactatatgccagcaccagattttactgagcactgactatataccaggtggttcgtatatagggcatcagtgaacctaggaagtgcatggtggcattgtcgctattgtttgtcccatcttagggatgaagaaatgaaaggcacagattggcttgcaagtggtgccggctggaggggaaacgatgccaggctgtacttcaggcacttagccccgggcctggcactggggacttgctcagtaaatgtcacaatgtcatagggcggggccgggctgggacccactgcccctgcgtcagcaatttcaggcctcactattgggccggtgtggggccggggaagggaggggaggattatatgtgcagaccttctccttgttcggggcattcagaccctgtggtctggtcacagcctgccaccatcgggcacgtgttcctagcagtgggatggtagcgccaaggtattttttaccacccgacagctctccctgtgccccccaaggaatagttccctgatatgtgtgagtaatggtcagccttcttgtggagggaatccatgagatgagctggtccgcggcccctgatcattttgccaggagcccgagtcaaccataaacagtctgggagccagcaatagaaaaattaaacccctgcgtctggcaactcaggtggggcctcaggaacctggcaggctcgggctgaacagagatagcaagagcaagagagagagagagagagagcttgagagtgaatgagcgtccctgccccaggagatagtgggagggtttaggaggcagacaagcctgggatcgaatcctggctctgccactcgtgtgctgtgtgactctgggcaggtgattcacctctctgagcctcagtttcctcacctgttacataggtataattcttgggaccctctcagagggttgctgtggggcctgagcatctggacaggttggtgagagcatgggctttggtgtcagccagaaggtagctattctgttcccatgtgggactcttggacatgtccagttcctctctgggcctcagtgtccctggctacaaactgggaagagtaacacccttcccacagggtagtgggaatgctcttcaccctggggcaatattgccccccccagggcatacttggcaatgtctagagagatctttggttgtcgtggctgcagggaggaagaatgctatgggtccctgatgggtggaggccagggatgctgttcaatgtcctacaatgcacaggacaggcctcactactctcctttccaggcccaaatgtgaatagcgctaagattgagaaactctgaactacagtgagtgattgaggttaggttcaaaataatactcagggctgggcatggtagctcatgcttgtaatcccagcactttgggaggccaaggctgctggatcacttgagcccaggagttcgagaccagcctgggcaacaagtgagaccctgtctctacaaaaaacacaaaaaattagctggccatggtggcgcacacctgtagtcccagctacctgggaggctgaggtgggaggatcatctgagcttgggaggttgaggctgcagtcagttgtgatcacgccactgcactcctgcctgggcaacaaagtgagaccttgtctcaaagaaaaaaaaaatactcaaaactttctaggcagtatagtctatattcaagagggctggcatatttattcattcaacaaacactcccaagcacttaaccacatggcgatgctgttctaagtggtgggatgcagtggggagaaagacaaatgccctgccttcatggagtttacattctaggggaggggccagaatgacagacaacaaagaagaacgcagagaattagaagaggggatgtgcgtgagagttcctagtctgggccaccaggaaggtctctgagaggcagtgacagtgaagtagaatccctgagtgatgacgaggagccagccactagtgttctggtgattctacttttaaacacctggctctctggggtagggggagagaaaaataaatgctctgatatgcagcatctgctgattcccgtggtgtaaatactcctaatttcaagccaccaaagtgatgtcagctgtcagccggattgcaaaattcctgaatatttaacaatgggctccggcaccctggagccagctgtatcaagctctgcaggaagtgggttgggcaaggggacagtgagggcaggtcctaaggcaggacggggagtgggcctattttaggaaaaaggcattgctggtgagaggggagagacagttcaggcaggcaggggcccgactgctcggggcttgtaggcacggtcagattagcagtttggagtccattctaaagtgtggccgggagccaggggagggtgtggagcacagacaggctgggatctgacggcacatagtagatgtgcattgaacggtgcttcatctgagcccaaggtgtctgagaaaatgtctgtttcccttccctatgttctggccctttctgagatggcagaaactttccttctggtttggagcccctgggccataggttagggcaagttaggctgtcccctaggacagggtgctggggtcctaaggtaagggttcagcctaccacaggtgggagggcatggggcatgtcagtggctccctgagctgggcaggccacaatttatgtcctggtccagggagactctgtttcctccttcccccaggcattgttctccaggccttgcagaggtcaccccgacaggaaggcacaggcccagctggggccagcccgaggaggtgtggaggcctgggcccctgggtgacccaggcctggtgttcactttctggcagcttttcttttgcattcctgcccaactccctgagtggcaaaggaatcctaacaagctacagttattaaacacccatcatgccaagccccattttacagatgagaaaactgagtcccagagaggccaagtgacctgcccaggggtgcagtgtggattcatatccaggcctttctgagcccgtgcttagaaccacttatgggcacggagatgaggagctgtatttcctaccaacagatgctggagataaaaaccaactctgtgtcttgcctcctcatggccgtcaccaggtcatgccgttggctgtttaggtcttcccatttgttccccacaggtgacgggacagtggttcgaacccctagcctgggggccgggatgtgattggggcaaggccgtgctgcctcactgatcctcagtcagctattctatccagtggctcaattctggcatctcctaggaccccagtgaggaggaagcgcctgccggtatagctggtacctgctgagtgccagggagcacaggtgctttgttgcaggagtgcatcctatcctggtcccaggcctagggggtgaggaccccatccagagacagcattcatcatggtcaccctggcaccctgctgcctttggcccctgaggtgtaggaggggtgatgaggatttcctgcagagggaccgggatggacccagatggggctggttcggggtcagggatcttcacccccatctctgcaggggtgggtagggaaggaagggatgccgctgtatgggaattccttgtcccagccccgcccacctcatttcttcctcccttatccttgagaacactggtcttagccagcttctgctttcgtaggttgcatttgcctgggccgctgtggtctgggcttcagccactgtcctacccgagtgaggcttgttacagacatcagggcccacctgactgtggtgggctacacgaggatgctcacatttcctccattagtcacctgatggctaggcattggagtcagattttacgtcccagacctcggggaggaggacagtgcaggaagccaggcctgtggccttccactggactgatctccttactgccccgggcctcagtttcctcatctgtcttttgggttaaacggggtcgtggcgaggattaagacagataatgaaaagcactccgcccagcgtctggcacattgcagacgtcactaagccttggcataaatacagatgcttctcctcctgcacaggaagcatcgggaacctgtgaggggagggggatgacacgttgcatgaagtggagaggagtgggcgtccccctgtgggatggctcattctccagtgggcagtgagagatttgcctgcggaatttaggagggtggtcttgggtgccgttcaggaaagagaaagtggccgcggcagctggcagaaattccctcaacggctagatgtgttacaacgccaaccagtgagaaaatgaatctgagacaaaaattgtgcattttctggaactccttagagttttaaataccctggccccatatacccacttcttagattccctgtttgtgtagggctggaaaaatcagtccctcgttagtgttgggaaactcctcaaaatcacggcaacaatgctaataatatttaagagcgcattaatcacaccttctactctgcatatatatggtgacgggttctccacgggcagttaccagacaaaccatgtgtagcccttaaaagctgtgcctggtgggtaggaatccctggtagctgttcccactgctttgtcatcagcctgggtcactgactcaggataaaaatgatgtaccctgtagaatttttcttttctttctttcttttttttttttggagatgcagtctcacttgtgtggcccaggctggagtgcagtggcgtgatctcggctcattgcatcctccgccttctgggttcaagcggttctcttgcctcagcctccctggtagctagcattacaggcatgcgccaccacgcccagctaatattttgtgtgtgtgtgtgtgtgtatttttagtagagacacggtttcaccatgttggccaggctggtcttgaactcctgacctcaagtgatctgcccaccttggccttccaaagtgctgggattacaggcatgagccacagtgctgggctggacttttattttttttttctctctctctttttttttttttttagaaacaaggtctagctctgtcacttaggctggagtgcaggggcaccatcatagctcactgcagcctccaactcctgggctcacgcgatcctcccacctcagcctccagggtatctaggactacaggtgtgtgccaccacacctggctaatgttttatgttttcatagagatggggtcttgctgtgttgcccaggctgctcttgaactcctggtctcaaacgatcctccctcctcagcctcccaaagtgctaggattacaggcgtgagatgctgcacccagccagaacttttcttcttgcttgcgtctctctccaaatccacgctatggtgagcaaacccatttgaccggaggtttcatctcgattttgctttcggaagaaatctcttgtgattgtctgcctcaagtgttcatttagggtttaatcaaataaaggtggggcggtaaagggattgtagggagcaaaatcctatttgtagagagtggggaatatccatgccctcccttgcgttttaaagaccaaggcaaaaactttttgcatgccagttcctgggggacagaaaaatctctcaggctttggttccccaggtgtttgctctgtctccctctcccccaccggctccccctcctctcctttttcttctctccctttcatttctggaacaatcgtcctggccagttcctttgggctcttccacattctttgccaaaaacaaaaaccattcttaaccccagatgaccaggcctgcagtcgttttgtctggtatgtggcgtccgcccgagttggggcgggtgagggggggcatgtatgcttccaatttatattccagcatgccagcttcaaggcgagatggggctaggggaggaaaaaaaaaacctcaaaaagtggggaggccagaaccactgaatttcaagagaggagaaagagggagagggtgggggaaaaacagccaagccgaggtgaccggcagattctaggtcaggccaggcccgccctttcagagccaccccccagcctccgcccttcttagccctgtggtagactttggattgtgctctgtattctatttgattattattattttttaatgaggtcagactgaaaatccatctgcctgggcctgcctgcctaggtttgaaggcaattaaactggagactaacctcttaattagggtttccctgtgtaaatctcatttgataaattccttatcagccttggctttaactacagcgcgtcctcgagacgggattgagctccccctgggacctctaagtgaatcccccaagagagcctgccccactgcaaactcttctagccagagcctcccccaggaagagccgggagagaggcccctttcagggttaattaatcagaaaatttagtggtgcccggtgattccggaggacttgtctgccacctttgaattctcccatctccccttctgcctcccttctaggtcttaaaaaattttttttgggtgaactgaactccgctaaaggaaatttgcagcccccactgcttccttgtggctccccctcccttctgcccaacttgtttgtctgtgtggatggttagattttttttccttcccttttttaaatgcaagtgcggctgggagtagaaatgtcaggggtcaggcttcaggcggcagggagcagaggggcagcctcagctgctgtcggtgccattccattcggggagagagcggagctgagcttaaccctttggggcccaggccctgcctctgggttcaaggatactgggcacttctttcccctctcttcattagagtcggaggggactctggcacctggactcctttttcaggattttaagctacaaatcacatctggggtgggacagggcagtcatagcagcatcacctaggagagtgtgaagcgggagttttggttccatcagcacgtcctgagcacctgtgggtgtgttccggaccaggagcaagatgccactcatatgcatgtggtcacacagggcaggctgggccacggcggtatgcactgctataacctcgtcagcatcccaggagatagccccatttacagatggggaaaacgaggcctcgaaggggtggtgatgtgctgagttccccagctgctaataggttggagtggacgcgaggcccatctttcccagttctgaaccctcgattcctgcgtaccaagaacccctggccactcccaccctctggagtctggtcagagaagaagcctgactcacatacagtgtttggattccttccatcattctgtagccatcgaaagggcggggggccaggttggagggtggagcatgtgccatgtcacccacagcaccctccagccgctgtgaagcagctaccgctgtggacccattttatagatgaggagggcgaggtacagagaaagaagggacctgcctgagagcacagccgacatatggcaaagcctgatgtatcccccattctttctgcccactgggtctgactgctcctcagcatgagacatcaccagcccctggaagcaggaacaagagcacagaactggggcctcccacctaccggctccccatcacctgtggagttgcccaggggctatgcaagctggatggtctgtgatatggggggctcaggagggggtatagctggcctgggtattgtcagggtgacagggggtctagtctgccagtggcttaggttggtacctggcagagctgcccctggcacacagggcccttatggaattgtcacgactgttgctatgtctaagcctcagtttcctcatctgtgaaatgaggatgatggcagtgtcaaccccctggggttctgcgggcacgaaacccgttcatgcgcagaaagactcaccagcaatgacctgcacctgggaaacttcagtgcacattaattggtattattatcatttattcctaatattggaggaaaaaaatgtaggtaccaaggaagtctctgagggaagaaaccccatgtgataatcaacacctccgtggatagccaggagggtgggggttcccagtgggagctgaaagcaggaggccctgccctagtctgacccgtggggtggacctccgacctggggctgtgtggccctgggcaagttgcttcacctctctgtgctccctctggtggggaggaaatgccagcttcttcagttggtgggatgagcgtggacctcaagtcttcagggcgaggggagggagatttgcttcatggctctgcctttaactgggcagtggccttagaatctatcttgctggccaggcctctgttgccctgtctggaatatccccgttcacgacggtgaagtatagaggaagcgatctgcccagacgtgttttgcattctcccagagagctctttagacctcagggattattattagaataatggaaagtgggatcatttctctgcagagttggggggaatctgggcacacgggaggtgaagcatttggcagctgcaggtttgtccagggggccgtttgctctgtgtctgcccctgagcccctaccactgagagggcaccgtgggggtggcgagagatactcatgtacatcaaaggatcaaggccgggcgcggtggctcacgcctgtaatcccaacactttgggaggcaaggcaggtggatcacctgagttcaggagtttgagaccagcctgtccaacatggcgaaactcagtctctactaaaaatacaaaaattagctgggcatggtggcgtgtgtctgtgcctcagtattcgggaggctgaggcaggagaactgcttgaacccgggaggcagaggttgcagtgagctgagattgtgccactgcactccagcctaggcaacagagcgagactctatcattcatgaataaataaataaatggaccaagatgatgtttggggcctagggtttgggtcctagcatcctctcttgttgtatggccttgagtgagtcacaatgctacgttatgtctcagtttcctcggctatgaaatgggcatagtgaggcggtgaggactaagtgcggcgagcacgtgaggccccagcctgggctctgcacggtgcactcccatgactcgggcccagctgagccttgaaaggtttggagtcgcctgaagcagagcttgaattctcccctcgctggcctgcggcctccctctctccctcgctctgaaaccaaagcccagcatctgcttccccaggagctgtttaatattctgccgtggtaaaatgaactcattggagccacccgaaaacagctgaatgaaccccctggcgcccggtggcctttcagagtggctccagaccccccttgggcctcggggaggctggcaacggtagcagctgtggaagaggggcccccttttcttcttggtgtctcgggggagcctctgacctgcaaatggggctcctcgggggctgggtaggggatgggagtctggggaggggcggcctgggcttcccggcctgttcggggccttgtttgtgcttcttggctcagaggttctgtgtatggggcctccttggggaggccgagaaagctaggccttccccaaattcttctcctgattctcccccaccccagcctcaaactgggcctagtgcaggcactaggctgctagcccccagctgccagccacactgcttgattatgatgatgatgatgatgatgatgatgatgatggcaatggtgatagtgacagcagcatccatggagcaattgctaagtaccaaaccctggtgagtgtgttgtcttgctagcttattggcggctggaaaccactgggaacagtttactattcttattcccatttgacaggtgaggaaactgaggcccaaaggggcgcagctgcgtgagagatcatggagctaggaagtagcctagcagggcttcacccaggctctcaccagcacaccactctcctggtgccccacagacgtctgcacctgcagggttgtcttggggttggttaagtgatgtcaagctgtggagcactgctcagaggcatacagtcggcactacttaaatgctagactctatcatgacttgacgactgtacttcgtcacacttgttgcctgttaagtccaagtttcatgaccgtctccctcctccccacactctaactgctctatttccaccccaactccctcgaaaggcaaatggtaacgaagtgcttccaggtagaagccggattgatttcatgtaattatccctgacaaaattaaatattacttgcaattagtcttgggcaatttctctgctgagacacagcgaggcagtggggtgaaaaagggctgagttggcccagcccctgctgggctgagggctgagtctgttggcagctgtgtgtgctctgcccgagaatgccctgtcgccaggacttaaacccacagcagcgatttctccccaagacagggaggactagggagggccgggcaggaggacacacataacagcccctttcgtccctccttattttataaccgagaagcctcagcaaatagtactgggattgatttttccagcaggtgagtggcctgacatgtgtcgggtccaacaacctctctggaagattccaataattgatatacggcggtggaacccaaggtataggatttcctccccaggagttcaagccccagcaacacttcccaccagctgtgggaccttgggcaaattacctcctttctccgagcctcagtttttccagtctttaaaatgggggtaactttgactattgaatgagttaacgcaggagttggcaaactttttctgttaagggtcagagagtaaatattttggattctgcatgccataaagtctctacttaattacctatccctttccctgtcatgcaaaagcagtcacaaacagtgtgccaatggatgggtgtggctgtgttctgataaaactttatttatggacactgaaatttggatttcatataattttcatttgttatgaagtatcttcttttgactttttttcaaccattaaaaaatgaaaaaaggccagggtggcggctcacgcttataatcctagcacttcgggaggctgaggtaggaggattgcctgaggacaggagtttgagaccaacctgggcaacatagtgagacccccctaccaacctctataaaaaattagccaagcatggtagcatgtgcctgtagtcccagctacttggaagactgaggtgggaggattgcttgagcccaggagacagaggttgcatgagctatgatcatgccactgccttccagcctggatgacagagtgagaccctatctctaaaaaaaaaaaaaaaaaaaaaaaaaagttagggaaaaaaccccaccaaaacattcttagctcatggggttatagagttttttttaaccctccaagatccaaaagtcagatggtgggccagatttggccactgggctgtagtttgccacccccaagttgacagatgaagtgtgcttaatgcagtgctcagcacaggcaaactgctcaataaatggacccaatgactattattattttctggactcgaaataccttttatgggcatatttaagagtaagttaaaaatgggctggatgtggtggctcccgcctgtaatcccagcactttgggaggctgaggtgggaagaattgcttgaggccagaagttcaagaccagcctaggcaacatagccagaccccatctctacttaaaaaaaaaaaaagtagccaggcatggtggctcatgcctatagtctcagctactgggaaggttgaggtgggggattgcttgggtctgggaggttgagactagagtaagctgtgattgcgccactgctctccagccagggtgacaaggtgagaacctgtctctaaaaataaaataaaataaaataaaataaccaggtttgtactgtgaagttcaggtgataatcattcctttttcagtttatgcttgtatctgtaaactcttcgtgtgttctttgatcaagtcaggactattacttccattgcagggagactgaggcccagagagggaaagtgccttgtccaaagtcacacagctgggacaaggcagaggtggatcctgaatccacatgattctctgcccaagagggcctcagagtcctctccagaaatttatgtgttggaaaatgcactggactgggagccacctcagtcctctcttccctgagcctcagtgtttcaacctggaaatggctgcctttcaaaccgccaactgtctatggactgtgactctggggtgacaagaatctctctccatcatcctttcagtggttctaaaatccaggttacacctgatcagcatttgccctgcctggtggctgaggcttgtgggagctatctgctgtgctggccggaaaggatttgggagggaaggttgtaagatgaagcttggactgtgttctctaggttaggatgaggactgtgaaactgtgcgtggtcagtgctgaacaccctggatactcattgtcaatattggattatgattgccaattagtgactatgtggccttgggcgagtcttactgagccatcgactctccttttcctcatgatctgggggatagtaatgcatacattatagattggcatgagaataaaggaaggtaccagtgaaaactgagacttggggctggccacatagcagatgattaaaaaaaaattggcatccttgccgggcacagttgctcatgcctgtaatcccagcactttgggaggctgaggctggtggatcacgaggtcaggagatcgagaccatcctgggtaacgcggtgaaaccccgtctctactaaaaataccaaaaaaaaattaacagggcgtggtgggtgcctatagtcccagctactcgggaggctgaggcaaggagaatggtgtgaacccaggaggcggagcttgcagcgagccgagattgcgccactgcactccagcctgggtgacagagcgagactctgtctcaaaaaaaaaaaaaaaaaattggcatccttgatattattgcttcgttattatcatcattctacttcatcctcagtcactgcatttccaagcctcatttctgaggattgcgaatttccaccatccagagttttaatgggggaaacatgctgggagagaacaggaggctgggggtgtgaattttaatcctgtcctggccttgactcatcatctgacttcaggcaatttactttatttcactgggcctcagtttcccactctttgtgattgcaataggtcagattacagattcaatatcaagtgctaatctggattagtttcggctacctgcagcattgtgtcaagaaagactctgaaggttccctaggagggagtgctgcagttgattagcaatgtctgccatggacttaaggtgaaatatgttttggtgggagccccgcgtggttgataatcctagaaaagatgaccagctcctttcagccccaaatttacatcagtctatggaacctgcctacttgaaactgatagggcttgccttttgtaagaaaactagttgtcatggcagccactgatgcagactgggagagactttgtagattatttttctagatcagtattgtcccatagaactttctggaatgatggaaatgtcctccataggccctgtcctgtacagtatccactggccacacacagctgtcaaacacttgaaatattgctagtcatgaatgaggaatttatttttaattaattaattaattatttttagagacagagtcacactgtgtggcccaggctggagtgcagtggcatgatcatagcctactgcagcctcaaactcctgggctcaagtgatcctcctgccttggcctcccaaagtgctgggattataggcgtgcaacaccatgcctggccaattttcaaattttatttaaaaaatgtgaaagctgcacatggctagtggctaccatgttggacaacccaactctagactcatggagctcctgagcttgtaggagctcccaaggcatctacttgttacaccccagtgtgcataaagtctgggtgggtccttgggtaaaagcctgttgcttggcaaccgacaccaagcagtactctctgtagctctacccacaggcagctggaaaccacctctgcaggagttttgctcaggtgggtgagctctgcataggagggtaaatgcttttgtcttttgcattgcatgcctccctgggggcctggttctccagggctcagaccctgtaagtgggtgagacctggcttgaatcagactctctccctaacccctggatgagtatgcccatctctcaccctctgtgacaatccaggaaacatgaaggtgtttccagatgcagagtcggtgggccaaaggggaaggcaggatgatgggtgtttgggagagtgggagacatgttttatttttccttccctccttctctcccttcttccctcctcctctccttgtctgtctctctttctggtgtggggaaaaagtagaagatgctttggaaactgatatggcttcatcctgagttggctgctcccttgctgtgtggtgttgggcaagtcaccccacgtctctgaacctgtttctgcatcctttaaaaaggaataacagtccctgcctttgaagggaggacccgatgaagtaatatacatgaaatgcttagaatagtgcctggcatgtggttctcttccctgggaaaaaattaccctccaatttgctgatactgtctctctctttctctcttttttttctttttgtcaaaaccccccaaacccttaaccaacacctccacccacccaaccttgcctgcccagagatgttgttggagcggtggagggtaatttcaccgatttccatgcttggaattgacttaaatctcatctcagagattatccctgtaggtccagtctcagggctgggtggcatgttggttgggaaggtggcctttctgggtgatcacactgggcaggaggaaattgctggcacttgtcagctcatcccaggggactcctgcatttttgtctttattacaggcacctccatttcggggtttttgcacacaccagtagggtctaaaataaacaagaactctaaccttcaaactttgaaggaagtctgttggctgggctggggttgtgggaagtgagtggatataattccttaatctctacatggtttgtgagagggcgtcgcccctctcagtaaatttggcaagccttccaattaagtcttgtattattggcacccaggaagccttgaaaagctccttttcaggtctgtccgggggctcaggtgatgtggtgtgagtctttctcattttagggactctttagggtttgttcctgttcccaggaattgatgtagtcagcacactgagggcctactatatgtcaggtgctagggtcagagtgggaagtaaataggtgatacaaggcccctagtttcatggaactcatactcttggggccatggcagagagcagggcaagaaggaaaagtttagcacaattagggttggtgtgaggtgtcacagtatgaggggcactggagcccactgagggacttgaagagacctccttgatgaaggaagatggagaagagttagtcaggtgaagagagaaaggaaagtggtggtccaggaagaggggaaaaatgacaggaatagtgttgcctccccttggtgacagcgtactacaaactccatggtgaagccttcgggacgaggagggggtctggtgctggctttggcagtagggccaaaatcctctgatctagtcacacttctgcccttgacttacccctctgtggccttggtttccctaataaatagcacttgtcagcccagtcttcctaggtctggttctgccatccttagaagaccacagggacaaggggctgtgacttctgcccttggaggaagaggcactgggtcttaatcctgcttctctataccagagacataggccaaatctggcaaatccttctgagaggtggggtataggtgttgcaaaatttgtcttgtctggagaaaatttgacagaaggtgaggccagggttgactcagtcacttaccccactcccctgcacccgcctcttcccacacctcctgctggaaggagtgtggcagcccccaccttccccttaaagaccacacaccaccttcctaggtcaatgccagagatgacactgggcgttgcaggcccagtgagagcacgaagagccaagtcagtcagcatcgctcaatcctctctccaacccccaaggtggagaccagcgaatattttccagcagtccacaggataatttgaggtggggaacacccacttgggtggcatctttaggtcacggagtcccggtcctggcagctgacactcttgccactttcaaaggggatgtcagttcagagaaggcaagtgctgcacctgaaatcacacagccagcgtccggcagagcccagcttcagctcccagagttggggaggagagcccagtccagagggaaagcaagttgggggttgtttgcggcaggtgcgcttcttcctggaaagccaaaggctggatctgccgggaccctagggtggttgccactgaggatgggtgtgccgggcacaggcaccccgggggcttagttccctgtcgttttaatggaaataattaaccagctccttctaagcccagaccacctcctgctgctccccgtctctctccacccccttcaccaggcacacaccagggagcgggtaagaagacacagcctctagactcatgtagacctgggttcaaatccaggctctgccattttcgctgcgtggccttggttctcatagtgctgtggagagaacctgggccagacccgggtcagtgctccccccactactgtccactcagttcccgcttgcccggccggtcactgtctgctttgcccatcagtctgtcctttcagagttgaagctgagctgctgtttgctgggcaggccatgcagcccacacgggggtcctcagaggccttgcaggggtaagtgctgggagcccccgctcgagtctccctcctgcctgacgtggctgactcattcggcttcagaaaatccacctttctccttttttgtggctgtgttctggaatgacttttttttttctaacagcaaccctctgctcctaataatgttctattgatttttaagtagaaagacaaagaggtttctgctgtagcccaagagggaagatgagggccatagcaaatgacgaggacatttctgactccctaaaagtgacagcacgaatcttcatagatcaggagcatggactgagcacctactgggtgcctggcttgcaacctcctcttatgcgaacttggacaagtgacatcacctctctgagcctcaggttcaagggtcagcacactttctctgcaaagggcccaatctatagcaaatattttaggtttgtgggttatatactgtgatggttaattttatgtgttaccttgactgggtcatgaggtgcccagatatttgtttaaccatttctctggagaactctgcccaatgcttacaatctgatgcaactctaggaaaacagccataaacaaaatgtaaacaaatgagcaaggctgtgttccaataaaactttatttacaaaaacagggagtgggccagttttgacttgtgtgctgtagtgggctgaccctagcagcgtctttatctgagaaatgggactaggagaatagatgcttcctccagggttacatgaggaattattgagtttaaaagaatgaacatgtgataggtactagcggtaattatgttattggtaatatcatatgtcattctcctggcagccctgcccggtaggtctaagatctcatttcacagatggggaaaccaagacacagacagattaagtgacttgccctcagcccttctgctcactgttggatgacctggcacgagtccccattcctctcaggcttctgattccctacctgtagcctcagagaggacttggtgatgtaatgcacagagcatgatgatcacatccattgtgcagaggggaagtagaggcacaggtggagccccttgtagaggtcaccatctgagatgtggcagggctggaatgaggaactaagctgaatttcttggggccccaagttagaggcatctgacttagaagctgccttgggcacctggccagcccagtgagacccaagctttctcaaggtaccgttcccatgggagtgggactcttttccctcaccttgcttagagttggagaatacaagggacttggttctcaataaggggctatgtttctaagtcaggtgttctacggcaaggttagatggatgaggtgcaagcccctttattaattttgatggattctcgatgctccttctctgctcagaagccttccttggctccccattgctggcaggaacacggtctaacttcttccaggggtctccatgactgacctcacttgaattttgcagcctcctcttccctcgtttcacacccatccctaaatcagggtccctgggccagtctcttgctttggaaggagtcacgcctgggtttggcgtgctcctctcgcctcctcttcctgcaaagcttgcttaaccccctacttgcacaccgcctcctctgtgaagtcttccaggatccccagttctcccctcagatctcacaacatgggcctgccttttgctctggtggagctcctgctctattttgcaggttcatgtttaccggaatatctctcccatagggtgggagctctggaaggtggtggaacctgtgttgggttcacctctctgagctcagtgcccagcacatggctgcaggcacacatgtggctgtgatcagctcattgccacgttgttagtggcctcacgaggactcccttcctctaggctgccctaggcccaggcttggggaattgataatggtagcaggactttgaccgtcggttgggtaccaattcatccccttctttgcaaggaaggaatgaccaaacccatttttcagaggaggcagtggaggcatcaaagtggctgatccagggtcacacaacccaacagtggcagggatggatttcaaactcaggcctctgtctccaaagtgcgtgactgtgcacaactgacccctatgcaaagcccttccccggcgatgaagcagtgcgtgggaacttatgtgggtaagccggccccttgccagctgtgctgacccgacacaggaaaataccccagagctcctggcagacccatggatgggggggatgaggcaggtgctccataggacctccacccaaagtatcagcactttgaaaatgtgtttttttaaaatccagacttgcactgaacctcatgtttcctccaatgggctggaagcaatgaggctctaattccaaataaatgtgaatgtatatttgttttgttttgttttgttttgtttttttgagataaggtcttgctctgtcacccgggccagagtgcaatggcaccatcacagctcactgcagcctcgaaatcccagtttcaagtgatcctaccaagtagctgagaccataggcacacaccaccatgcttggctaatgttttattttttatttttattttttgagacagcgtcctgttatgttgcctaggatggtcttgaactcctgggctcaagcaatcctcctgcctcggcttcccaaagtgttggaattacagtcatgagccaccgcactcggcctctatttgtttactttttttttttattatagataaaaatcattatttgttgaatgacttaccacttgccaggcagagtgctaggagttcagtgaggtgtcagccctggtgtttagttgctccagtttctgtgcgagcatgctggggctcagagaggtacagcatcctgcccaggccactcagtatagggtctaacactatgtgggtgaatcttgggcaagaaggcaagaaaacagagagggggagggctgtgctggagacagggctggagagactctcaaatataataatagtacttaatggtaatactattaccagcattaccggtattaccagcaaatactattattatatttgagagtctttccagaatggcagctactatttatggggtgaagtcagcccctggcactgtgctaagcactttgcttgtattgcccccaggccttccctcctatgagaatgatactgtctccatccccatttcatagatgaggaaattgaggctcagaggagtcaatttcctcagaaccgacgggctgtgcttttgcataagcacgcgggcaacaccaccatcaggaggaaggtgcaggctaagcgactggccctcagccccccggggcctgtcacatcttagcagcatacaggtcaggagtggccccagggtgtgcagggctgcatctgtcacaggtcactggctgcgtggccggaggtgccaggcaggacagggagcccaatcagagatgcccaggcctggtgcgaggagcccactctgtccatcctgccgtccgcggctgtcatgcaccacctcatcccctccttcagggccagggacagtccctaggactcagcctccccccgcattccccggtcctgcccccagctcctggcagccgggttccgatgatgcccttgcagcctctcctctgtggagccctcggccagttctcaatctaaatgacagctgccctcagccaagtcaactcaaattaatttcctaaggcttccaggggcctggcccagcctctcaccagactgcactgctgcagcggccggcgcgaggcctctgcttcaccctcgtggggcctggaacgggggggccttgcagacccctcctgcccatcatgagttggggggctgtctttgcacctggctctgtgcccagggcagaaggggaatgcaggccctccctgcccccaggtgcccccatccctgccgtgtgctgcctcctgtcagatgggggaaggttgcagctgaaactttggtaacatcagtggtgagggaagaaacgttaaggggcgggggctgtccggttttgtcctcagcttctgtgtcaccctgggaagttctcatcccatctgtgagccttgggtttttttttttttcccccaaaaagtgtgtgtgagagagagagagagaaagagagagagaaataagaagaactagagaataagagggagggggagaaggagagagggagggagatacggatggaggggcagaaagaggaagaataagagagagggagagagagaggatggataatggacagagggagggtgaataagagcaagacatgagggagagagagagagaaagagagagagcgagaacgagacagattgaaaggaggagaatgcttgcaagagagaaattgggggtggtggtggggtgggagaggtcgtgccagtcactttggccaatgatgtttccctttttcatgcaactttgataaaaaccacacactgtgacatcagacgtctctgggtgtgaccttggctctgcggatggctggctgtgtgaccctgcgcctgtggcatcgcctccttgaggctcagtgtcctctgctgtaaaatgggctagtgtgtcgggccatctctccctctgggtgttggagtcattcactgtgaccgactgagcctgcaggtcatgttcacggtcacgccctggagccgactcgcatagagacagtggtctgctttcccttttccttttctcgattgccacggtgacactattgatggaagttgtcattgatgggagggcagagaaggggcaggggacacaggcatagggctgggccaaggagtggctagtcccctgggcctgcctcgggctctgcgtggccccggtgggatgcctagagtgtcacgcaggctgttggccactatctcttggtccccatccttggggttgtgggtgtggttccctgagctcaggtcaagatgtctcagtggcctttgcttaggctcctgccccagactcttgcctatatcaaatgtaaaatctttctttctttattttttttagagacagggtcttgctctgtcactctggctggagtgcagtggcatgatcccagctcactgcagcctcaatctcctgggctcaatagatcctcctgcaccagcctcccaagcagctgggactaccagcatgcaccaccatgtctggttaatttttttttttctttgagacggagtcttgctctgtggcccaggctggagtgcaatggtgtgatctcggctcactgcaagctctgccttctgggttcaagcgattctcctgcctcagcctcccaagtagttgagactacaggcatgtgccactactcccggctaatttttgtatttttagtagagatgggaccatgttggccaggctggtcatgaactcctgacctcaagtgatccacccaccttggtctcacaaagttctgggattacaggtgtgagccaccacgcccagccaatgtctggttaatttaaaaaaattttatagagacagtatcaggctggtcttgaactcctggccttaagcaatcctcccacctgcacctcccaaattgctgggattacacatgtaagccaccttgcccagctcaaatgtgaaatctgattgccccagagggatagaagggatttggggggagggttgtatatctacccaaaccactagtcattttagagagggccagttaggcccagagagggagagtgacttgcccaggatcacacagcaagcaaggtgacagagctgagatgaaaatgtgagccattcattaaaacacttaacaaatacttatcaggtgcctactgtgtgctaggaagcaggtgggagccacatgggcatgtctgcccttagggtctccaggccattgtcactggagggattgttatccccttctacagatagggaaactgaggctcagcaagtggacccaccgaagatcacagagctagtgaggggcagagttgagattcagaccatggtgggctttgaactcaggcctccaagctcagagttgggacaacctctaagctgatgcgtgtctgggagggttggggtgggagccaaccgtgaagtttcaggtttgctgttttcctgcttggttggtggccgtgtagaccttctttctgatccctgatatctggctgagatttgctgttcctgcccctgagcccagagtctttgagtttcccaggccccatctatctttctatagaaggggacgtggcccagggatcaagtgtgcacaggcagccaaggcaggtcattcttggggttgtggggccccgcagacgggttctagttgggctgtgggggccaactccacaggggtcaaatcctccacctttctcagtggtaggttcttggagacaggtcttagcactgcagtcaaaagcctgtgactgagcacggtggctcatgcctataatcccaacactttgggaggccaaggcaggtggattgcttgagctcacgagttcgagaccagcttgggcaacatggtgaactcccatctgtataaaaaaaatacaagaattagccgggcgtggtggcgcatgcctgtagtcccagctacttgggaggctgaggtgggagtattgcttgagcctgggaggcagaggttgtagtgaactgtgatcatgccactgcactccaacctgggtaatagagctagatcttgtctcaaaaaaacaaaaacaaaaacctgtgactatactttctattgggcaaggctctctactcctgtgacttctgtctgccctgatagctggtagcattttcctgggtacctgccatatgccaggcacaatagaaccttatcttcttcccatttcacagagaagaaaggtgaggctcggagagggaaagtgacttgcccaagcttgagctgctgggaacaatgccagggaccaggatacagaccttggtcatctgactccaaagtcccccgtgatgttttctgtgtttggtggcctgttggtgaggggccctgccctcagaacacccctctgccagagcaagatgtgtgagcacatccctgaagccagcaagcctgcagctagcggtatcattaccatcatggtagccggagccaggggtgccatctgccagcagggagagaagtatgcacatctcagagtaggggtgttagagaaacatcgccatggggctgacagccaggtaggatggcaggagtcacctggggtgaggaggggcaggtgctctaggcagaaaaaaccgcagcagcaaaggtgtggaggtggaaggatcagggctctgctgagagaatgtatagttggggcttcagtgcaggagagagcactgagagatgaggtcagaggcccgagagggagtcagcctggggcatgcaaagctgcgaggcactggggagccatggaaggttcaagcaggagagaggcctgctctggttggtgcttcaggaaactcccccagctgacaggtttggagggcagtgtgtaagcagagagtgaggcaaggtggcagctgcaggcaggagatggttggtatgtgggccagggtggggtagtggggcaggagaaaagtgggcagactttggaggcagcctcttccctccttggtgcctgggctgactgtgggggatggggaggagggaagagtgacctggaatgcccggggcttgcttggatgcaatggccctgcccttctaaggaggtgaggaacagaaaagctaccaaggtctgggggtcacagataagtgtgtggggggcctaagagactcccaggctgtagcacgaaggctccaagaagtggtggctcagccctgtggcccaccagacctgattcagcttccaggcccagtcgcccagccccccagttgagtggcagctgtcacagaacccaatgtctccccgcaccaggtccaaataaaggaaaaaccaaaatacatttccctttgtcggaatccagcgagggtgagttgggcgagagtcatccgctattgtgtgctgaggcccacactgcttcttacataagccccgagttaaaaatatgcccggaattctcattctcaagctctgcctgggattgcaccctgacccccagcctcggcagcttctagcacccacagggatgaagaaactgccccatggcacaacgctggcacgtggcacttctagctctgtctgcctccagtgccacgaacagtaagagtgcgccgggtgcggtggctcacgcctgtaatcccagcactttgggaggccaaggtgggcagatcacttgagcccaggagtttgagaccagcctgggcaacatagcaagaccccatctctacaaaaaacaaaagaaaaaccaggggctggattgcaggcctggctctgcccctgactccgtgtgaccttgatcaggctctgactctctggaccatctttcagttcatctgtaaagagcaacagtagtaccaggttaggggattagaaggaaaaatgtggccaggcatggtggctcacccctgtaatcccagcactttgggaggctgagatgggaggattgcttgaacccaggaatacaagactaggcttggcaacatagtgagaacctcatctctacaaaataaattttaaaaaattagccgagtgtggtagtgcacacccatagtcccagctacttgggaggatgaggtgggaggattgcttgagcccaggaggttgaggttgcagtgagctatgattgtgccactgcactccagcctggatgacagagcgagactctatctctaaaagaaaaagaaaaacaacaacaacaaaagaatgataagtgtcagagcagctaccctttttttgacaaagggctcaccttatgctgaaggctttccagctgtcatctcacttaatcctcctagcagcctgcaaggtaggttctcttactcctcccgtactagagaagaggtgagcacctagcccggagtacccagggagcccttgatatgggcagttgttgggctctgtccttcttcccgaatacccctggctttccctcaggtaggcagcggggcaggaggtggctgggtcagaagtctccttccctggggctcagtggtggaaccgtggctgggagaaccaccgaggcagccctttgcctggcgtgggaggtggcagccacctccgcccggctcacgacgcctgagcacgtggctcacccacattggaacctggtccgcggattttagtgcagagcagggtgatgacgaggcctgttttgctgacttcaaagaaaaaaagaaaactcggccccctctatgggtgggtggcatctctagaagcaaaatttaaaatgcaacatccccaggtaaacgtcccctcttttccattctcccttcaccccaggcacagcctgcagaagggtcactcagccctccccgggcccagccctgcaggtccccactgtcacctgcaggctggccaacaacattgacaggctgtactcatagccagcgttggcaggagcgccccacgtgctaagcgttttgcatggatcatttcacttaattctcctaactgcctccatcacggccggtcctattatttcccccatttcctagaaccgaggttctgagagctgaagtgatgtacaaaagttccttgctccacgaatggtggccactatcattgttgaaccctgtaagagaaacggagtgagttgagttattcacgcaattgctttttttggcacctgctcctggttctctccttcccttaatggaactgactgtctccattgtggatggagaagtttggaagacagaatccaacgtgggtctcgtgatcgcagcggggtgagcagggggcagactgaacctctgcagtatgatgaccaaatgaagtgctgtggtgttcagggcaggggtgacggggtagtaggaagaggccggaagatcagcgaggatttgtgccatgaagaaaagctgaggagtgcttttgggaggagaaagagcaggggtgtctgtctcagctctgggccttgaccctgggcatggagtgtgaggtggttctttctggccatagctgtccttaaaaactgtcctgcagtctttccttgctgggcaggcatgcccatcagtccccaagaaccagaggcccctgccctcggccccctgtgctgcctgaatcgggtgaggcacacacagggttatctgttttgagatgatgttgccccagcctctgggactgaccccccaacatgcacatggtattgccagtctctcgtgaggtctcccatgctgctcttagccgggctcagcaggaatcaccacccccaagttgcagatgaggaaactgtggctctgcagacaggagctgcccagatacagggcatttgggattccaccctggcctgagcagctgggaatcctgggctgagaggagagagccacaccaccagagctggtgacatggccgtgggtgacccctgggtagctcctgccccttagagcctcagtcttctcgtctgtcaaatggggatgaagggcgcttcacagtcagtacactggacccaactgagggcctggtgtgtgcagggtcggggggtgaacagaccaaacctgcccttctccacatggccacagtctgatgggggaggctgacaatcaagtggaaaacagaacagcactcactgggtcctgtgatgtctgccagtgctgggcgctgagtgactccatgatctccgccaaccctgggagcttggcaagggggtggttttatctctgggtcctggcgtgggggctggcgtgcttaccgcctcaaggagcggagactgagggcctctcttgagctggggcaggccatgacttgaggcggcttccgtgggactgatttatcggcagcgactcggcagccctggggagccgcggtctgagggcgtgttaggtccccctagctggaatgaatccagcgggaggatgagtttggtcatgcttgggttgtcaagaactgaagaataatattctctcttaaaaatattccctgtggataccagactggttggctctctttctcattctaggcggaggctggggaatcctgcacccatgctctgtgacatctggcaaggctctcaccctctctgagcccagggtggccctgctggggtggggagaaggggcacccccactgatgggcttgctgggtgatgggcttagataatacacagaagtgttcagttgtgtgcctgggatgccctcattaaatccacccctaataagaacagcaatggtttctggcgttagtgcacggcacgcttatggctgtaacttggggatgaaagcgtctttcgaaaatttggccatttgggtctgtcttacccatcacttggcagacccagcttcctctgcccggtgtgttgctcaggaattttctttcactttctgggtgtttgcagccccagagcaaagagtttatctctcctttggcaaggagcttcatccctcggagtttgtttcctcatctgtaaagtgggctcaagcattgctacgttcattccttgagataatttgtgcaaagtgggggaaataaccccctttcagattttctctctttctctctctctgtggcaggtactacttccctcaccccaccccagtccagatcttgcagtgcttggaataaaattcctttggagatattaagcagggtagggtggaggggtcgctgggaacaaggcaagcatgggttcaagagcaaaggttggggcactgtgcctcagtattgccagaatccagggcctgccatgttcctagaaaccctgcatctgatgccttaagcttcctggtgtaccttctccccaggaagccctgggtggggtattaacaacatccagatttcaccactactaactagctttgaaaccttggattcagaacctcagtttctccttctgtgaaatggggcaaaggctcctgtttcatgggcaggaacacgcccacctagctgggccccaggaagtagtggggctttaggggattctaagtggctgcaaagcccccctcacccccgaccctcccagatatgaatgacagtcccagcagcactgtttgggggactgtctgtgtgccaggccattacaaggccccaggggagatgacatcatccccatttcacccatggggaaactgaggtccagagagggaacatggtagagccttggccacacagtagtggggctgtgacttcaaagtgaccgtgctttggtcacaaagagacactgtttcctggcctcaccatcagctccaggaggagggtggggatagtgtctgtcctattccatgctagatccatagggtttgtaccatgcctggcatatagaaggtcctcaataaaggcatgttagttgcatgaatgagggaaggggccaaggaagtctcctttctgcccagctccggctcctcccagcatgcaggtcccaaagctgagtgtctctggggctccagggtgggggccccaagcccagttagtcatggcctgtcctcagctgcctgggcccatccctctgggaggattttctctgcaggctgtggctcagctcctgggggaggcctcctgcttaatcccagagggcagggcgggccggtgactcctgcctggcacagggcccttggctgggcttgcacagaggattgagggcaggccggtcatggagttcagtatctgggtgtgctccctcagctggagcagagccccccacccccaatttcagcttttctcactactactgaggcagaaattcaacatcagcccatattcaaacccagctttctgtcccttccaggctgtgtgaccttggacatactctaaagtcagagtctaggaaatgagaataatgagactcttcattgacatatggcaggtctcaggacagagccagtggtcatgtggtagccgtaaatgagaagtcctgcaaattccctgctttggtctaatttatactaagatgtgaatggttgtcaggctcctttctcctcaagcgtgtctaacacagacatccctgtgatctgtggtgctttctggcattgtgtgactcaatgaaaagagggttcaggggagtttcactaagggtatgggagaggaatagactcccccaccccaggcacccagagtcctttcacgtagtagctgagaatggtgcttttgtgctggtctgattggggagctcagattctctgtctctcctgctctgaacacttcatcttctgtccttgtgaggacaacactttacagtttatacaaacaccttgtacatatcaacagcctggttgactagccatcataaggaggtgcatgagccgggtggacactccccttttcagaggaggggactggcctcgggtccctttgcggagctacaactggattctctcagccattaggttggagctgtgtgaccccaggaaagtttctgtgcctttctggggctcagacttctcatctgtaaaatggagtatgagcaagctaaggccagagcgtaggagggaatgaaagacacaggcaggtgtcccgaagggctcctcttctcccatgcccccactctcaaagccacctctatggagcctcagcccctgcacaccaatgaggggcagaaccttcagaggtgggagaggggctgaaaagggagtgattggaaagcactggggagcgcttggggattggggagcacatggggcttggggagctgtgggcgtctagtctttgtggctcagctgtgccaagctgggtatccacaggcaccttctccatccttcctgctcctctggaaagggtgctgtgactccacactttctcctgtgtgactcggggcaagtcatcttccctctctgagtctcagttttcttagctgtaaagtagaggtgatcatccttcccccctggagttggtatgcagtctggcacattttaagaaagttcccagctcgtggtaggccctaagcaaatgtctctccagaggatgacacacaaacaggctgtgttctggacccagacaatcctcccctccaccctttcactgcatgcggcgaactcctacacatcctttgatgcccagtttagatgcccctcctccaggaagcattcctgacttagatcacgtccagttaatcttttgggaactctggtgcatcagagatgggcaaactctgagtttatcctgcctcactttcctatttcccagtggggaaactgaggcccaacagggaggtcttcccttggctgagatctcacagatgaatcaggggtaacagcaagaagattcaaaacaacatctctagatcctctgggaccagctttagccatggaaagagggcgtggacggtgcctgtcttgtatgcctctgccactttggcccccattatggtgtccctcagagacgagtgtgccactaatgtcctctcttccttctctctccacagcccacgacctccctgcaaacaaggcctcagcatcccagcctggcagccacttgcagtgcctgtctgtccactgcacagacgacgtgggtgacgccaaggctcgagcctccgtgcccacctggcggtccctgcattctgacatctccaacagatttgggacattcgtggctgccctaacttgaatgacaagaaagatcccctcctctaccaggcccttcctctccccctgtctgtttccttccccctcaaccttaccccacccctctgttaatttgaaagggccactattgctgagtggatgagttttttttttttctctaggttggtacctgcttagtggcatatggaccggaaagggttaatttaaagggggggaacctcaaaagtttttttaaaaaagaaacttgtctgccacagtatgttaccagtgttaacccttctgcagttagcaaacttttgcttaagcctttttcctctagatactccccatgtttcggtaatcttggcatacattttttagatgacctctttccttgttttgttttcatgctgctgtatgtccaagtattgttatttcataataagacaagagttgctttcttttttattctttttccttttcttaccccctccccttttattttctttttgctttgttcactgcttattaaaatggaaatcctggagaatagtagttctggaatattgccgggtgaaagtccaattgtcatcacaatgttatatattgacaccccagtgtcatcagtcaggcaggagccaaacaatgaatgcccctcttaggtattccgcctgggattttgttttgtctgttccctaagaaaatatattttcattcctgcaaacacagtgctcagccttcagttcccttccacttgagttctctcttctcctgctggaagccgcccctctctgcgatggacgtgaggacgtgtccagctctgctctgtgggaaggagttggaatgttcgacagcagtgttttctctccttttctgggcctcctcgcaaatgcccaggccctgcattttcacgctgtgctaagcagcctttggtctgcatgggggatggtgtgctcccagcctgcagtctttggagcaaggctgctgcccgtgccttgggtgctggagttggaggaggctgttctcagccctttcccttttctgaaagctgttcctggccgggcatcccagggaagaaggaggggactgcgtgtatctcctccacctctcccattccatccccagtccagcctgggcaaccccacccctgggagggatgaggcaccctcttgctcagcctgctcagccttctctgagcctttgcagggatctgcagactcctgagggctagaggacagagaaagagaatagaatgaaatgactttgattcctgcgccttttagttttgaactctggaattcctctgccccctccccaacatttttttggaatctcaccctgttgcaaaactagagccatgtcccaagcatctcacaaaggaataactgctctgagcagagatgagtggtggttggcaggggcaggcaactttgggtgctgctgatgcctgcaaaagccatttatggcttgtggtggggggcacatagattccccggtgggttagacaggaagtaactgatatcacttcacccaaatatataaccgtgatggttatctatttaatttcagtttttgttaacgagcgtgtcttactaaaacgctccactttgagctcccccaccccctccaggtcctcagagtttgcagatctgggctttctaaagcaagtgacctgaaggctctgggctcaccatacaacacccacgttgtttatttcaaagaacttttcagcgaagggagaggagctttcagaaaaacctcactctttcccctcccttctcccctctttccttctgccggtccttttggctggggtctgagtctgcggttctcgcctgggcagtcttgacgaggagcaaaccccgccttcagagggcagacaaagcaggtggcatgaattgatcagcgagaaaggtgtgagccgaggcagttcctgcgttctgctacaaaaggaatggaaagggaagggaatttccccccaccatgggctgtgggagagttgaccgtattctgggcaagactccatgacccctctgattctgcagtgtacagctgtttgagagcctcatcattttacttttgaaacaggaatgatttctccttaattgcttaaggccggggagcaaagtgtcttaacttctgtctttgactttcccagcgttgagtcatcaacactttgccaattagctcatggtcctggcaacctcagaaacccctgaagttttaaaaactttctcgctccccacgaccccagaatgaaacagctttaaaaatagccttaagcaaaaggatgttatttcattaaatttggtttaatggaaagaataaaagtaaatgaaaaacacaccctacacactagactccgaacactggtaatcagtactgcatagcaaactctttgggaaagaaaacgaaaatgttattgcacatgtaaaatatgaaaacttaactctgctgtgtgttaggcaatcctgtaatcttttttgactcttaaaagaaattcatttctgaaatgcttggttggaagactgtgacaatagctcatgaaattgagtgttatttttttctttcttttttaaaaaaatatgtaaagtgcagtcttctgtattcctgcatattgtatatacctgtatatgttttcctgagcagttaaataacaataaatatgacgttaatggtgactgtggtatatttgtgggtggggctcgctttctttgtttcctcccaactctatcccctttttacatcagtctcttcagattctatgggacgtaggggtgtaggtttggatgctgtagtgggtgtgtctgtgtgtgtgtgtctgtgtgtgtgttgatgttctaagttgggtcatttcagtatttctcaaccttggcactattgacattttgggcctgttaattctttgctggagtgtaaggggggcaactaggcatttgaggaggttgaacggcattcctggcctccacccactagatgccaaaaaaaaaaaaaaaaaaaaacctatctaaacattgcccaatgtctccttgggggaaagatcctttgggggccaagaaccctgtatctgactcatgtaggagggagggggcaacggaagtgccccccccagtggctgtgtagggtgatgcttatgcttctgggttctagtgttcagtttcagatcctagtaagcctgggaatctcctgcaagttatgcagcttctcagctccaccttttcctcatctttgaaaggggtctagctcgtggggttgttatcggagacaatgcactggacacaacatgtaggaagggcttcatgtgcataaagcgtcagcatcagcaccataatcttaccacagggcagccgatggcggtctggagtcacgctgtcctggggcgcatgctgcttcctccccttacagccatggaccttgggcaagcggcttaactacagcccccagtttttttgtttcttaagtggagcaagtaacatctagctggaagctcactgtgagcaccagccctgtaaaaggatcggtttgcctatgggccactctttgggcagtggcttcactccggcatctgcagcctcagacctgaggccactgcagaccattcctgtccttcccttttgcacctttacctctcagtgtttctcaaagcatggtccacagaaccctggccgcagaaacacctaagggctcttgttaactccagatttctggccttgtgctagactactgaatcagaacctctgaacttgtattttacacctaattataacaggtgcagttaccttctttcacagcccacagcagatcagagggctaatgtaggtgggcgcccaatgccaggttggagcgggaagatgagtcagaaatgatggcggcagattgagagctgcagcgcggccattcagtgtggaggcaaacagcttacacgtgtctccaatgactctaccctggaaaacatcacactaaggcagagtgtgaacagaagctccccagactggcattaagctggtaaaacgtttaattacatccaggaaattccccatctcaggagcaaagaacacatttaggaagattacctgccatagttactttgtcactggggctggaatcctgagtggaaaaacctctgcagtcactgggtctccgggaggtaggcagtgcactctctctgagcctcagttttcttggctgtagagtggacagaaagagtgttatgaccccacagagctgtctatgggaagactcctgagcacagtgccaggcacagaggggaaacaggcagtgccagcccctttctgacacctggtgacacctttccattggcatttggtaggacacatcttccagaccctccagagttagacatgctgcttccacttcctgtgacccatctacaggatagaatgaccatggaggaaatttgcttccctgggactgactcagagacctgggttcccacccctcactggtaaccaaaggacaccatacagatgcaggcaattcaaaccatttcattccaactcaacacatttattcagctcctattatgtggcagaaacggaggatccaggtaataaaactgccatgaatggagagccacactcagtactaggcactttacagactcatattatctcatttaattctcacggcaacctcatgctggggcagattcatccca

SEQ ID NO: 16513 - DNA, 177293 bp, Human
atggtgctaacatttgtctatgaacagatgggaaatcttgctgaggaaaggacaatgattctcaagcaaaaggggaaaagggagagagaaaagagagcacctggaactcaagagtatcaagaatgggaggtggcaacaggatgatttgcaaataatatttggctatcattagaacaataaactcttcactatacaaggttgtatggtgtattggaaagagcatgaaatcagagaaacttcattagacttcaagttttgctctatattagctgtgagattttgcctaagacaattgaccattctgattccacagtctttatacatgcaaatgctaaaacagttgtaacagtggagatacattgtgaaaaatgtgtcattgtgcaaacaaaataggatgtacttatgcaaacctagatggtatagcctactacatacttaggccatatagcatagcctattgctctgaccaccatcatatatgcagtctgtcattgacccaaatattgttatgcaatgcatgactgtaataataataatacttgccacataggtaaaaatactgtcattaacggtgtagtaaaatggtaactggcatagtaatgctgtaaattgaatacaatttttagaaggttttgaggagggaggttcagaactgttctccattgatttgcttaacaaagatattttcattttccaccaaagggtttggctgtgaaaacctttgcagaaataatattttaggagttttttccccctgtactgtcaactgatttttagtaagcatatgactttctgtatgtatcatccaattgatttaaaaatgaatcaatgaatgtatttattgatcgcctgcctcgcttcacaaaggaatgtgaggaaggacacccaatttggcattgctgtgtttctctgtatttgggtcatgcattttttcttgctttccacattgaaaatgtggtggatgcagtagattggctttaagtgtcaggccttccctcatttactatacctttttgtgtttcacaagctggaaagctaccaactacatgctctagacatccttgctgctaatattctgcatgtcagattggtctcaccaatggcacgcagcaaagcaagatttgcaggtgctgttttcttgctgctggcaaatgcagccgtggagaccaccgttttttgcagcactgttccagtgtcctgttaattgttctgtcggtgttgagaggaggttggggaccaggcatggcaacttcctgacgccatcttcctgattgtgggcagcagccacaatcagcaatcttatctaggtagtcatccatggatgttcagctcagcccttctccagcctttccaatgatttcgaatgtccccaattccccctaacgaatccctttctgactaggagtaactagctgagtgctgcaatgaaatcctgactgacagatttgtaaactctttgcgggcaggaacccttgatataaataaatgaccttgcattttaatggagggaagcagaaggataaacaaatgaataagtgaaaagttttaataagatggtgatgcgtaaaaaataaagctggttaatggggagtgcaggaaatgagcgcagctgtcttgccgttttaatcagataggtcagagaaggcttctctactagggtggcttttgacctgcctctctgttaggtcaattgtgtgcgaggccctgatggagttactgtgttaaaatgcaatgattcaattactccattacttagataccctttaagtgacactacggttgtccatctccccgctattgaattgtttacccacagtaagcatggcgggaagagcttcgatccgacccttgaacgctcaataaaaatggcgacagcacttcctgtacttgccctcaacaaagatggtgtcaacacttcctgtttagggttttcgccattaacaaagatggtgcttatggggcaggttccctaacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctggggtgtgtgctttttttgaaagaaaaaaatcccataaaatgtcccatgcatgtgcggccacgacagtgttgtgctggagattcggaattcttagtgggaaggaatggagtctgtgactgtatattgtgtaaagtttattgtagactgggcacaaacaacaattttcttaaaggtgatcgtgtagaggacttttagcgaaaagagccttaaattctgaacctgctgatttctgtcctgcactcctattactgatcaggttttgcaaatacttgtgatcaaaaaaaggggacctgcgtccaccttggcagtttctgccttggtggtggtggtgcaggtctgatgagggcaatgtgaaaataaaaccaccatttcttctccagcgtgttaaaattagtgctgctctgtaatcttcagataaaaattgcttgttcagaagggtctctgacccactttttttttttctttttccaaatttctttattgaacgaggaattgagctgggaccccattgtgtgaaaagcagaaacagaaaagatgattcatcttcattgttgttcattatgttaggaaacattcaaaattaacctggcttggcttaatcagtgaattaaataccatgacctggcagtctgctatggtttaaagatgtgcttgacctgaaggaacttacattgcagtgacactgtctttagggccacatcaacatgtctgtaatttgagctgtgattttggctctttccagggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatactgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatgactttattgaaagcagaatagataacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttaagcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaattgagtaattttagtaagatttaaaatagtccacttaaatttttgtaaagatatctttgagttttgaggatctagactataggagaatgtgtgtacacattaacctcttaatgtatgtacacattaaactcttcctaccttttcctcattttgatcatacttattaattaatttgtatggattcagtagtctcttgggaggccttgagaacaaatgggaaggaatggccttcttttttagccaagacgttgatccttctctaagaatgaactgattttatcttattaaggttttcttgtgttggtcttcccagagatgcttggtttcccctttattggtttgttgttttaattttcgttgtttcacttgtaaattttgagctgtctcagaggctttattttggtgattgttcctggttagttgctttttacttatgtgctggatgtaatttgtttagagaattgagctgtatcttgttcttctctactcttctgaacgccacccccatcaaatctcaaaacatacaaaaacaccctaaaccttttgattctctcagaatctgcctctgtgactagtctcccaatctctgttaggaaaaaaaaaaaggtttaagttgttaaagttgttaatggatcattggttttgtgtttttctcaccctgtaaggactcttaccttttaaaagaggaattctggtgataaaatgacttaatccaccttggcaccgtggagagaacacttcatggtttgtctctctggccaaggtcacatactagacattagatcagctggaaatcctctctgggctcctgtcaggtcatttaggagatagggacagtgccgtgtctgggtgaaggcagcctgtgcctgcctgcctggcttctcactgctcatggggcctgtcggcactgacaggctccctccagtgcctgagctaatctggatctggaaaggaggttgatggcagcccagcctccccatctggtgggactcagcgtaaatcacggtgggagtgactcctgggccacaggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagcaagatggagccatatcctggtattatgaattttagaactgggtgggactcacaggtcatctaatttttctctgagaaaacagaggcctagggagattaagtcaacttgcccatgatcacacagctagttaatgtaatttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactgtgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctgagcccttcctctaggacaccagaatcacctgaagtggggaaaggaagttccaaaagaaagagtgaaagctgattgaagcaagagttgtctactgtgccatccttcttctttttggattgaataggtctcacgcccatgggcctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagtcatgtgctacgggcaaatgtgacttttcaggcctttcatatttgtttgagcccttttattccatcatgtgccagtcacaattcattcaggagacagaaaccacacagtaatttaaacagggaaaacttaatataaagaattttcttttgttttcttttttttttttttgagacagagttttactctcgtcgcccaggctggggtgcaatggcgcgatcctggctcactgcaacctccgcctcccgggttcaagcaattctcctgcctcagccttccgagtagctgggattacaggtgcccgccaccatgcctggctaatttttgtattgttagtagagacagggtttcaccatgttggccaggctggtctcgaactcctgacctcaggtgatctgcccgccttggcctcccaaagtgctgggattacaggcatgagccaccgtgcctggccaatataaagaatttttaactggtgaaaagcaaaccatggttaaccactaaatggggtaaaagaggtctctaagtaatacaggaatggcagaagctactttttctgaggttgaaaggtagtgcaggatacagtcactaagaatgtggaagagggccctccccacctctaaggctgagattcagacttcggtggagttgaagtgactgtcacactagctggtctgtaagagcagcctacctggtagctaacttcaagaaaatccagagaaataattgcatgaagtcagaaaagtaataaatgaccaaaatgagaaattttgaaattatttaaaaaaatcaaatagaaattctggagctgaattaggaaaaataactaatgcatgtgggcttaatacctaggtgatgggttgataggtgcagcaaaccatcatggcacacatttacctatgtaacaaacctgtatatcctgcacatgtagtccaggacttaaagtaaaaattaaaattaaattctggagccgaaataaaaattaatggactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatactgtaatggttgtatgtaaatcatttacatctttagtttgaaggttaaaagatgaaactattaaaatggatataacaacttataaagtatatacaaaacaaaaagacataaattgtgccatcaaaaactaaaatatgggggtgatggtggagtaaagtgtagaatttttgtatgtgatcaaaattgagttgttatcagcttaaaataactggctgtttataaaatgtttttgtaagcttcatggtaaccataaaacaaaaacctatggtatatacacaaaaaataaaaggtaagggaccaaaggatatcactagagaaaattacctaatcacactggaagacagccagaggaaggaaagaacaaagcatctacaaagcaaccaggaaacagttaacgaaatggcagaagcaagaccttatcattaattaccttgaatgtaaatggattaaattctccagttaaaagacagggtgtctgaatgggttttataaaaagcacaagacccaactatatgccatccacaaaagattcacttcctttttaagaacacatatagagtgaaaattaacgggtagaaaaatattttccatgcaaatggaaaccaaaagagagtaggagtggctatacttatgtcagaccaagtagattttaagtcaaaaattgtcaaaagagacaaagagggtcattatgtaataataagggggtcaattcattaagaaggtataatagccgtaaatatatatgcaccaatcactggagcacctaaatatataaatcaaatattaatagatctgaagggggagacagactagaatatagtaatagtagagaactttaataccccactttcagtaatggacaggttacccagataaaaaaagtaataaagaaacagtggatttagactacactttagaccaaatggacctaacagacatttacagaacattccatccaatggtatcaagaatacatattttgattagcttagtaatgtataaggatattgagtcagtaatacaaattctcccattaatgaaaagcccagaacctgatggcttcattgctgaattctgccaaacattcaaagaacaaataccaatctttctcaaactcttctacaaaattgaagaagaggaaatacttccaagcttattttgtaaggccagaatttactttgatatcaaagctagataaggatacaagaatagaaaattacagaccaatattctattcttgatcaacataggtgcaaaaattgtcaacaaaatactagcaaactgaatttaacagcacagtaaaagaatcattcactgtgatcaaaggatgcaaggatggtttaacatacacaaatcaataaatatgacataccacattaacagaatgaaggacaaaaactatatgatcatctcaatagttgcagaaaaagctttcgacaaatgtcaacatcccttcattataaaatctctcaacaaattaggtatagaaggaatatacttcaacacaaaaaaggttatatgggacagactcgtagctaacttcatactcaacagtggaaaactgaaagctttttcttttaagatcaggaacaagagaaggatgcccactctcaccactcttactcaacataatactggaggttctagccagaataattaggcaagataaagaaataaaaggtatctagattagaaagaaagaagttaaattatccctgtttgcaggtgacatgatcttaaatataggaaaccctaaagactctaccaaaaaactattagaactaataaatttagtaaagttgcagtatacaaaattaacataaaaatcagtagtgtttctgtacacaaacagcaaactatttgaaaaagagatcaaggaaacaatcccattttcaatagctaccaaaagaaaaatacttaggaatacttaaccaaggatgtgaaaaacctgtataatgaaaactgttaaaacattgatgaaagaaactgaagaagacacaaataaatgggaggaaacctcatgttcatggattgaaagaattaatactgttaaaatgtccatactacccaaagtgatttatagattcagtgcaatcactatcaaaattctagtgacatattttatagaaatagaaaaaacaattctgaaatttatatggaaccacaaaagaccctgaattgccaaagcagtcttgagcaaagaagaacagaactggaggcatcatactaccttctctgacttcaaaatgtgctacaaagctatactagtcagaacagcatggtgttggcataaaaacagacacatagaccaatggaacagaatagatagtccagaaatgaattcacacatttatggtcagttgattttcaacaaaggtgccaataagacacactggagaaaggacagtcttttcaataaatggtgttggaacaactggatatgcagaagaatttagaccctcatctcacaccatgtataaaaataaactcaaaatggattaaagacttaaacataagaccaaaattatgaaactactagaagaaaacctaggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaataaaaaagaatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgcttgatcttgcacctttatcttggacttccagcctccagaactgtgagaagtaaatttctattgtttataaattacccaatctgtgatattttgttatagcagcaaaaatggactgccagttttcgtatttcaaaacatcatgttatacacgataaacgtgtacaatttttatttgtcagttaaaataataagttaaataagttaatttaaaaaagagatagccagtgtttataataaatgaatcatcttaacatttgagtttttgctgtaggggaggaaaaatctcttttcctcattcattctaggttcatgactgaggcccttataccaaaggacagataaacaagagcaagcatagaaatttatttaatataaattttacatgacacaggaacttttataagggagtgaagacccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacaccagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaacttttcctatgaatatatatcattatctttgccattttttgagttagattttgccagaagagatttgtcataccagggccattgaagcttttctttcatttctaaaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatcttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaacatgtactagcagcctacaaagtgaatggaatttcagcagagcatgcagcatgaaggagcgatctcagcggggaagggaataaagtagggagtgcttcgaaggtgaatctgggttttatggaaggtagagtcattggttccaggggaagaagccagtccagatggaggagacgccaagtacttccctgacatctcaggatgccttgctagaacattaaacccagcatgttgcagatggaatgagtttttctcactaaatctaggtcctgctcctgccctcagtatttccgtcaatgtcatggttttctgagttatgcacctgccacttactttaggcttttattgcttctccaaactactttgtaactggtttgcctgtacagagaagctgccagatttgtcttccaaagctttcttcctatcactgtgacccctgcacaccattccagcatccattgtgccattctctggagagctgctcttctgcatactagccaaatttgtcttccttcagtaattttttttttcttttgagatggagtctggctctgtcacccaggctggagtgcagtggcttgatctctgctcagtacaagctctgcctcctgggttcacgccattctcctgcctcagcctcccgagtagctggaacgacaggcgcccaccaccatgcccggctaattttttgtatttttagtagagacggggtttcaccttgttagccaggctggtctcgatctcctgacctcgtgatctgcccgccttggtctcccaaagtgcttggattacaggtgtgagccaccgcatccggtccagtttgttttttaatgtgctgtgctgttgggttttgtttgtttgatttttgttttgcctgagtgtctttgcctatagtgtgaatgtttttacttctctctttgccacgttaactccagttcctcctttgggctttagcttaggtgttttttcaggaagccttcccataccttctatgttggattaagtcctctctcatgcgcttctgagcatcttgcacctcctatttggtgtgcttctctataataggttgtaacttccagagggcagggacctagtgctattggacaaatggcaagtgctcaaataaaagatgttgtttttttcttaaaatatatttaaattttcctcattgtctacaaaattaatttcagacatttttaaattcatttcagaccttctgtaatatggcccgaccttatctatattaattattgaattagatttggcaacatttaacagaaaacccaaatgacagtgattttaacaagatggaaggtttatttttcccttctcctcctcttcctcctgtttctcctccatatccttctctctctctctctgtgacacacacacacacacacacacacacacacacacacacaatctgtaagtagtctccagggctgtgggctggtgtgactgctccacagttaccagaggccaaggcttcttctctctttatgctttgccatccttggcacgtgatttccactctcaagattccctcatggtcctaactggctgctggagccccaggccatcttgtcccttgtgggaatagtgctagcagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgtcggatgatcttgatatctaggctttgaatctgggcttggcagggtaggtgcatgagccctgaatataagggagctggcctagggagagaaaaaaaaccatcacttcaactcctgtcttccagggtgttgacttcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagcgatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtgaaattttattacctttgtagattcatacatgcttttgatttttaatgctcacttaccgtcaaattatttggagcctttcttttttttttttttttttttttgtagagatgggggttccaccatgttacccaggctggtcttgaactcctgagctcaagggatctgcctgccttggcctcccaaagtgctggaattacaggtgtgagccaccacacctggcctatttggagcctttgtgtgaataattaataatagcaaaactggaaattatttaatctggaaatctcaatttaatactcttaacaaaaagactactggattagaaagtagaaagtcaggttctaattccagctcttcaactaggcagttaaacttctttggttaagtcatttacatatttggtacatcatgtactcatctctgaaatgagtgagctaaatgaaacaaatcttgatttccactttcccttctctaaacatccttctgtgtactgtattttaaaaggcaccatctgtattttaccacattgttctagccaaaaacttaggcatcatccttgtttccttctttgctgtacctaccctctttccttctgtatattccattagcaagtcttctacaacattccccaaatctgtctacttgagtccatcccttgcctggattactgcagtagcctccacatgtactttcccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgttgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttggggtcaggagggggtcagggaggggagtagcattatccttcacttttcattgggagaagaaacaaaggatttgaggccatcattaatggctagtgatgagatcacatcagaatagcatttatttaatagcaatttattactctcctgaggttcaggtggcttaaagtgcaaatattagtaggtagttccatgtaagggaatcccattccaagtggcacagccttcatttagacaaaactctgatgtaattcattctagtcatttgatggatggagactctaaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgcaaaccattttgcgaatatgtaagcattgtaatagggcttgcacaggaagtgatttatttttttctttatttttaacttttattataggtttggcaatacatatgaaggtttgttaggtaggtaaacatgtgtcacagaggtttgttgtacagattatttcatcacccaggtattaagcccagtacccagtagttatcttttctgctcctctccctcttcctaccctctcccctcaagtagacccgagtatctattgtttccttctttgtattcatatgttcttaccattcagctcccactaaaaagtgagaacatgcagtatttggttttctgttcctgagttagtctgctaagggtaattagccttcagctctatccatattcccacaaaagacatgatcttattcttttttatggctgtgtagtattccatggtgcatatgtaccacattttttaaatccagtttgtcattgatgggcgtttaagttgattccatgtctttgctgttgtgaatagtgcttcggtgaacattcatgtgtgtgtgtctttatggttggatgatttatattcgtctggctatatacccagtaatgggattgctgggtcgaatggtagttctgcttttaggtctttgagccatagtactttccacaagtggttcattttaactagaatagctggttcatgactggtggcagttattggagaacttgcctttcttgaaaaatattctgtactataccatttctttgtcttttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacaccggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaagaatgattagtggtgaagtttgctgacagtcctcctcagtatgcttagatatttgttagcattatcttttcagtaaaagataggtattattagtgaagtccaaggcctttgagtattatttgaaccctttggttttgagctatgaattgtttatagagtgaattgcttgaacattttgggctttattgagccacagctgaagatgatcattgattgactgcccccctccaccccaccctcccacccccgcctttttttttttttttttttgctttacttgccattcatattgtgttgtacatgttcctctgggtatattagaggttgaaatcaaaagccaaaggaatctgaagggggtcctcagctcttctctgggtcttactgtaacctagagcaagtgactccatcagcaggacaagtaaactcaggaaaagaagcaaaaaggaaacaagccagttgctctgggctgagataatgttaaatggcagagggaagcttgagttactcaactgctgcttggcttccatcttcactgtccttgtttctctgattcaattcttgcttcctacagttgatttcccacataggcaagcagagggatcttttaaaaatgtaagtcagatcatgttattctccagcttaaaaacccgaggggggatttcattgtacttgtaataaaatccagactcctcatcataaattagctcccactcttgcctctttacctcttctcttactcttctcccctccctctttatcagccacattttatttctttctgttccttgagcccttgaggttcattctgccaaattcatcccattttaggggttttgtacttgctgttccctctctctggaacactctgaccctagatctttgtgtggctggttcttcattcaagcctcagcccagaggacctcataaaaaccttttgtaccctcctagactctttttttttttttctggagacagagtctcactctgtcccccaggttggagtgcagtggcacaatctcagctcactgcaacctccacctccccagttcaagtgattcttgtgcctcagcctcctgagtagttgggattacaggcgtgagccaccactcctggctaatttttgtatttttagtagaattggggtttcaccatgttggccaagctgctcttgaactcctgacctcaggtgatctgcccacctcggtctcccaaagtgctgggattacaggcatgagccaccacacctggtctcctagactcttaacagtgcactagacactcgccctctcacagttcctatgttctgtttttttctagcactgactgttctttttctctattttctcatgtataaaggtggggttaatgaaagaggtacatacttcgtagagttgttaagaggattaaactagttactatttagaagagtatctggagcatgatattgctctcaaatatagctttattgttatatcattctttactacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgatccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaattgattttttttttcaggtgactactgagcttggtggcagaattgagaataaagactccctgacttcagaccagtgttctctctgttccagtagtgttttcaatctgggaccatagagctgctcaaattcaagcaaaatagaatcttttttgtgtgtgtctttattttgaagatcgtttttttttaaagccattttcaaaaacagtttttcagttggggtacattgacctctgaaagttctaggacacagtctcaggagcccatgagatttagttctccttcccaccacttcaaaagaggtctgtgcggtactctaggttcagaaacttggcaccatgatattttgccagtttatcttattaactgaatgctgtctgtagtgactctgcagaaaacagtgttatgttcttctgtcagacttgtgctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgacacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagatcaggtggttaaaagtaatgcctttccaatcctgagaatttgtgacttgatgaaattgggcaaagggctgattttacagctacatgaaataaatggattccgtgggcaggagaagaaagcattttatttcactccctgtgcttttcctttaaactttcacatgagtattttccagttgaggagcttttgcattcttggttacagaaagatgtttgattgtctaatcccagggaatctggtgaacagtgtatcagttaggaatgtgcttggcaacaagtaaacaaacaaacaaaccaaagtgacaatggcaaataagtagagatttattttaatcctgtaacaagaactctggaggtcagctgcttctggcattgattcattggctcaaaggcatcagagcgagtgtctctgctattctcttggccttccttttcctcgtagtagcaaggcagtcacagctaccaacagcacatccgtaaggctggaagaggcacggaagttgctcagcccctactgcgtctgtcactttttcttgggaaaagaagtagtctttccagaaatcctcaacacaattcctcttctgattcattgggcagaattgtctcatggccactccttggtacaagggaggctgcaaagtgaatgtttgctcttctagactctacgattgagacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttttggtaacagccctttatcatatgtgtcctctgcaaatattttttctagtctaactcatcttctcattctcttgacagtgcctttcacagagcacactttttaattttaatgaaatctagcttatcaattatttctttcatggatttctgcctttggtgttatacctaaaaagtcatcaccatacccataataacctagattttctcctatgttatcttccaggaattttaaagttttgtgttttacatttaggtctgtgatctatttttaatttttttagagtttcgctctgttgcctaggctggagtgcagtggcatgatcttggcttactacaacctccgcctcctggggtttaagcaattctcctgcctcagcctctcaagtagctgggactacaggcatgcaccaccacatctgggtaatttttgtatttttagtagagatgggatttcaccatgttggccaggcaggtctcaaactcctgacctcaagtgatccacccaccttgggctccccaagtgttaggattacaggtatgagccgccgcacccttcctgtgatctattttgagttaacttttatgaagggtctaacatctgtgcctggattctttttgtttttttgcacgtggatgttcagttgttccagcaccatttgttgaacggactgtctttgccccattgtattgcttttgctccattgtcaaagatcacttaactttgtttatgtgagtttagttttgggttctctgttctattccattcatctatttgtctgttcttctaccgatatcacactctcttgatgactgtagctgtacattaagccgtaaagtcaggtagtggcagtccttaaactttgtcctttaacattgagttggctgttctgggtcttttgcctctatatataaactttagaatcagtttgccagtatccacaaaatagtgtgctgggatttttgttgggattgcattgaatctatgaagttgagaatagctgacattttgacagtgttgagtccatgaacatgggatatctgtttattcaattcttctttggtttctttcaccagttttgtggttttcctcatatagatcttgtacgtattttattagatttatacctaagcattttgatctttgggggggtgctaatgtaaatggtaatgtgtttttaatttttaatttcacttggtcattgctggtatatggggaggtaattgacttttgtatattaaacttttattctgaatcttcttataattgcttattagttccaggaatttcttgtttattcttttggaattttctacatagacaatcatgtcatctgtgaagaagacagttttgtgtcttccttcttaatctacataccttttgtttctttttcttgtcttattgcaccagttatgacttccaatttgatcttgaaaagcagtggtaataacggacatccttgcctggttcctggtcttagtgggaaagtctcaattttctctctttttttttttttgagacacggtctggctctgtcacccaggctggagtgcagtggtgtgaacatggctcactgcagccttgatctcatgggctgaagtaatcctgccacttcagtcttccaagtagcttgaaatacagatgtgcaccaccatgcctgactaatttttgtattttttgtagagatggggttttgtcatgttgcccaggctggtcttgaactcctaggctctagcaatcttcttgcctcagcctcccaaagtgctgggattacaggtgtgggtcactgtgcctggctgactttctcactgttaagtatgatgttagctgcagggtttttaaaaatatgttttttatcaagttgaggagattcccttctattcctagtttgatgaaagtttttattatgaataggtggtgagttttgtcaaatgatatgatcatgtgatttttctaattaagtctgttgatgtgatggattagattacatttattgattttgtatgttgaaccagccttgcataattgggataaatcccacttggtcatggtgtataattctttttatacatttttagatttgatttgctaatacttttttgaggatttttgcgtttatgttcaagagagacattggtccatagttttcttttcttgtaatgtctttggtgttggtattagggtgatgctgacttcatagaatgagttaggaagtatttccactgcttctagtttctgaaagatattgcagagaattgttacaatttcttccttaaatgtttgatagaatttatcagtgaactcacctgggcttggtactttctattttaaaggttattaaatattgattcaaatgtttaatagatgcaggccaacttagattgtttatttttgtgtgtgagtattggcagattgtgtttttcaatgaattgttccttttcaggtatgttatcaaatttgtgggcataaagttgtttataaaacttctttatccttttaatgttcatgggatctgtaatgatgttctctttttcatttctgatattagtaatttgtattctgtctccttttttcttagcctgtctagatgcttactgatttcatctatcttttcaaagagcaaacattgctttattgattttttccattgatttcttgtgttctctttcgttaatttctgctctaatttttatacttttttttgcttttgcttactttggatttaatttgcttttctttttctagtttctaaaggggaaaacttgggttgttgatcttaggtctttcttctttcctaatttttgcatccaaatcctatgcatttccctttgctttagctagaaactacaaattttgataagttgtttccatttttatttagttcaaaatatttttttaaattatcttgagaattctcttacccctatgttacttagaagtgtattgttttatctccaagtactttggaattttccagctatgtttttgttattaattttttatttaagtccattgtgatctgacagcagattttatatggtttctatatttttaaatttattagagtgtgttttatggcctaaaatgtggtctatcatggtgaatagtccacatgagcttgagaaaaatgtgtaatctgctgttgtttgatggaatagtctatagatgtcatttacatacaattgattgatgttgagtttatgtccttcctgattttttgcctgctagatatgcctatttctgagggatgctaagcctccaaatgtaatagtggattcacctcttttttcttacagttctatcagttttacctcatgtattttaatgctctgttgttaggcacatacacactaatgattgttacgtattcttggaatattgacccctttatcattttgtaacgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgttttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacgttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgcatcattttatataagggacttgagcattcatggattttggtatccactgggggtggggccctgaagccaatctcccatggataataagggactactgtacacataagcatacataaccaaatacattgttgccattattattttgaacaaactttgatctgttagatcaattaaaaaaataaacatttttgttttacctccacttactccttcttgatgctcttgttttctttatgtagatcttatttctgacctaacattattttccttctctcaaaagaacttcttttaacatttcttgtaaggcaggtctactgccaacaaactctgtcaatttttgttagtctgagaaagtcgttatttctccatcagttttgaaggatagtttcacaaggtacaagaattctaagttggtgggttttttcttttcctctccacactaaatagttcactccactttgttcttgattatgtgatttctgagaaggcagatataatttttatctttgtttctctatagccaatttactttttttctctgatttctttcaggaatttttctttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccagactggtaaactggctcatctggtcttttggcccgcacccaggaactgactcagtacaagaagacaaacttcgactccctatgatttcaacccaaccaatcagcattccctattcccgaccctgctgcctccaaattatccttgaagaaccatagcctctggatttttggaaaggcatatttgagtaataataagctcctgtcctcttgcttagctgcctctgggtttattaaactctttctctattgcaaaaacctgctgttcagtgcatcggctttgctgggcagtgggaatgatgaaactgcctggtgaatacagaagtgttctcttgtcctatgagtaggtctcagtctttgagtaagcctgtgcctctggactgtgaacttcacagtgtttctcaggttttatttcctcttaggtgggacagggtcgctagactcggctggaattatatgtttctgttcatcacatggaaggcttgagtgggctagagctgagaatttctcttccctccaggcccgttaggctgtgggaaaatccactgtcagatgaggctctggttaggtagcttctcctgaggacaggccttgttaggaagaccccagtgctctggcatatttcaaaatggttccttttccttctcctcctgctggaaagggatttttcttggggaagtttctgctccaggccgggtgcagtggctcacacctgtaatcccagcacttactttgggaggccgaggtgggtagattatttgagcccaggaattcgaggccagcctggataacatagagaaacccagtctctcctaaaaatacaaaaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtttagctgagttctgttgcccagttgtcaccaactactgcatatactccctagatatacagttgcatgttctcacactgtcctgttttgaagaaaaaaatgtttttaaaaagtagaaattgaaccaaatgccattactgtctttattgacttgaaaggccctcattccacccaatcctgccctactcctcttaccccaattcctttgtgaactactttgggaaatgctgctggtggtggtgtgtgatgatatttgtaagagcatgaaaataaaaagctgggaatatataagagattcagattttgctgaagcagagaatttgacttgtggagtattgtaatgcaaaatttggtgcactgttaatggaaagcatttgctatattaaacagtaagggtctattgtaggttgagaagctggggagatttattttaccatttagcatgtagagaatttgaataggaaagtaggtgtgtatagagtgcctgtttgtcccattcattgttggggtttatatatacctttctctcttaatcctcaaaactccctgcctgtaatgtaggtattttccccattttgcagataaggaagctcagacacatgaacttttccaaggtctcaaagctagtacatcgtggggctgtattcaaacccagggctgacttcaagacctattattcttctactgaattaacctgaatgcttgcaaagtctgtggctctaattgtttctgtggctaattaatgttcatgaactggtgaagagtaaatagtttagttttttttttttttttttttttttcttgagatggagtttcacttttgtcaccctggctgagtgcaatggtgcaatctcgactttctgcaaccttcgcctcccaggttcaagcgattctcctgtctcagcctgccaagtagctgggattacaggcacccaccaccatgcccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctcagtgctgggtacatattacgtgttcaatacatgtttgttaaataaatgaaacagtcacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaaaattacaaagaacaccataatattaaaaactaatgtcaatgtggagaaaatgttggctatatatatagtggccaaagggttattgcccatagtttataaagagctcttacaggttaataaataagagatgcattctccacgacaaaatcagaccaaagatatgaaaaggtaatttgcaagagaagaaatacaaatggccgctgaattctttactactactatatcactatcactactactagcaggtaccatttactgtttattgtctgccaagcactgggctagtatcatatcttgcttaagaaaatactatgagacaggtgcaattatttacattgtgcaatgaggacagtccaatttagggagctaaagcagcttgtcctagatcacacatttagcaaaactgttgcagcccagggctgtctgcctctgaaattcttgctcttcagtataacacggacctactgctcctatatatcagtatttgtataaaaagaaaattcagtgaaagcaaccagaagttaccatttgttttgcctattagattggcaacaattgaaaaggaatattcatagccagggaagatcagagtgtgaagcctgcactctcatatattgctgctggtagtgtcaactggcatgatttttctggaaggcactttggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctcggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggtgcaactttatatttgaaaaactccaagtcatatacacatatgccaagaaaaaagtctggggaggctgtgaaacacagtattgacagtggtataattattagtgttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactcttgtgtagcagttaagagggtgcattttagagtcagacagacctgggttaaaatccaggctctaccacttagtcgttttttgagctttggcaagtcactctagtctctctaagctttagtttcttcatttcaaaagtacagacctgacagagttgttgagaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtgtttcatttctcacaatcgcccctctcaccagccacactgaagaggtgatgtcatgggcctctgatgctgtgcttgcccccatcacccagccgtctggaatagctgctggaggtgcccagtgtgccagcactgaaggaaggcctggctgcttggcaagcattggtgatgctgtgacattgagttcctggggaggctgcctgctcaggtggactgccacatgctgtatgtcttgcttcatatttgcacaatatggtgcttgatgtgattcattcatccattcatccatcctttgtttttttttttttttgaggcagcatctcactctgtcacccaggctagactgcagtggtgatcaaggcccactgcagcctcaatctcctaggctcaatcgatcctacaccacagccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtccatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaatacagatatgaggttggtacccactaatcttaacaggatatatatatatatatctaaagtatataacatattatttaaaaactaatgtattatttaggttttattaaattatcctgtttttaggctatgctgatgggctaaatttgcctaaactcctgagatttagattctcatttattggcattagaggagttcctaaaaaaaaaaagctattaagattaaatatcataaaaatctttctaggaaaatataatcaaaagcatcaaggctgtctcctacagttagtggtttctattattttggttctcagagctatgacaatgtcactggatttcaagaattcagaaagacaaaaagaaaactcataattttgaaatggggaaagggaaagatcttggacatagtcttctgtttttaaaatagtcattctcattttaaaataggaaaaaaattatttttcatttaacaaagcaaaaaacccagtctgtacttttaaattaatgcaaacatcaatattttatagggagaacattaataatcattgtggagcccattaatcacaattctgcttttgatttattgtaaatatgcctcccattttcctcctcattaccaatcaccttctttaattataagagggctttcattaaaacttttgaatcatttattttggagcacctaactttagaagacatttattgatttttatagcataaaatacaaatgtttttattttagaaaacatcataaactaaaactttattggaggagtttggctaaagattcaaaaatatatagaagtaaaaatatatttaaaactgcacagtttttacaacagcatgtatggcatttggattcagaattttaactagcagtaacctcatctgtttagtaatgaattttaaaatagaaaaaaaatctgccaaaacagaccagttgtttattagctatttaactttgatgagctgaaatgagatagtgaagcagaataattagaacaactttttttctcaacatctaaatatttctctttttcattaacatttcagttaagtttgaagaaattccaaaaatgagattctcattaactaaaaggaattctaagggttataagccatctacattttttctatgacctgaagactttttttcgaaaaccaattttgggggaggattgtcagatttacctaaggttttggtttttaatttaaaaaaatttaaagaaactatcttagtgatttttgtcatcatttttatttgttgccatgattaatatatggaaataagataaattggattctatttctgtgaaagccatattcttaacatcaatgcctacctaaaaaatatacgagtcacacttgatcattcagaatcattttgaaattctctggtaatcttttaaaaagccagcgttgactagtattatgtggctagttatatttattacagcagtctagttattgtttgtgtaactatagtttttttctaatagaaataaaatgtctatttgcaggataaaaagaagtatgtatatttgatgattttgttgtagaaaatacttaataccttttaaaagctgtttgactttcggttttaaaacagctgtgtagcttggtgagtcctgcagattccggctttctctgtggcctttgagccaagtaattttttgcaacattttcctttgctttcttataaacactcaaaaattatacttgcttttcctgaaggccagctattaagttagaaagcaccaaaggtgttatgaaattgccctttattttttcgtacatcagggaggaatgatagattttgtgtatctcttgtgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggcaggaagccgtcaaggagaaggctttgaggcatctgctgttttgtttccagatcccttgtgttaatttaatgtttctagggaacccggctctttcttttttctcggaatccctgctctaggaactggtgagtgcgggggcgctgtgggagctgcagataagccagcgcttggccgggcacccgcgggccgcgcagcggggcagggaggcgcgcggccccagccgccctagggcgccggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaaccccctcttcacttcttatagagctgcataattcttaaagcttgtggtgacgggagggcacacttgcttatacgtccaaatttactgtttatggatctcgattactgttttctacttaaattctaatttttctcattcattaattttaactggacaactattcagaagtatgaattacatatgggcaaattctagtgctttgaaattactggaaaaaaaataaatggatgatcaacagatgcaaggaacagaaaatgtttggcttttaggggagttttatgaatactcttttggacttccccacttccttttagtaactccaatgtcttccagtaactctagcaaggaggaggcccagggagagaaatggggatctcacagtctcatactaggaagctgtgctatggggaagtgactggtggtctggagatgtgaggtagaggcataggcagcaggtatgttgacacttgaaaccagtacctcctcagcccttgcgggaaatgtgataatccaatcttagccatatatctcaggtgactctatatctgaaacgtgcaatgtaggtaaggtacttctgttgtttctcctaatttgtgactattttcatataatgaatgatggtcgtgggcattttggtatagaaggttttaattatggctcagtatttgtgtaattaaccaagtggaatgatttagagttctgatattactgaagtctttacagctggaagtcaatggatccatgccagtacattattaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactttttttaaaataaaaaggcactagtattataaactttaaccacaatgtaatgttattttatggaaaaacgtattgaattcctattaaggaagccaataagtcattgctgtattgcggccctgtagcaaaaatggagtgtttccatcaggctggagtcagagcagaaaaggacctcctctgtaacccaggagagagagggctcttgtcaggcaggtactggtgatagtattgggagacctagggctgggaactggggaggggcatgagacagggagacgggaaagcaagggtgagtattattcttttccttctcccttattcatttccctactttttctctttttttccttcctcttaatttttcttcttcttttttttttttcagatgtagtcttgctctgttgcccaggctggagtgcagtggtgcgatctcagctcaccacaacctccacctccccgcctcccaggttcaagtgattctcctgcctcagcctcccaagtagctgggcctacaggcatgcgccacagtgctggctaatttttgtatttttagtagagacagggtttcactatgttggccaggctggtctcgaactcctgacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatattaactgcatgcaacctttcaataatattaagtgcgtaacatctgccaggcactattctggggacatgatggttaatgacctagacaagatccctgctgtcatggaaacaaatgagggaactatgttggagaatagcaagatgagggtggatgggtgagtgagggctgtcagaggaagtgacactgaagctggcacctaaaggatgagcaagaattagccatgccagtagcctcctagctagagaggccagcaagttcaaagggccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggaggttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatcacttgaggtcagaagttcgaaacctgcctggccaacatggcaaaaccccgtctctactaaaaatacaaaaattagccagggtggtggtgtgtgcctgtagtcccagctactcgggagactgaggccagggaatcacttgaacccaggagaaggcgctgtagtgagccaggatcgtgccactgcattccagcctgggagacagagcaagactctgtttcaaaaacacaaacaaaaaatcctttatctttactttgctcctttcaggatagctctggaatttgaatctgctttccagagctttattctcaactgccagcctcatttttcatactgtagttacttaagggtggaggtagtcgggccggcaagtaactacctgcagtgtacttgagaacctttgaaagcatctgtacttgccaagggtggggcatgtatgcttgagagccctttaaagcgtctttacttgctaagggcgctatgaccattcccattcctgggacttcattcccgctgggacctcattccccagtggagggtaaagcatggcttttgctgacggtttccaggtagccttccaaagtatgttagcataaaggactggagatgctgaccatctggctaactcatgattcagaagccctttggatccacttataaggccattctatttaggcctgctaaggatgtctgccatgctaatgtcaaaagcagggattttaggttatgttagtgatcagtgaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactgatccactatcatgagaacagcgcaggaaagacccgcccccgtaattcaaccacctcccactgggttcttcccacgacatgtgggaattgtgggagttacaattcaagatgacatttgggtggggacacagccaaaccatatcaaggagcaaagtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaaggtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaagaggtggtctcccacaactttgggcagctctgcctctgtggctttgcagggtatagcccccctcccagctgctttcactgctggagttgagtgtctatggcttttccaggtgcatggttcaagctatcagtggatctaccattctggggtctggagggcgtggccctcttctcacagctctactaggaagtgccccagtgggaactctgtgaggggctccaaccccacattttccttctgcactgtcctagcataggttctccatgagcgctccgcccctgcagcatacctctgcctggacatccaggcattgccatacattctctgaaatctaagtggaggttcccaaacctcaattcttgttttctgtgcacctgcaggaccaacaccatgtggaaactgccaaggcttggggcttacacccattgaggccatgacccaagctctaccttggccctttttagccatggctgggacacagggcaccaagtcctaggttcacacagcaggagtccctggacctggtccatgaaaccattttttcctgctaggcctctgggcctgtgatgggagagactacctcaaagatgcctgacatgccctggagacattttccccattgtcttggcaattaacatttggctccttgttacttatgcaagtttctgcagctgacttgaatttctcccaagaataggggttttcttttctgttgtatcatcagcctgcaaatttttcacacttttatgctctgcttcctcttgaatgctttgctgtttagaaatttcttcctccagatatcctaaatcatctctctcaagttcaaagttccatagatctttagggcaggggcaaatgccaccagtctctttgctaaagcatagcaagagtcacctttgctgcagttcccaacaagttccttatctccatctgagaccacctcagcctggactttattgtctatgtcactatcagcatttttgtcaaagccattcaaaaaatctctagaaagttccaaactttctcacatcttcctgtcttctgaggaagacattttcctatcttcttcttagccctccaaactgttccaacctctgcctgttacccagttccaaagtcgcttccacatttttgggtatctttatagcagcacctcattcccagtaccagtttactgtatcagtccattttcatactgctatgaagaaatacttgagactgggtaattcattaaaaaaaaaaaagggtttagtggattcacagttccacatggctggggaggccttacaatcatggcagaaggtgaaggaggagcaaaggcacatcttacagggtggcaggcaagagagcatgtgaaggggaatggccctttataaaaccatcagatctcttgagacttattcactaccatgagaacagcatgggaaaaacccttccctatgatttcattacctcccaccaggtccctcccatgacatgtgggtattatgggagctacaattcaagatgatatttgggtggggacacagccaaaccatatcagatacagttcccaaatattgccttatccctcacaaaggagtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccatctttagaacaattctaaagaaagcagaaaagataaagatatcaagtcataaatgtatacttgtttattgagcatggtttaaaattttaatcagcctacaatcagccctggcatccttgattccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaccctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttctgtataggagtagaagaaggaggaacaatccaaagaggaaatgggtccagtgataagagcttacaagaacatgccatgtaggcacaaaaccttaacttcttggcacatcaggtatcagggaacttccaggcagtgcaggacacacaacctcctagccttcatccacactggaaggtatctctcattctcctggcacacctacaggtgggaagtcttgagcactgtcttgaggctgaacccgccactgacagaaatgattcagtttaacagaaaatcagttaatttatttgccagtctatttgttcacttgattaccattgtcatggctgagtgaaattttcatttaagggatgaatgaattgtaaccttttaagcaccatcacttaaaactatccaaccacttttgttggaaaatttactaaaacatacgtatatttccccatcttcttaataaagcattagaagattttcgtattatctcaagatcatttgggaaacattgtgctgttatatagtagtacacttagagtctactccaggtagagttttcattatgccgaagaccatatattgtattttttgaattctcatgcctgtttttcttggttttactgtcttctctctctggtaggttatgtgttcattttctagtgctgcctatgtggctgccccaagagtctccaatctcccaaaacatactgtccctggttatctgtagaaaaatagatggccaagtttattagattcatctaaaatacaaaggaagtttaatgtatggactttgtgatacccacaagcctcctgtttcatctctcccatctctagttcttctcagcagtgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagactaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacatcagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatttaagggcgcttgtcttcattggtttgtttgccattcattcattcattcattcattcattcaacaagcacccactgcataccagcactgttgtagggatgtttatcctgggtgagtgtgagaatcgccttactcttcaggtgcctccacagttctctgctgatttctttagtgatgatttgctgacactatgcacagtggtagaggtggctttagcagatattggaagggtgccccagaagaagtgagtgacatttgagccaaaacctaagtgatgatcaaggggaagactggttcaagcagaggggcctgtaaagccagggctgtaaggtgggcatgtgagatagggagaggaagccgctgaggtaggagtctagcgaacagggtgagaaggggtaggagatgagactgggcaggctggcagtgtcttcaactctggctgcactttgcagccattgaggtggctcaggccatatcacagaccaattcaatcagaatctctgtggacccagacatcagcattttaaaaaaattctccaggtgactctaatgtgagtttagatttggtctgattacactgggaagctttggaagagaatgatagactcagcttttcattctttaaaaggttgctttgaggctgtgtgtagtgtgaagggtacacgggggagaaggggaaagggtgtcttcaggaggaccagttaggaggctctagtggtggtttgagtgagagatgatgatggtggcttaaacaaggctggcagtgaggacaactgggagaagtggtcactttcaggaagtgaggaatgagattaagagagaaatcaaggatgactcgttgtttggggaccagaacaattgggtgggtggagtggccatttatagaattagggacgacgaaaggaaggtggtacaggtgggaggaggatctgcagacctgggatgtcatctcattcccattatcctgggctcctagaagacacagctcacacttcctacaactctttaagttcatacctctattatagcactagtaggctgcacattgcctaatatggactctctgccttattttcagcaaaattcactgtgtgaccaaattggtattatgagcactagtttcatttcatgacaaataggaatagagagaaaattctcaataattttcccagctttaattctctgttgctcagcatgctttgagccctgatggatttctttggatttttcagaagaatcctgcctatgctttaatataaaggaggatgaatacggcagattcagaaaattgtggtgtcaaaggatgagctttgctttcctgccatcttctgtgctttgtttccttccaaccttaaaggaaatactaccctacttcaataaaaaactaaaacaaagattcaactcagcagaaggaagagcccaataagcttaaaataaatttgcaaaggctaataactggaaaccttttttaagctaaataaaagccttgtgtttaaagtgatagtctgccttttctggtctgcatcatgatagcttctaaataaagaaaacgggccgatgttgtgagtaattgcagctgctactctgggggttacatcaggcaagtgatttgtcaataagaatttattgtcttcatttctgggatgaggctgagggcaataaggaattcagaaggctgcttccttgtctttaaggggtttgtagtccattggagagatatgtctggctttcttgaaccagttaacaaacagttacattagatgtaattggaagctaacttatagagatgagggcagtagacattaaaagaaaggagaggtcaggcaggaaaagccatgaggtcagtaaaggcctcatgggcaatagggcttgcctggcaaatatttggctgaggcaagttggaagttgagctggaccttaaatgatatagagacctttatttaccgttatgtgctaatagttaaaatttacttatttgggactgctaacatatgctcaagttaaaaatgccaaaggtctcctttctattcctgcccccagtccctcagtttccctttccagaagcagtgctatgactcctttcctacaaacccttccagatacagtatcaaactttttttttttacatatatagcatttcttatttttttatttgtaaaatttgtccttttccaagtgctaaaacagtaaagaacaggtaagctaaataaaacaaaaacaagtcaacttccctgtggggaggctagaacagtgctggtctcattgactagtggggagcagtacatgaatgaggtttgcttttcctaagatatttgccttctcattgattggagtattggtggctaaaacgtaagcaactctgaaccctctagcacttacagaatggtgataatattgtgttgagtgctatactatgctagaacttcacatctgttttctcacatctctgtaaggtgagcctttccctcccttgacagatgacgaggctggaactcaggctaagttagcctgttgtaggccagacagcaaataggaggtagagctgacttctgacctgaccttttcctaccatattatgctacccctctggatctaaagctcttggttctgtatttctagtatcattgttgctgttttcttttatggctttacatactgagtccttggtatgaacttggggtgacccaagagaaaaaagtgagtggaaactaacttcctctctattaaaaaaaaatctgctcaaaggagaagggcaaattcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgctttttgcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttattctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttttgcttaagaacgatcactctggctgctctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaagagttattcagagagaggtcaagggggagttactggttttttgtttttacaaggaagttttagtaaatcatattaatagtaataataataatgatgatggtgtacatttgcatagcacttggcagtttacactgctctttagagtgcgggatccacgcagctctctgtgaagtaagcattttataggtgccaaaacagattcacaaagtgtacctgaggtcatctgtttcctggagctgtaatttttcccaataatcagtaatattccccatgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaacttcaaggtgaaactggtcctcgtgattggtcgattgcttctctttcttgagcactgcacccatttcagaagacagatggttttagtattaatggcatcaaccatcctttgctggaagataaagagtcagactttctatttggaatgtaagctccttgagggcactgagcttgtttattcaaccttctattcctagtgcctagaacagtgcccagaacactgtagaagaagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgtttagggctttggatcctaaattatcacattaattttcacagcaactgtttgcagtaggtggcattatccccattttacagatgagaaacctaagttttagaggagagacacacccaaggatgtacacctagtaaatggcagagctggggtttgaatctttatgcatttaatttaaaagcctgaatcatcacatttcacaccctcttagaggaaggcagggttcatgccatctgcttcctccaaccaccaccactcttcagcagtataccacagaatgctgtaagcttcttatgacctgaaaagatgtattttaaatgcaatcaatacaagtcttctgaagaaatacacacaagcaaattcaattcaacaccaccaaaaactccttcaattaagataaaccagtattgacattttggagtatatctttccttgtttcttttgcaaagaattaagtatatacattggaaacactcttaaggcttaatgcattctgctaataaatttctccttcttagaaccaaagttgtgtgctcactaagagccatttgtttttttcttagtactgtttatgccaatcgaacttactgtaattctgtaatctaattagatattacgtaaaccaatgaaatatgagtataaaaatagagttgttgccactaaaattaggttgaatgctttagcaaaatgtgataaaaacaaatctctaaaacaattgctctagaattcagagtaggtggaacaactgaaagatttgaaaataaatgttaaaagtcacaaaggattcaacattcatattgcttcacaagtgtatttaaatttttgtttcatgttaaagaaattgaaactgaaaatagagaagaagatggattatggatatgatttatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatagattaaaacattttctggcaatataacgtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgtcaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaactggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattttaatgttgtccaacttaccaatctttctctttgttgttagtactttttgaggcttgttcaagaatcttcacttatgccgaaggtcatgaagatatcctcctatgttatctttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccccctcctatgttatcttttatcaactttattcttttacctttcacatttagatctacaatccacatggaattaatttttgtgtatgttgaaaagttagggttaagtttcattttatgctacattaatatccagttgctcaaacagcacttaccaaaaagaccatccattccccattgctctgccatacagcctgttccataacataaatcaaatatccatatatgaatgggtccagctgtggactccttattctcttccactggtgtatttcccttgagctaataacacatactttgattactgtagcttagtagactgaggactacatcttcttcttttcaccagttcctggagattcttggttattcttgatccttcacatttccaaatgaaaagattagaacagcttagaacagcttgtcaatttccacaaatacacacagagacacactcagatttgcagagatttttaatgagattgttttaaatctatagatcaattgcttttacaatcaaatctctaagagaattgatgtctttgcaatattgaatcttcctctttgtacatagagtatctttccatttatttgtgttttctataattcattgaaagttttatgttttagttatttatcttcaacataattctttccaatggctatagaatattttttggttaacataaaaatttattaattaatctccttgtgttgtaaacctaggttgtttctgttttgtttcattgttgtaaataatgtgattatgaacattcacaagtatacatattttagtgcctttctgtctccttggaattgactcctgaaactggaatttctggaacatacagcttgcaccttcatattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacttttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccattttgatctgtgatgagggcactacattaaaagagtattgaagttggaaatctatattttggttctttcattagaatgtgccctttacaaaagaggcaatatgaatttgcattgcaaaggattgcttatttctttttagaactcttgaagtcaggtaatttaattatgtctatgccatagccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccagggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacaatatatatgcaatatgtcttacgtaagtcagagtaggctctctgctgtaacaaagaactccagatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaactgcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggctggaggtagggcacattgcttccactcagattacattggctagaactcatagccatacctactttgtgagtttttttttttttttttttttttgagacagggtcttgttctgttgtccaggctctagtgcagtggtgtggttgtccaggctctagtgcaatggtgtgatcaggcttgaccacctgggctcaatcgatcctccttcctcagcctcccaagtagctgggactacaggtgtgcaccactccacctggctaattttttttttttttttgtagagatggggtttcaccttgttgcccaggctggtcttgaactcctgggctcaagtgatccacccacctcagcctcctgaagtgctaggattacaggcatgagccactgtttctggccaccatagctactttcaagtgaacctgggaaatttgtgcttaagagaaaaccaaaatggatttgtttaataaacacatagtccatcactatgtagttcaccacaaacatatagtaatacttgttgaataaatgaaaggaagaaaaatgaaatgaattttcttcttcatagattcctagagtattagagctgatgggggccttggaagtgatagagattttaccccttcttttatagatgaggagcctgagggcttgaggaatttagtggccaatgcaagatcatccagctgtttagtggcaggaccagaacttgaacccactttccccaaatgctgctgtttattctgcatttaattatttaaaatatcattgttttctgccatagggttgcccttgccttttggaatgtgaagatgggttaggaggtgggaggggggttaaggatgttattctgatcatgatagctagacttcagttttctttggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaatcatccaaggtgatatggatgcaatgatgagcaagatgttcacagcctaaggaaggtgtcaaatatttacacaataattactaaatgaaatgaggagcaaggaagcaacaaggtggaagggaccagctgctagggtggggagggagagggcataaggaaagctttatggaggcagggtcttgaagaatggatcacagttttttgggaatttgatctgtcctgaaatacacacacttgtgtttgtgtagttggtgcaaatcaccttggccagttgtggatgtgcattgagaaaaatgaaagaaagaaactgacaaaaacccaaaatgatgatcaatgctcctgtgagcatttggtgctcacatttaccattcatcaataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagagggatctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaggcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaagcctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttatgtcattaaaactatttaaaaaataagtggtggcagaatgcatggtataggatggaaaggatgaggatatggtcattctcacgggcctgtgggttgggcaggaagacagtgccatagccagcgagccaggcaaggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgcatttttttggtttaaattatattgtaaggcacataaacaaacacatgccagtagatgttattgaagagccacagtgtgtaattgctgtgaaacaaggaaaatggaatatcaaaatgataaacaacacataaagacgttcttgattaccttttttttttttttgagacagagtctcttccttctgttgcccaggctggagtgcagtggtgtgatcttggctcactgcaacccctgcctcctaggttcaagtgattctcatatctcagcctcagcctcctgcatagctgggattacaggcacatgccaccatgcccagctatttttttttttttttgtatttttagtagagacacggttttgctatattggccaggctggtctcgaactcctgacttcaagtaatccacccgcctcagcctcccaaagtgctgggattacaagtgtgagccaccgtgcccagcctcttggttacttttttttaaaggttctctttgaaccatctagagcaaagccatcaaagagactgctgggatcatgtcagaatgattcagaagccaacctgaggggatcccccagagggcaaagatgagacagtttgagcatcaaaaggattgaaatatataaaaatatataaaagtccatgagtttatgacaaaattctaaagacacaagacaataagacaaaaaaatcccgcatttgtcacttctgagattgttagggcaccaagtcattgttctgaaaatggatttaaaaaggagatctcacatccacccctgctttcctatttactttatagagaattacagctaataaatgcagaagggtgctagaaaagttttaaaaacctacagttttgtagcatctaatgaagtaatggagctaagcaacaaccattaatgaatgataaaatcaggtaaaattggtgctttctaacagagaatcaggctgacaacacttgaacccacggatcagtctccatatcactaaaagtggaacagccgaacgttagttatgctcctccaatgtgatctgatagaaaagaaacagcaccacctgtgaagtattcttacccacatcccctccctcaacgaggctgaaccagaagctcatcaaacatgcacatctaactattaataccaggttataggaaatacgggagacagaggaacatgctaaacaccactacaagggtacagatcagccaatgcctgaatgtaggaagttctacaaaacaaatgacccatttttgttttcagtatataaatgctacgagaaaaaagtagagatggggaactgttaagtactgtaaactagttcaaccattgtggaaatcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacttggaaccaacccaaatatccaacaatgatagactggattaagaaaatgtggcacatatacaccatggaatactatgcagccataaaaatgatgagttcatgtcctttgtagggacatggatgaaactggaaaccagcattctcagcaaactatcgcaaggacaaaaaaccaaacactgcatgttctcactcataggtgggaattgaacaatgagaacacatggacacaggaaggggaacatcacacaccggggactgttgtggggttgggggaggggggagggatagcattaggagatacacttaatgctaaatgaggagttaatgggtgcagcacaccaacatggcacatgtaaacatatgtaacaaacctgcacattgtgcacatgtaccttaaaacttaaagtataattaaaaaaaacaaaaagacttaagggtgggagatggagcctgcagtgagctgagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactccttcaaaagaaaaaaagtatgtgtatagggaaatacgtgaaatcagaatggtaaaatataataattgttgaagcttggtgataggtttttgggggttctttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctataaattgtaactttaagccataaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctggatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgagggcatcaaaaatggaaaaataataaatactgctgatatttactaagttttatggtatgacaggcactgcactaagtcttttgaatatctaatcatgtttaactctcaatgtcccattttatagctgaggtggccgcagcacagagaggttaagtgagttgcccaaggttgcacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagagtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttgacaaatacagtttctggcttcagtcacatatagaaacattggaataagtacaatgttgtgttttgcttttttttttaaaataggaactatgtttgataatgcatatactccaaacacctctaaaaataattttcaattggcaagctattttttggtgtattttcctagtctgggagaggaagttttatcatttaatttgataaacttagtacctttgagagaaaggaggagaaaattttaccatcttatgtggttgaaatatgctttagtatttacataattgaaaatgattcaaactgatttcctctgacgaacatccgaaatgaaaataaaaattgtgtctactccaaagggtagtggcttgagtcacccactggtatgtgtgacctatgagtcactcactggtatgcgtcttcccgatcccctggcctatgggttagaagtcaaagatgctccactggggcttcctttgtagcttcttttccccttcagtattcaaccacagctactgctggcagctcctggcagaacaggaatgggagaccaaggagaggatatgtggaagctgagtgatttatttataggggacttttggcaaatgaaagaaaatagatgtgaagtcttagcagttccagcatgttcatcagaaatgcaagctcatgatagtcatttcaaagggaattgtggaagaatggtgttaccctacttcacaggccattaaatcatatatatgtttggttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgccgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttctttatctgtagaaatgagaatgataatacctcttttgtaggatttcctgaagactgcgggtactatgtattaagtatacatagtaggcacatcctcaaagggaattccattaccttttctatggaggtagatcctgtataatttttaaatttttgtcttgatggccagttgctcacagtttttaaaagtgtagtagatgccagcgcttctttatagattctgaaatcccttcaatttacattttagttgttttaaaataaagatttctttaagagacaacattcagagggataagttttctacttgccagtagaggtagaaggcagtaaaaccaaatagatctgtcagttactgtcttgaggtagagcccctaaagcaataaaacccacctttgacaatgaggaaacacgagacatcattttctccttaggacaaaagtctagtgagtaatggcccttctgtgactaatggtaattctgtactttattcccatagaaaatctaattttgaaaacatttgctgcatgccctactatgtactaggcactatgccaggggaataatgtaaagatgaccaaaacataatggaattgttgcctacaagtatgtttcggctatttaaggatttatattgcagtttgtgcaaattgtgtatgagtccactttgagaggttatacatatcttccaataatgttgctattgctcaaaatatctttgaagtctctctttggaatttacttttagagcccttagcacattctgctgaagattttttttttttttttttttttttaccctagtggtatttattcttaaaaggtggatttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctctgccatgtcacctgtattagtctgttcttatgctgctatgaagaaatacccaacactgggtaatttctaaaggaaagagatttaattgactcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggtggggacacagccaacccgtatcaacacctgaccacagtgtgtgtggtctctgaggcccagtggtggctctcagagcacctccttagcaaatgtaccactggacccttgttagaatgatgttcttgattttttaaaatttatttttgtctcttgactattcttgattcaggaatgttcttgattttaaagggagggtgtgaggtagttgttgtctagttgtctagatatcctccacctgagaacgctgtctggtgtcatagaaacagcaatggcattgggatcaaaagacaaactttccagccccagctctgcctctctttagcagtctcctgacctatacaaggttcagttttcccaccatttaagggaaaccaataccactgttttattcacagcactcttgtgggaatcacaggagacagggcacgggagagcctttggggaactgtggatgttagtccctgtcgtcatcagcctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcatctacttaaaaaaatcacttaattaacagtgattattgagtatctgcatctcctccaagaaataaaatgccatatacatgacacacacacacacacacacacacacactcttgatagtcctacagatgactaatcactccccaccccccgacttcctgccttttcattcatacattggggttgggatctctgctaccacaggagctgttgcagagaaaaagatttttaaaatactatattatgtaaattagtacaaccattatggaaaacagtatggaatttcttcaaaaaactaaaaatggaactatcgtatgatcaagcaatctcactactgagtatatatccaaagaaattgaaattggtatatcgaagagatagctgcactgccatgttcattgcagcatcattcataatagccaagatagagaatcaacccaagtgtccattaatggatgaagggataaagaaaatgtggtgcatatacacacaatggaatactattcagccttgaaaaaaaggaaggaatccctgtcatttgagacaacatgggcaaacctggcagatgttacgttaagttaaataagccaataacagaaggacaaatactgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatctaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaacctgcactctctagatcccatttaggctcttaactgctatactgtcttaactggattgaggttttccataaaattaaagtttcccctgaatccacagaaaatgttaacaatatatagaattttctggatttaatttttttctgtctcaaatctttgtatctaggatcacagataactgaagattgaacaagttgcaaatttcttaatagtcacatatgtatcattatatactcagagtttagccagataacccaccataaattgctaatgaagcttaataatttatagtgaaaaaacaaaaatagaattgcaaaccataagcaactcaagacgtgcacgggggattatgcatccttcccccagtttacagaaattgcaaccatcagcatatgcgttccacatcagtgccaggcattgtgtggcaatcagacttcttatctagaaactctagaaatgtactacttttagtaatcctaaataacttacttaataagctatattacttaagctatattatgcacaaatataaagctagaaaacaaaaggtgaacttggacttcctctatcctttataaaaatggaaggacctgtgctttgctggattggtttgctgttcaggtggaaacccctcgtggtccattcagtgggctgtgggcgatagtttgagaatcctgctttaaaggaagaatacagttcatacattttattaaagacagtctgctaaagtgatggagctggaattttctcagtgagagcactgtataacagggttttctgttttccttttttcataacaaatagtacttctcacttaaaaacaattgttccttacaatgatgtctgggatttgcttcaaaataatcctgtgggtaaagagttgggaatgagttggggaataggtggaagaagtgggatgaggggcagataattgtcaaagcaagtgacatggggcttcatgatactgttttctctacttttctatatctttgaaaataaaaagttaacagcaacaacaaaaaccttccttgactactatcctacctacttcatttctctgctcttgttcacagcagagcttctaaaaggaactctctgtatatctcatttgtacatcctcatcctccattatttaagcaacccattcacttggctgtcctccccaccagccaactgaaattacctttttaagggtccccaccaatcaccatcttgccatatggggtggttaattctctcttatgttacttgactttcagcagcatttgatgcaataggtcactttttgtttcttggagcattttcttttattggctcatgtgcacccacatgttctcatttcttctgcatcttgctggtttccaacagctgacctctagctgttggaaagcctccaatgcttcatccttgggtttctctgtactctttctgagtaatctcattgggtcccattgctttaaataccttctggttgctaacttaacatctgtagccctgacttccagacttgaatctgagaggcatctcaaatttaatgtatccaaatcataactcttaatcccagccttactttcttcctttcttcctcacctcttggtacccccatctcagtaaataacactgttatatatctggctgctagagccccgaaccttaggcatcacccttgattgctctttttccctcatatcccacatccagcctatcactatgacctattgtcatatctccaaatttacctgaattcatctactttcctctcctctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgggagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctctttgtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttcttttcctgtggaaaacaacccatatatttctagtttagtcagattagctgctaggaaggccctttctcaagcttatttatataacgaaaagctatacccaaatcctaatttcatgtgacaattgagcagcctcttgtaaaatagctagaacaagggcaaggatattaatttggctcttggactgagacacactagggatgtcccagggatttgaacaatttctaatcttctcagaggagggcataaggaaattcctaaccaaggtgaaatcttttgtcacatcctagagtagataagtacttcaagaatcttctagactggggataagttggaactgctaaatattatctacttatctaatgcatgtaataatagctatctatgtctattttatcaagtagctgggaggataagtttggtttttttttcaaggacttttgagctttttcttcaggtaatatatcttaagggaacactttatataaagctaagccattgggaaattttttctgccatagccaacagttttgtaattaacattcctttgcatggtataaatacaaatctgttcttttgtcaggatcattctttatgaactaccatataaaagtcatctgggctgggcacgatggctcacacctgtaaacccagcaatttgggaggccaaggcaggtggatcacttgaggtcaggaattcaagaccagcctgggcaacatggtgaaaccctatctctactaaaaatacaaaaattggcagggcatggtggtgggcacttgtaatcccagctacttgagaggctgaggcaggagaatcacttgaacccaggaggcagagggtgcagtgagccgagatcacgccactgtactccagcagggtgacgagcaaaacggtgtcaaaaaaaaaaaaaaaagccatctggataatacatattctttattagtattaagtatttacttttagatcaatgaaaacatttctatggggctagacttttccttgtcaagattataatttttcttatgagtttttacctgaaacccctattttctaagaccccatggttaatgactctctttgacattaatcatttcaattttgctggttctgatgaccctgtgctatctattagagctctaaccctttgcaaacctctcttctgcccttgtcagtgtctcacgtgctcacgtgcatcttaggctggatatcacgtggcacatcctggtaccacctctgctgctttcactggccactgttgcatctgtttggtgcagctgcttcctccactgggaccaacccctcctcttccttacaaatattcggaggtggggaaaatggaaatgctatcattagaacatctggcatcagaatttgctttatgaagaaaataatcttgggggaaaacactttgatgagtgcttgcggaagaaaaggaaaccccaaaggcctgggtattgggagagctgctttgtgtaagccaagggcaagcatttactggttgctttgagagtgaggggaacacatgagagaaagaaagagaggggagggtggaagaatggcaggcatcaactaaatggcataaaattgtggggagggtcttgatgcacctgttcctcatggtctccagacttttctgtgaagtacagcatgtagtgtggagtggatttcagggggtgaacttggagatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccctccagatgtgcctctacttagcactctgatagtgagcacaggtgagtccgaggaaagcaggccaagaagtgctgatgagtttctctctgaggcccagggatacccagccatgccaacaaccagccctcccatgccagtccacgccctgtagcctggctctcttactgctttaggagccctgggctctcttacacctgtgtggaagagggagggactcccaggaacataattaggagtgggggaagggaggagaagaagggagggaagagggggaggggagaaaggacatgcatttctaccagggtaactttggtttccttatattaatataagggacttgaactgtgttattctttctcaaattgggatttaaggccccaaggaatccaaaaattctatgagaactaggtatttttatgtaaatgattaactaaaacaacgaatgtaaccttattctggatcatcttccaatggagtcctgcctcttgattttactttctgaggttatgtttgtgactgtgatgcatgcaaatctcagtcacctacagtggccacattcagacaatttgaaatgcattttatattgtaacccagcacacacacacatgtaaatagaaatgcaccaggagtttcctaaagtattgctcaccctttctgcatagggagtaccctcttgtcacctctcttctattcccaggtagtcatgacccactatcagattacaaccttcaataaaaagatcatagcatgtaactgtaagcatgatcagtctgccgttttcttttgcagtggaaatgttccattgaaagacattttatagaatacatctttaccaccctaagttgtttaacaaactgaatctttgacttgagatcatgagaacaaaataaagatatgaaataatgactgttttattctgaattgctgaaaaaatacccagatagtttaaagctgtaaatcagaacagggcaaatcagagtctcattgctgtaggggtatagacagaaataagactgatagagtagtaattgcagctatacaattattttcatcaaaacaacctatatcaaagtagccgtgttatttactttgtaagcagatatagtgcatggatctcatctctgaatatgccagcttaaaattcattagcagaaaatgtggtaagtgtaccatgatgacttactttttcattaacttaacatttgggatacactgtattagggttctccagaggaacagacttgatagtagatagatgatatgatattaatagatagattgacacagagagagtaacagataggtagataaatatagatatgaaatttattgtaggtattggctcacataattttcgaggctgagaagttgtgtacaagatgcagaatcaggaaagctggtggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctggtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttactcaatctgttgattcaaatgctactctcttatgaaaatacccttacagacacatccgaaaataatgtttcgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatcatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggctggagtgcagtggtatgatctcagctcactgcaacctccacctcctgggttcaagtgattctccagcgtcagcctcctgagtagccgggattacaagcacccgccactatgcctggctaatttttgtatttttagtagaaatggagtttcactatgttggccaggctggtcttgaactcctgacctcaggtgatccgcctgcctcagcctcccaaagtgctgggattccaggcatgagccacagtgcctggcctttaaaaaatgtttatttaaatagttttgggggtacaggtggtttttggttacatggataagttctttagtggtgatttctgagattttagtgcacccgtcacttgagcagggtacactgtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggcaagctgcatatcccaatggccaactggtcatggctacttcctttttctcatctagtgcaagctcaagaggtgtgggatgggacaatattccactgttctgcaggtaaatgtatctttgtggggcctctgaatgtcctcttcggtctgctagtctcctgacaaggggggaaaacactatccagaccttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttcttaatgcctgtcatccttatctggaaacttgggtgtttaatgcattttggcaagagtgatgccagtgaggatgttccttggtagcttaaatatatccaggctattgcaatgatgcctgacattgaagggaaaatgcacacatttagtcagtcacatgtatgatttcaaatatctggattttggaattgtataaccaggtatataccagctacatctgaggggaaattttccgttttcatccagatgctctggtaagtgctgacatacccagactatgagagatttggatcaaactaaagaagtccccaagtctcaggagaacaatgaaatgtagtgcggggtgtctgccggagtcatggtgtactcatcagaatgagctgctgaacactgtggtcaggcccttggctagtgacaccattaagattttgtttccttctaaatcaccacccctcctctactgttgaaatgtggctgtttcatctctccattagagtccttccaatttacaccaagcaaaacagttggaaaataaaacttcatggccaggcagtgggtaggagtgagagggaggaggaaaggatgtagacacataattcagaatcaaacattgaatgaaggactcctcgattcagaccccatctcactttgcccatggactcagtgtctgaccttgcattaccctccctgatcttaacttcccagaactctgacagatgattaataatacctgctatacaaagggggtgagaactaataaatggtagttaaggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctcttactctacatggaaatcctgtaatacagatttcagccttacaccgagaaaatatatatttctgagtctttttttcttaatatatatgtgagaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccagagatgcttggctgggcaaagtacagcaagtccctgaagggggctgtaatttctcaggcctgttgaaggaaagaagaacaatatgtgtgtgagttgctaagtctttagacgttggcagtggcagcaggctggtaatgagcagattaggtatttcaatatgtttctttgcctcgggaaatttaacaggtacacctgttttctttcagtggctgaaaatgtcagttaccatgagcctggtgtagttggcctttttgaaaaaacaagagaggtggccgggcgcagtggctcatgcctgtaatcccagcactttgggaggccgaggtgggcggatcaaaagatcaggagttcgagaccagcctggccaatatggtgaaacctgtctgtactaaaaatacaaaaaattagctgggcttggtggcgcatgcctgtagtcccagctactcaggaggctgaggcaggagaatcacttgaacccgggaggcagaggttgcagtgagctgagactgtgccactgtactctggcctaggcgacagagcgagactccatctcaaaaaaaaaaaaaaaaaaaacaaaaaaaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatgaactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagatttgagatatgagtggtgtgactttcttttgtagagtgggtgaaagaatattgttgatgcccaaaggctctcaggcagtttcagaattagtacatatggaaattgaggatgtagaaactcatttttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaatggattctccaggaaaatacaccaggtttattcttttgctgtgcatataattgtgctcagagagtagttctgcctcagtttgaggaacatcggtgttctggaagaaatcctggattgggggtaaagatatggggttctggccccatctttgccataaattagctgtgtgaccttgggcagatcatttaaacccattggtctccattttctttgatgtgaattgggtggcagtgactgatcagattagatcacaaaatcccttccttctgtcatgctataatgacatagagtcttgaatgccaggaccatgcctccccagtgcctgagtggttgtgcttcctagaccccaaggtccagtgtgtgccagtatggccttaccctctttactgcctcagagtcacagtaaggacttttctttataattgaatgaacacggaatgaatgggcatcttggcatagctggtttacacattattcttgtttcccttttctacatatatgaaaatgtgaactaaatccatagccctcccttggtggataaagacatgggcataatagttccatgaatttagcctctttttgtattcaacagtctcatcccttcccctcaacttgtgttctccttgatagaaatctaaccacttctacaagtggcagctaaagcattagtcttatataaccttctcgctcaacaactgaaaagttgtacaaaccttttaaagaatttaccatcagcaagggctgtgcttctaggcttgtccaaattgcgtgtaaagtacactctctaaattaaccagaccatattaactctgaaaacaagactcactcttcttaagctatgtctccagactgtaccaaattgtactttctcttgaagtaggacattctgtgccctgtttgaaagctggcgtgactaatgtagctggaattgctgatgagagaagacaggaagagaaagaaccgatgtgccttaagaatagggaatttcggctgggcacggtggctcacgcctgtaatcccagcactttgggagaccgaggcgggcggatcacctgaggtcgggagttcgagaccagcctgaccaacatggagaagccccatctctactaaaaatataaaaaaattagctgggcatggtggcgcatgcctgtaatctcagctacttgggaggctgaggcaggagaatcgcttgaaccctggaggcagaggttccggtgagccaagattgtaccattgcactccagcctgggcaacaagagcgcaaatcagtctcaaaaaaaaaaaaaaaaaaaaaaaaaaaaaaaaaaaaaaaagaatagggaatttcactaggccctttgcagaatgcagtatggctgatgtgtgtattatgacatggtaaatattactcctagcctccttgtgaaacgggctccatgtcatgcctcaaggccctactaagtcattgctagggctgagcctcaagcccagccccaacagtaggttcaacctggccttccctcccagcactatcactgcctgtctttcaacctatgctatacattgtgacaatcagttaactgaggtacaagtgtatttggatttatgccagactgagaatgagaaatattcagatcacacctggaaaatgcaatgcaaaactcccttgtcttgagctaaaaatctagaagcatttgcaagtgactaagtcccttagtttataggtatgagcctgtgataagttatctttagttgtttctggcttaaggggatgtcagtgacttttcccttagcccccctcctggaacagccggctgctggtggtctagttttttgaaagaagccctgaattctgaaacctcatgctggggttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttcaaggctgtgtgataggacatttccctgatgcttggctttaggctcaggatggggacgttaatacattcagcagaggctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagtttcttatacaactaaacatactcttaccatatgatccagcaatccatctccttggtttttacccaaaggaattgaaaacttatgtccacacaaaaacctgcgcacacaaatgtttgtagcagctttattcataattgccaagactgggaagcaaccaagatgcccttcagtaactgagtggataaactgtggtatgtccatctgtatcttttattcagtgataaaagaaatgagctgtcaagccatgaaaagacatggaggaacattaaatacacgttgataagtgaaagaagccagtccaaaaggcggtatactgtatgacatctggaaaaggcaaaactatagagaaagtaaaaaagatcagtgattgccaggccttcggggaagggagtaagggatgagttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagagtttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagaacagaaattgacttggaagatattgctcctagaccaaaagtccaaattaaggggtataggcagttaagggcaagtgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaactttggagagtgccagaggaagctagcctgagagcacagaactggcagtcacgaggcctgcattctccagcttcgcctgccaccaactctctgagcctccaggcctcctttgtcaagtaaggacacaagcaaagcatctcagaagacaagtcattttcataactggaaatgagacagagccaacaaggatgcgtgaaaccagccacataaattgtgaaacctatgtgatcatgtatatgtacaatgttttcttaaaaaaaattaccattcctagatctaatatcaattttttgtatgattttgccccacattttgctcaaattatgcagtgtttgaaagagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccagacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtaagctattttcttttcatttctcctttgtattacagttttcatgttatattaatttaaaaacatgggcaggttatatgatctatggattttataccagattagtagagtactataaaatgtttgttataaaaagtgtgttttatttgattgggttgaaaacttctgggccaggtaatcctaaagtctcttagcttttaaattttgtgagcctgtgagattatttagccaaatgccttcatttttactggtgagtaaactgaagcccattcagtctttcatgcattgtattgcattcagaaattgctgtgatcattgggaggggagaatgaaactaccaagcaaaagaatatgattttagtttattctctcctttcttttccaggattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaatttgaatgatatattttatttaacccagtatattcaaagtattattatttcaacatgaaaggaatagattattattttttaaaggcttaattttatttatttatttacttatttacttattttttgagatggagtcttgctctgtcgcccaggctggagtgcagtggtgcgatctcagctcactgcagcctccgcctctgtggttcaagcaattctcctgcctcagcctcccaagtagctgggattacaggcgtgtgccgtgatgcctggctaatttttttttttttttttttttttggatttttggtagaggcagggtttcaccatgttcgtcaggctggtctcaaactcctgacctcaagtcatctgcctgcctcagcctcccaaagtgctggaattacaggcgtgagccaccataccctgccagaaaacaattattaatgagatattttatgcttcttttatactaagccttcaaaatctggtgtgcacttcacatttagagcacacttcaattcagacacagatcatttcaagtgctcagtagccacacatgtctagtggctgccatattgggtagtgcggctctagtgcaatggctttcagcagttcttctgtttctacccagttcacctgtctaggcaggagacttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttaaagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttgggggcttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcgcaaaccaagggattcccagacccagagcagatcaggctcggaaaagagataggagaaacagattcatgaaccgatgtataaatcagaacacctgtttgttaatgggttaagataaaaattcctcctacaaggacacgaacatgcatgcttgcaggtcagcatatttttctctctgtggaaaaccttgtgtgaagagccagactattatctgaaggttatttaatgcacttggaaacagagctaggagacttagattattgctgaaaatctaagtatttatatttgaagaagatgtgatacaaaaaggtacctagtgaaaaggcagcctctccttcacacctccccactccccactccctagccccttcccaggggcaacccttaggaccaatgtcttctgtaagttcagttgcctgaggcctccatttccttggcagggatggagctgctgtgcaggccaggtgacctgtgtcttctggttaggctcccttcctagacgggttttgtcttgacatactagcgggtgggaggtggggaggaacaaaaaccgtgggagtgatagaggccagttggcagaggaggcatgcaggggtttatgagttagaaatatctgcagagggggcaaggggtggggcgaggagtgacccagtgacaacagaaaggagtgtccccagacccctggcagggagcagacagtggctgttctctgacacttatcagcccctaaggaacaggacaggaaggaaaaccacagggtgagagaactggggagactctgtccctgagaaatcctcccaaagagacagagcatgatccaaaacctcgtgagaggcggcctggccccacagcattcgtgccatagcataggtcagtcctgtcatagagtgcaaccaggtaaggtgccttccagcttcaatgctgtgatctagagaccgcactggcgaagatcagcagcaagaaagaacaattagccaattcattatgttgacatttctagctacaaggccagtattttacaaaataaggccttttcccttaattaaggttgtgacagataaaagtatattcccagctgactcatgtcacccatgtgggcaggcctattatccctacttggcccgccctgtccgcctatgagggcttgctctgtgtgcgtactcttggcagctttataaaggattcagaaggaataaacacagggcctggttcctgcccttcatccagaagagaagactcattcatacacatggtccaagccagcaaactttagttgctcaagagcaggaaaataaggctaatgaaggaggggaacatctagaaaccagctcaagcaaggagcaggggtatttaatgtggaagagtgagaactaaaagtagccttgaataccatttctgacgtttgaagaggcagcaaagcttaatgtgtggtggttaaaggcatgactcagaagccagattacttggttcaaattctgattaaacatctctggcctgttcacacaaggcaagttacttcatctctctgtgcctcagtttcctcatttaagaaagtgaatataaagaaaatctaaaaaaagaaagtgaatatgatagctatccttcagggcaattgtgagaggtaagcaggctaacacatggtaaatactcagaacaatgcctgttagggcaaacactatagaagtacttgttacttggtgtgcgtaagagggcagggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccagcctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgttgcccctgagctccagatcaaatcccagctctgtcctgtcacctgcagtcccacgctgtgtcatttctggctgcattatcaaatagccattcatcaggaaggagattttgctgtaaaaacatgctctagagtagatcataggatgttagctcttaaagagagcttagagacactgcctgatgcagaggccaaagactgtgcccctgagggctgtagccagcttgcagacacattttgcatggctcacagcatttaaaaatcgttttaattagttgacactattaaaacagagattttacctaaaatatagacccatggctgctcctcaaagattagcagatgtgaagacattggacccttctttcagggcgacagttggttgcttctgagctgccactgtcccctgagatggggcatgcctgccccagttctccccagcccgcatagctctgtgttctatactcatttatattccctaccaggcccctgtagacattggcattttcagctcctaagctcgttcaacctcttcattttacaggtttggaaggtgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaagaaaggtagagaaacagagaggattgacaatgacagggaaaagaaaatctggacagcttttgagaggggcacagcctcttccttgtggtgttgcaggacggtagggagtcagttgggtttccactctttaagggatgtgaacatcaagatgtagacagcaggccaggtgtggtggctcatgcctgtaatcccagcactttgcgaggccaaggcaggtggatcatttgaggccaagagttcgagaccagccttgccaacatggtgaaaccccatctctactaaaaatacaaaaattagccaggtgtggtggtgggcgcctgcaatcccagctatttgggaggttgaggcacgagaattgcttgagcctgggaggcagaggctgcagtgagccgagattgcgccactgcactccagcctgggtgacagaggaagactcagtctcaaaaaaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctaggaaacaagagcgaaactctgtctcaaaaacaaaaaaaaaaaaaaagaagaggaagaagaatatgctagcattgttgatttggtttatagactcccaaaggcctgttcctctgaccctcttaatgaatacaccaaaagagtgattaatggattaataagttagctccatcccctttcacttcctacccttagactaaaacaattttttcaaattacttctactaatgttgtactttcattaattggttggatcaacagggtagaaagctgttttctttttcttttaagaattctctgccactaagttcttccagccaaagaatgttcattcactataatacctcttcagttcaggcatttatttacttgaagtgtgaatccattgctgttctcatcgtgtctaactttgtctttttagaagtaaggtatttttccttgcctgtggttcacgcagaagtggagataatgattgtgttgagaattcagggagagcctgcaagtaggtaatagaggtgggaagtggagtgagtaatagtcagaagagaaagaagcaaggctgttggaatggagaagtctaaagagactgtactagaaggaactcgaatcattaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttttgctcagatagttttcacaagtatatattcattaatacatggggcttgttccaaatcgatcatgaaaataagtttttgctgttggtattttttgttaaagtacatctaaccccaaaactatttgatgagggcagtttccctcaggctgtaaaatgaattaagggagcactcttctctgtagtcattttcttcccgcgttggttctaggctcaatcatttagatgtctctggtatctgcatagtctgggaattatacttgaactagcccgaaattactgcccagtaatcctctttctcactcaagagatttgtcaacattcatctaaccagagacttagcaagacatagagaatcatctagaagagcactgactctggagccagaaagacctggagccagacaggctctgtcacttactagtctgagtgatttggggcaagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacatagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtatttttggaattctgtgcttttattttctcttctacctataaagtacatgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaaggaggtcttacagtaccgggtgtttgagtgatttttaaatggatgaaagggagaaggctgtaaggcagggcccacggagtctttttctcagctccttatgataacccaacagagaagtggctggagagaactttcagagtatcaccatcttcacacagcaaacatcgctgaaccagacactcccagacctcagcgagctcactgtcaggtatggctggcaagcaagtgttaggttgagccatgtgaaactgccattgttgtagaccagaaatggtagaatattggcaatttcaaatgactcaacctaataattagatgaaaactatccacagtgatcaagactgtgatggccatcctgcagtattctgggagagtctagggaacaggacctaacccagtgaagtggggccagggacaagaaggggacaaaataaacccaaaaaaacccccagctttattgaggtataattgacatacagtaaactgcacaagttcttagtatgtaatttgatgtttccacacacttatacacccatgaaaccattgccacagtcagaatgatgaacctatccaacactcctaaaagttttctcatgtccctctataattccttcttcccatcacccccatctccaggcaaacacggatctgccttctgtcattatgtgttggtttcatttcctagaatttcacgtaaatggagttctacggcattctcttttgtctggcaacttgcactccgcataattatttttagatttgtccatgttgaagtgcatattaatactttgtccctttttaatgtaggacagtatttcattttgcagatatgccatagtttgtttatgcattcacttgtcgacagacatttgtttcgtcggctattacaaataaagctgctgggaacattcatttacaagtctttgcatggacatgggctttcttttctctttattaaacacctagaagtgaaatggctagactatatggtagatgtatgtttaacgtgttaagtgactaccaaatcattttccaaagtgtttgtcccattttatgattctatcagcagtgtatgagagttccgtttcttccatatctatgccaacattgtcttcagtcttctttattttaaccaattttattgtggtaagaacacttaacatgagatctacacaatacagtattgttaagtataggtacaatgttacagatccctagaaattactcatcttgcataaatgaaagcatacctgttgaacagcaactcctcatttcccccttcccccagtagtggttccctcctggcaaccactattctccgtttctatgagtttgactatattagatacctcaaataagtggaatcatgtagtatttgtctttctgtgactggcaagcattctaatttgagtagagtggtattgcattgtgattttaatttacatttctctagtgagtgatgttgagtgtctttttaagtatttatttgccatccatgtatcttcttagctgaagtgtctgtccaaatctttgcccatttaaaaaattgggttatttttgttaagctttgagaattatttgtatatatatatgtatacaagtcctttacaagatatgatttgcaaatattttttcctagtcagtggtttgtcttttaattttctaaacagtgtctttcaaatagcagaagttttaaattttgatgacatccagcttatcaatttattcttttatggatcatgcttttagtatggtgccattttaaagaagtctttgcctaagctaagcaaataattcatctatgttttcttccagacgttccatagttttaggttttccatttgggtctatgatccatgttgaattaatttttgtgtatgatatggggtatgccttaaattcttgtgtatgtctgcatgtgtgtatgcacatgtgtgcttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttgtcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtcattccagagagaggaaagacagttatctcaggcagtcttttacccctgggaaaagaccacagacacatgggagggtttgtgctgccttgagtgaaaagagtctgttttgttatgctctccttcccccagctggctggaggctcatccaccaagctttagactattatgctgtgtaggattttctaccattatctggtacaggaggcagaaatcaaacccctataaggcttgcaagttcctggacccgggagatcagctcagtgactgggctttctcatgcgtggtaggagagtggatgctgggggtagccaggatgaggatggctctggtgagctgacaagcaaagctacaaatctggaattttgtgaaacctctcaatttttaaatgctctttctgtagttttttgaactggacaggccaaatgaaacacatctacgggccaaattcagtccattgctaccactgtgcagcctctgatggatgggctcttttatttgcttttagggtcagctctttcatcagctccctaaagttttggttttttgttgttgttgttgttgtttgagatggagcctcgctgtgtcacccaggctggagtgcaatggcatgatcttggctcactgcaatgtctgcctcccaggttcaagcaattctcatgcctcaggctcctgagtagctgggattacaggtgcccgccaccacacctggctgattttttgtattttagtagagaggggttttcaccatgttggcagggtggtcctgaactcctgacctcaggcaatccgcccacctcggcctcccaaagtgctaggattacaggcatcagccaccacgcccggcggttatttcaacagttgcttatggagcactcctgatgtgccaggaaatgctgggtgcacaggaaattgaccagtggtggggagagcctgccacgggttctagaggctcctgcttcaatgtggagctcaggcgtggcagagagaggcatcccagtgccaccacctactctcacctgaatctgccccttcctcgaatcttcgctgtcacttatttcaggccctccaagaagaggatggctgatttacgcttggaaggctcccagaaagcttcttcgaagagatgacatgtgagctaattattgaatgtagagtaagaattagccagctgaatctgctctagaacagtgttggtcaaaccttgctacctgttagtggaacatgaaatcaatttaaaataaaagaaggtagcaggtagtgaaggtaagtattttttgttttgttaaactttttttcagtctctctcacacacacatgcacctgcttcttttaaaggaaacttttaaaagaaaattttggttaaacatatataaaaacagaatctggaaaactgtttgattttgagaatgttaacaaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatccccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctgtagtgcactatgcagatgggtgtctgcactaagttcggcatcaatatggtgacctcctgggagcagggtccaccaggttgcctaaggaggagtggaccaccccaggccagaaaaggagcaggtcaaaactcctgtgctgatcagtagtgggattgtacctgtgaacagccactgcactctggcctgggcaacatagcaagaccatgtctctgaagaatgaaattttttaataattttttttatttgaaatattgcaaatcctagaaaattaaaaacatatcaagaatcacacaatttcaaagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaaggaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgttttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttacccccatgggcctgcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatatagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcctcccaaagtgctgggattacaggcgtgagccaccatgcccagcctaaaattagttttatatttaaatgaattcagtgcccagtactaatctttttcctatggctttcctggtactgatattgaggaacagatcaaggggcttagtggagactgcctggcagaggggaggggtattttatcatttgcattgtttagaattgcctgcacatggtgatgtgaaaaacagacagacttttaatggttttgttactaatttaaaattctctataaacactgcatcctttattgcctgcatctgaagcaaaccattttcactggcccccccattggtatgcactgctgatagctttattttatgcattgcactgactagattgtcaagacttttcaaggagggctcctgaacgatgaattttttagttttttttcatgttcaagaatatctgatgattaccttacctttatacttcaatatcatccctaggagtaatatttatgcactatactttattccccttagaattttggaggaattgtttctttatcttttgcatttaaaatacttttgaaaacaatgactgactttcccctcattgtaggcaacttggcttgttctgcttgaagaattatttcttggaactggaaatttaattattgaaccagggtacatgtttcagttaattgtttcatattcattttttgtaaaaacgaagtatgctcttttgacttagagctctgttgcttgctcattttagggatattttcttgtattggatctttaaacactttggcctgggttctctacttcaggaatactcattaatctttctgatggattatattttttctcctctatgtctatcatttttctctgtaagttttgccttttatcttgatgacctgaaggcttcctaggatataaataattttgagccatgttaattctattccttggtgtttctcacttattagtttattccttggagattgtagatttttggttttggcccattttcttccacataatgctctatttttaattcatgtgttactctgatatgttactcacttgccatgctgtttcattccatcttgcatatgtttgggtgactgtggcctttggggctctgatccactggggtgatttctccttgacacccttctgacccctgtgtattaccccttgaggaccaggtatttcctgtcctgttcacttttcttcaggctataggcacatgtaagcaaaagagcagggcaggaaagtgagctcaccaagttgtttacgcgtaggccaccctataatgcctgtgctgtgcaatctctcctgagaacatgcagaatgtcttctcattctgccagggacagttagttctcgttgtccacattttttatctcctgtcgcttcatgtagcagttaccatctccactctgctgaaattagaggagaaaaaaatgtaagaaacccacttaattttttcctctttagatttggggatagtagagtgaatctcttagagttgagtttgggtgaataattgatagagcttcaggaaggtaggaattggaaagtggctctgccatcttttttgatgggcttcatttttattttattaccttttcttcattcccttaggtgttaggggatggagactctggggtcaggcctcactctgccatatttacccagaagccttcttggggcttgcctgtctttctcttttcaaatgaaacatggatgtgggaaaggggagttcattgtagcccagtttggcataaaaagaggtaacagcccacatctaaccttgacaatattttaccattatggagtttcctctctttttaattttctgttcaccctcagattatgcaatgtaatttctctggttttaaatacaaagtaaattaaaagtagaagcacttggtaatactgtagctatagagaataaagctaagtgagtatgttatcattgtaatgaatcattccttttcattcattcactcatccagcaaatatgtagtgagtgcctactatgtgcaaggcactaccctgggtgcctggagtacatcactgagcaggatggacaaagctcccctgcctgcgagacacttacattccagcaggcatgagtgtgtagggttgggggcaggcagcgacagtaaatacagcacatctataaaatatatcacacgttacaaggtgatttatggacaaagggaatgacagtggaatgggagttgcagtttggaatagggcagtcagggcagctgccctgagaagttatatttggtgaaggggtcagtgaaagagtgtcccagggaaagggaacagctcgtgcaaggctctctggttcgcagctggctgctgtgttcaaggaaccggatgaatgacaaattggtggagctgtgtctggtccatgtgagagaaatgaatggcccagcaaactgtaacattaattgtttttactgttttgaaaatttactgtaccagatattcatttcacgtttttgtttgtttgtttgtttgtttgtttttgtttttttttttagagggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacagggtttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttgttctttggagtgggtttcacttaatcatcctggaaatcggttttagaaagactaaacatgatttctccatctctctgtgaggaccaaattgttctctgtgattatctatcagaacaagcagaacaaggggttctaattagttttccttttgaggtttttttttttttttttttctttttccaggcagtcagtctctcagccaaagggatttttctgcagagcctttgtactcagggaccagggttaattcatgagtcctgggaggtggctgatcaggttagtttttccagcctggaacagccccgccctacccctgacctcctccactccaccactctactcactccactcactccactcacattagctacagagaaactggatgttgtcagccccaggggtaccgtgagacagctgggttcagagtgactcttgaccttccctctctcactctctccctccctccttccttcccttcctcccttgcttctctctttctctctcttttttttttttttcctttgcgctcatcagtttatggtctacttcactaattggtctgtgaaaagcttcttccttttccattcatatactcactcttgttccccctccctctcatagataaggataactattctgactgatatgtattcctttatttgtgtgtgtttttgtaagtggtgttttggacatacattcttttttgttttttgagacagagtctggctctttcacccaagctgaagttcgatcagtgacacaatcagggttcactgcagccttgacctccctggctcaggtgatcttcccacctcagcctccccaccgagcacctgggactacaggtgtgcaccaccacacctggctaattttttgtattaatttttttttttgtagagatggagttttgccacatttcccaggctagccttgaactcctgagctcaaacgatccacccgcctcgacctcccaaagtgttgggattacaggcgtgatccatgggtgcccggcctggacatatattcttaatttgcatttgtatagacctgattcttttccttacattttttgctctccactgcatttagtccatcccctctaactctgccagtattccctatgtgctgttttgtatttctatatctcttcccccagcaatgagcttttagattgcttccaactcctttcttccgacagtattacctcatataaacaacctcatagtgacccctcatggatctgtgtaggaattttcctgagatggagatatctatacctatatctatatctcccaaaagagggtttctggattataagatatacgtgtatttgctagcacaaataacgaagctttacacaaacaacctaatacatgtcccttacaggtcttttttagaacttttcttgggtacgtctaacagaacaagattggaaagtacattcaattttacccacactgccaacttgctggccagtacgactgtccgatctttatttccattggcggtgaacaacgttctctacatcacgtcccagcctaagcttggtattgtctagatttctatacatataaagtgctttatcattgttgtttacatttgtttcttaaatttctgcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttcttctttttttgagatggagtttcactcttgttgcccaggctggagtgcaatggctcaatctcggctcaccacaacctctgcttcctgggtccaagcgattctccagcctcagcctcccgagtagctgggattacaggcatgtgccaccacgcctggctaattttgtaattttagtggagacgggggtttctccatgttggtcaggctggtctcgaactcccgacctaaggtgatctgcctgcctcggcctcccaaaactaatttcttttctttatagcactggtcaggacgtccaatactgtattccacagtattggatcttatacagtccagacaagtgtgcatccttgtctttttaaagagaatacatttaaagtttcttcaccaaatcaaatgcttttacaatcttaaccaaattaagaaagtttcccatattttgaatttttaaagaaatatttttttcaaattatagttatgtgtcaaactttatcaaatttttttctgcatctattaagataataatgactttcctctttggtggattgatatattgagttaagtggtagattttatgatgttgaaatttattgcaaacgtaggatacattctacttgttcatgatatgttactttcaattttttgattcaattacttaatattttatttataatttttgcttctaaaatcgtaactgaaacaagcctataatttttcctcttcttgtattcttaccctgtttggaataaaaactgtagtatcctcataaaatcagctagatagcttttgtccttttttgattttctggaacaacttacatatgataggaaattaagtgtttcatgagctttttctttttccccctttaacttgtccaaggtccacaggatccatgaacatttgatggagcttacctgtaaagccatctgggcctagggctctttgtcaagggagggctttgtttgctatttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaacttgacttggagggcttttttgctttaagatgatcatcagctcctggaaaggtgtacgttgagttcccttttgtgctaggcaaagggctaaagactgaggggaaggaggtcacagaagtagaagagctggtctctgcccataaggagcttcggagtcagcaatgtcatatacaaaacctggaaaaattatgtgagaaactttcacaaaatgcaatagggattagagaggagatttttagttttgaggccaaaacagtgattgataggcatggctgagggaggaggaggtagctggagaaggagggagaatgctatgttgttttcattcacgtagtgaccacagaaatgagggatggaggggcgagagaataagttaagtcagggcgggggtgggggagagtagggggaggtgtttccattttcctttaagtggatccttggcttcattgcagtaaatggggttgtcagtatatattgccccttttgaaaccgacgagtttcactgagaatgggattaaaagattgcatgaaaaatttaggatctgtataagggagaacattttatacagccctgtatgagggccgtctaaaaggagttaaattcccatttgggattttttaaaccaggatgaacattctataccacaatgtctggtggttttaaccagagatagtactgcctcaccccagggtatgtgaacatgtgtgtttgtggtaaggtaggggtatcactagcaattagaaggtgcaagccagggatgctgatgaccccgtcatgtactggagaagctctgtacagcacattgcctgcctagaatgctaagggcacacttgtggagaaataatgcacttcctaagcttcagtcatttggggtccccttgtttaatttttgcggtatctaggtaccatttctaccactaatttaatgctttttttcttttttgtctttttattcttttttttttttttttgagacagtcttgctctgttgtccaggttggagtgcagtggcgtgatctcgctcactgcaacctccgcctcccagagtcaaacaattctcctgccttagcctcccaagtagctgggaatacaggtgcccgccaccaagcccagctaatttttgtatttttagcagagatgaagtttcagcatgtatgccaggctggtctcgaactcctgagctccagtcatctgcctgcctcagcctcccaaagggctgggattacaggcgtgagccaccgtgcccagcctaatttaatgcttttctttaaatttatttttatttatgtatttatttatttatttatttgagagggagtctctctctgttgcccaggctggagtgcagtgatgcgatctcagctcactgcaacctctgcctcccgagttcaagtggtcctcctgccacagcctcccaagtagctggaattacaggcgtacaccaccatacctggctaatttttttgtatgttagtagagacgaggtttcaccatcttggccaggctggtctggaactcctgacctcaagtgattcacccaccttgtcttcccaaagtgctgggattacagacatgagccaccgcacctggccctttaaatttatttttaactgacttttaagtttttagttgtcattctatatctgcattttaatttacttattgtgatccttgcaatcatgagtttgaaatgctattgatatttttctaatcatattaaaatagatgactattgcaatacagaatgttcatcttgcactccgctagtggcatgcatgctagctttgagaagtagtagccagatggtcgcagtggattaatttatggcttgacctgattttatgtagtatatccttgagagttgacatccttgggactctcatttttaagtaaccttgtgttcagcagaattcacgaactgaacgggtctcatgaggatactgtccctgatagaggtcagacagcacaaacagctgtgattgcctctctatatgtgcaaagatgtccatttggaaaggcttgatctgcttggtggggtggtgcttatgtgccaattacctttgctccggcctgtgtccacagactgctggccatctcccagttatgtggccctatttacaagggctaagtgaccctgaaagtgtggaagaatcagagcaaactctgtccttacttccaaataattggctcgaagcatatgttgcattcatgttggccaagaatgagagagaaggatgacagagtatagcagaaacacagacactcccttcccaacacccaaccaacagaacgaaaatgcagttagaaacaaaatcaaacccagccccacaggctcttgcagcaagcaaacaaacaaaaaacaattacagctttatttcaaccactttgaaaagtggcaggcaaggaagggtgcaccccaccgtagcccctcagaagcagtactggaaaaggaaggcgagaggaccagttcctgagggttcctcctaatacagatcaatatgggaagcagctggttgaggaggtgagtggatagacttggtaaaagttaaaaaaacaaaaaacaaaaaacaaaacccttggcagagttaggaaggcacctggggaggccatctcctagtctctgtgttgagttacaggaaagagaccataggagtgagtctgccctggtttggcagagtgggccctggtctaagacatttaactcccctccaaaagaggacagagtatagagcccccaaggacaggcctcatgactcctgcctctcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataaccaatctccaaaagtcttcatctttcaaaactggaactctgtacccattaaacaataattccccatttctccctcccccaccccctggcaaccagcattctgctttctgtatctgaattcgacaactccaagtacctcatatgaatagaatcagaaagtatttgtccttttgtgactggcttattttacttagtgtaatgtcctcaagattcatccatgttggatcatgtgtcagaatttccatcctttttaaggctgaataatattctattgtatgtctctgacattttgcgtatccattcatccagtggatactcagtttgcttccacctttggctattgtgaataacgctgctatgaacataggtgtacgaatttctctttgagtccctgcattcaattcttttgagtatatacccagaagtgggattgctggatcatatgctaattctatttttaaatttttgaggaactgccatactgttttccacagcacctgcaccattttccattcccaccaatagtgcacaagggttccaatttctccacacccttgccaacatttgggacttactgttttttgttttgttttgttttgttttgatagtagctctcctaatgagtgtgaagtggaatggattttttaaaagatagagccaagaaaagaaataaagaacaaaaacacaatacaacgttaaaaccagaacacacacacacacacacacacacacacacacacacacacacacgatggacatagctgaaaatcaaagagtgagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttgaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattatagagtatttctataaaaacatgcagttaacccttgagttttcgtaacttttttctgtgcattaaattgtgtgtgtgtatgttttcaagtatgttaacttgtaaccgctggtcagaatgtcattttgtttcacttctgctttttcttctgttacatccaaacaaaattacatagctcttactggaaagaaaaggtcatatgttatcattttaaatgaacccattaccctctatctagccttctaccagtgtatgtgcatacagagatatccagaatgatggtcaccaactgtaaacacaatagcgggatattggatgatttcttttcttctttgcgctgttttctgttgctttattttttttttaatgagcctatgtttttatacaagccgtaaaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctcaaaaaaaaaaaaaaaaaaagtttctgtaaaaacattttcacagatacttaacagcattgaagccctgaatcatggcgttgtacagagcagcccccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaagtaccgtgttgggtttttttttttctttctcattcctgtgttgcatagattaagggtgtaaaattacaatagtcttttttttctttttggaacagaattaatagtaacagtgaaatggttactttcccaagtcaggataaatagctcaggcaggatgtctgtattaaatattgtaagacactaaagctccctgcaaagaccagttcaaggaccagcatgcatacccgagcccttcatctttaaaagatcgctcgagaaaatcctgtgctgtttattgaaagcattaagtcaggggacgagagggggtgtggtctttccattgaagccagaatgactgaagtgttgtgctcctaaggagtatgatttagtcttctgtccttttatcaatagcacatggtgtttatagaatgctttactgttttcacggcttttcctgtatgtgatctcatttggacctctcagcaatgctgtggggcagtgggcaaggtggttcacctccttctgtacagagattgagtgattggcccagggtgaatgaggttgggtgccggctcctgagcctttccaactgctccacagggctcctccccttctctcttgcatgctcattgaagaagcttgaatcctgctccccgcctactaggtgtatggccttggacaagttacttaccctctctacacctcagtttcctcattggcagaatggggaaatgattgtactcacctctgaggtctttgtgatgattaaagcaataatgtccgccaacagcacatccagatgcagctcattgtcagctttcaggaaatggtagctgttaatttgccgccactgtggctgaaggtatggttagaccacaggcaaagctgaatagtggctgaaagctgagggcactgtgggaggagctactattgccacatttcttactaagctttaaaatgggatttgattttataaactttacaatggggccagtctgtgatctatccttcttaataattacggaatctgtttcctaattctaacataactcaggatttttcaaaagggagaaaaaaatcatgttttttatttctctccattccaagaataaatttatggaatggtagaattgagcacgaagtgggtacttaaaaagatgacaatagtgtgtggataacatcctttcaggcatcttgtaaccatattcctgttactaaaaaagagctgctatgccacagtttattcttccagtgaattcggttcaaaaggatagtctactggccttatcagttcaaatttttcattttgtagcccagccaataattcattatcttataaaattctcatgcttttggccatatcactgtgcccagtgatagactgtactgctgtggcatcttcagtgaatcacttgtcattttgaacctgggacttattacattgctgtcttccccctgggtttcctaatagagagttgctttggcttttgttctcacagctcagagtcacattcatggatgagtgagtagagctgggctctgctgcgtctgactagatggcattttagaagcaggtctgatgattagctgggtcatctttccgccattcaccatttgcaaggaatctgtcacgcataaagacactcgtgggctctgtcagcagtgagagacaattagtgaagaacaagcccacgatgggccagacagacagggccgagggggcccttagagacctctgacttgttgcccttcacaagcagagtgtcttcaccaccaaatggcggcagcccctccctggcctgctcacgtgcttgcagaagatttgcagagtggaagaacagagcagctgaatccctatcttggtactacctctggccatgaagaataatgctacatagcagctgcctacctcctaacagaactggggaggtgaagagcctgcagggatttcctgtgtttgtatgggagaagattctacaatttcagagactgttta

SEQ ID NO: 16514 - DNA, 160759 bp, Human
  misc_feature (1)...(160759): n = A,T,C or G
tgcctcctgccaggcaaagataatgttatccaattgcaaatgaaaggcttatgaatgaaaagatgaccactctgactttagtgtatgagagccactgctgaaatgataggatccttgaacttcacatctagagcagaaactcacacttctcttcttctccctccacctcacccttctttccttaagccttccagaactcctgccatatccctcagcactggggagaacttgaagcactgttggagaagtttgaaacctgcaaccttcggcaggactcagcatgggacaaaagccacctcattcctttcccttcccaaaacagcatctcgagctggggaacttggagggaaggaagaaaggggatagcagccaattgccctccctggggcctggggtctggaaatagcctgggaaggaacagagatcatttcccaacgatccatagaggtcctcagcaccctccactcctatgcaccccctggctcatctgccagactgtaagggtgctgatggtgcccgcagctgccccgggaagctgggaggcatttgtgcatcctctgggaagccccattccgagaaatcatgaacctattccccagtgggcaatgattccctgtgcttcagaaattcttggcggctgtgggggcaacccagctgttattcaccctctgggtgaggtggtgagacctcagggggtccaaaggataaaagtgggtaatgatgagacagatggagagcctcgagggaaatacggggacttgggtctaatagtagaaagcagggcgggggctggttggtgcatttaacttgaggaacttttcagtctcactacagagaatgatctctgggggattatggcaatggccacaggtggcacttaactagagccaggtatgtaagaggccctggggctagatatggattcgaatctcggctctgatatctaccagcagtagaatgccagcacgttccacaacctttctataaccattctcctggactactaagtagggatgacaataacagtcactaattaatagggctgttatgagaattatgagtcttaacccatgtggtgagttcacaagcgcacccggcacgtagtaagtgctcagtaaatgttagccccgctcattaggttagatggtgagcagaactttccaagtgctaggcttgagagcctgggactctgttgccaagggagattagagaacctttgcaaatatgggcgctccggccctggggattgtccagaacgagagtgtggcgcctgcctttctgccacctcactcatccgacccggggaaacccacaccctgtcacaggggcgccttggtccccggagtctccggctcggccatgtctcccgcgcgcctccccggggcctccctctcgccgctccacacctgtcagccgctctcgcagcagccctgtggcccgagcccggggcctcagctgcaaccccttcgcaccctggatcctcgctccgcgcgcctggcgtatccccgacccggctgctgtcgtaaacaaaaccgggcgttggagcagcaccgcgggcggacgggcgcgggagcccgctccgtgcgccgttagcgcgccccgggagccccaggcgagccaagggggcgatggtggcggccgcggcggccgcggcgggcggctgagctttgttatgaatagatgaaagaggccacctacacagtaacccaaattacgagacctccctcctccctatctcaccgaatcaagaggggaggggagatgggcgtggagggagggcgggcgggcgggcaggaggcggagggcggaggaggaagagaggatgaggaagggggccagttgcatcccactttcacaatgggaaagtgaaacgcacaagcgcacccaacctctccagccctccccgcccgcctcgctcctctccgcccgtcccctcccttcccctccgcgcctccccgcgagcgccagcgctgcacacaggaactctccggcgaaggagggcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtttccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcagcaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattaattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctaccccatcgtccacaactgtatctttaccttttcaccccctcaactagctaccctgtctttgggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagatggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatccccagctattgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaannnnnnnnnnnnnnnnnnnnagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttgaagttgagtttaaagattgttaggggcaggcgcggtgactcacgcctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatgacacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcaccggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggattttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgctaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaagtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacaaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactgagctataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaatagtatctggcacaacgtaggcattcacaatcaataaatgtttcttgaatgaatgaatggcttgaaggtggagaatggaccaaagaagggaaagactgaaagactgagttccaaaagatcacttggaggggtccaagtgagagggaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttatggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggaccctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatggtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactatgttacccaggctgatctccaactcccaggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcacgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggtcgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccagggatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggcgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgttaacccgggaggcggagcttgcagtgagccgagatcccgccactgcactccagcctgggcgacagagcgagactccgtctcaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagagaggtgaggagagggctcgggtgtgaggcttcacatgttggttccttctagacactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctggatcctcacatggtggaaagggcagggcagctctctgaggcctcttttataagggcactaatcccatttatgaggactctgccctcatgatctaatcccctccaaaggccccacctccaagtaccatcaccttgggggttgggatttcaatacctggagttagggggacatcaatattcagatcatagcagcattaaagacaagatacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggctcagaggtcacccagctggcttgcggtggactgggatgaaagccaggagtctactggcttctactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcgtcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctacgcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccactgaactccagcctgggtgacagagcaagactccatctcaaaaaaaaaaaagtgacctctggcatggtcaatatggggacctcgtaaccttccctgtcacctagaactgcacttctgggactctgtggtcctattaataaaaaagataatcaccaatctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctcccccagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacacagatgcccaaaggggcagaaaatacataaggggtgtcagccgcctgggactacagaaagcagtggagcttgacttaatgggaaaggactcgccatccaaggagacagtgccatttgcttcagtggttgccatgtggactacagattgtattactagactgttcgattttctttttttaaagaaatcagatatccagttttttatatgcaacttaaaaacttttaaaaaaaattttatagagacagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacctaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagatgggagttttattattactcaaatcagtctccctgagcgttcagggatcagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgtgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattgggatattttaaaatcccccatctttttttttttttttttttactcttttggtgatggttgctttttttttttttttttccccctaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacatttcatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaa

SEQ ID NO: 16515 - DNA, 163022 bp, Human
  misc_feature (1)...(163022): n = A,T,C or G
atatactgtgctgctgggggaaaacaaagagcaaaaggttcttaactgaagtcaaagacgaccaagaaaatgtaggcagatgtcaggtctgatcatgtggatgctcaaatgataaacagacacattgagagaaattgtattaattaaatcataaaaatatgttccgctttttggggaatttactcctcctcctggggtgacccttgacaagacattctgtcttcctgtttttaagcaaaaaaaaaaaaaaaaagtgggtagaagatgaaagtttgatatttcgctcatgcatagctttgtctccttaatatattttgtgcttgcctgtcatttcagctttctgctggcagacgaagctccttcgactgccattcctacttctgacactcctcttgtccttttcaggacaactttatgcctattgtgccttgggtcttgagaagcatgtggtaaaactggccagtggtgatggcaggcatagcagggaatcagattgaggggggctgtggcgtgggagagaaaacaaaagagggaaacaggctatttgatgacagaatcaggctgcttctgcaatgacattacatgaaatatctgaaatttgaccttaactgtatctggtgggtcccgttaaccctgtaagttatggacagaacgttcactcaaattctagcaacgtctaggctcatggaaatacgtgaccaattcaggtgaatgaaagggattttaaaacattaatttccagcttaggtcttcctaagactgcctgcgtgtcccttaccaccactccagcctgagtgtcacatggatcctgaatgcggacttgtgtgcacactgtagaaaaataagcaactgaaaaccccaggcatcggggtggagtgatgatgaaagacaccgagaccgaagatcaggaagctggaaattccccccagcttcggtgtttgggctgtatctcgcttttccacttccctaaatcaccctcgtggtgcgagtgtgctcgcagcagatgctccctaattgtctcttgtattgaccgtaaaaccctaacgacaggaatactctctctccttctatttctcaacaccatttcaacacccaaactaaaacctctcacctgagtgtaagggagtggtgaccttcttaagcggagagctcttccatcagagggctccctaagggcatctctgttcctagccggggagccgtcaccccactttgttctgcttagcctaagacacgcaactttttccagcttttactcttcgctgaattctcacggtggggttggggggatgttcaggctcaggagcgaggttgggggcccggcccgctgggcgctgttcaccggtagcccggaccagagcaggagtttcatcattacctgctgggataggtgggacacatgtatttccggggccaccccagacctcccggaggatgctgattgacactgtccagtttgagaactactgtgtccagggagcagaggcctccccataaccccttgggttgtggacgtctggcccagggcttctctgggtgagcggggcgggcatcagagcgcgtggaacctggggcgggaggtcggggcagtgaaggaggaggagaaggaggaggcggagaccgagggggagggaggggaggaggaagaggaggaggagtccctcgtggccaccccgaggggagggcgaccgtagagacttggtcgggaggcgccggcccagcgaggccgctgggactgtgcactgaggggcgctgaccgttggacgcgcgctccccgcagaccctcgctgaaggagcagggggcggcgcgcgtgcgcggggcgccgggcggcgcgcgagggggcggagcggggaggcgtgctgcgaccccggccggctacagcctgcggcgcgcgcagagcgctagtggggcgcgcggcgcgcgcgcggggcgggggcgcgcggaggggggggctgccccggggcggcccccccaggtcggggcgcggcgggcggcggcggcgggcgcgcgtcccgtccaggtccggagtaaccgccgccgccgccgccaaagctcgccaacatggcggacctggaggctgtgctggccgatgtcagttacctgatggccatggagaagagcaaggcgaccccggccgcccgcgccagcaagaggatcgtcctgccggagcccaggtaccagctgccccggccggcgccggccccaagccgccgccccctgcggccgccagctaccccctgcttcctggagggtcgggcgctgagcctccgctgccccggggcgggtgacacagcggagcgggcgatgcggggccggcctcgtcgttccagtctctgaaatggggcatcggagggccggtggggggcaccccgggagagagcgctccaaagtgcccggcgcggcgccctgcgcgcagcgagcgccccagccagggtctggttatgacttggctggaccagctccatccctgtcgccccctccccccagccctgtcctgtcctgccctgtcccatccccgtggttcttcctgttgcattggtgtagtccccgttggctccttgcctgtcactgctttgcgctccatcctggtcgctccttcttcccgggctcattggtccccctttccaactccatcctctcacctccctctgggccgcttacctggggactgcaggcttgttgcttattgtccgaggtagttaaactgctgttttcagtacttgctcttcttgaagtctattaagtctagtcaccttcttcggcttctcttctattttgtccccgggcaggattttgacccactcagtattctttttggtgccaagtgtgtcacctgagctgctttcctcaacttgtagatctactggtggcactttattaaaaaattgaaacaggagtcacttaaaaagacacttgaatgggtgattccagacaggaatttgttgttaaattatcaaaggagggcccgattgaattggcgaggggctcggtgaggtgcataccaagttgcaattttctctcaaatgatttattattaaggtactagtaaaattttttctagttcatatcattagcacttccccagaaaaaatagtttgtctggttaatagtgagttttaaataacgtatcaaggcttcagtgatggatttttttttctctagctcctttcctaattaacaccatcatgagttgtacagctaatgtgattccttgatgctaaatagctcttggaattgatgctcaaaagaggcatcttgtttatggtgaatttgaaaccatgcaattctgtaaaatattggaatctaaaccaaagttattgtccatttgaaatcatcagtccttcaagcgttaggcgcccaagattgcttaaatgttacctaatgctaagtgatcatcatctgattttttttacaagtcatccatgagccctatgatacagaaaataccagtccccttgttatttgttgtgaaaagctaaattgtgcaaatgaagacatgcttgctaggtattttgagcttgcttttcctccttagcccatgcctcttgttggttttgcaggatgtgctactctttgatagacaatgccaagtagtgaaaatgagggaaaagtgcaaacctttctgcaatgtcgtgagtttaacacccctattccagagtgtagcatatctgaagctaattgaaaaaaatcaatgctgcttaaaatttccggcaaatgggaaacttacttagagaacaagaacgcctacatcaaacctaaatttcaccaaaaaaactgtacatttctaatgtggtagaaaaaggcttaattcctcttttgtcttgcctttcctagtgtccctccaccacccaaaggcagggagtcctaaatatgtagtatttctatatacaaaattgataaatctcaactcatgggcagttttttttttggggggggctagtatataatattaataaagttaggaacttctgttcagttttttttttcttggtgtttggaacttaatgtgacttctgcttttttagtgtccctcttaagaacgtacttatgcacttagggtgttcacttccttgtatgaatgcctttgtttttcagtggtattctttggtaatgctttcttttaaggcagagtaagtgacagccagcattatttctcatgacatttgaaaattgagaaataccaaccagagagtaattttaggaaacagcccttcagtaattgttactctgttgctctttttaaaatagactctcgaattgggccattggaacctcctcctgagattctaatttgttttctacttatcttagtggctttggctttagttttgtaatgtagctatttacatagtaacagtcactccttgtgctgtgttaggattctgttacattgagattatcaggtataacatcttgcaaaattctctctaccactggatggcagttagtggcctacctatttgatttggaggttgggggttggggaatttctagatcctgtaaaaaagttaattgcatgttaaaatgccccagcctaatgacttaaatagctggtatgacttcacactattggtaaaagggatacgggtcaaatgttttctgataagtttctatttcagcttcattatagaggaagccatgtgatcaccagtttttggtattcttgaaagagatgttcagatttgtatttttggtatctgaatgagaagcatacattttaatttgcctttggtctatcactagtgatttttttatttccagcaaattatttgcagtcactattctttgtgcttccttattttagttactttgcctttcccacagttttaaacagaagagcatcagaacgaaatatctagctaatttaaatgaaacactgggtttgcagcttcctgcctattacaggagagtctcagaaaatggaacattctgcccaggggagattttgcttccctgagatggcaagaggcaaatattttgttatgttgacactttattcagttaaccaaccaatgagtgcaaatcctggaaaagctgactgtttgtccaaatggtatagctgctttagtttactgaaatgttgttgagctaatgtagctgataatggggcctactgggagtagtaaactgtgacccacagcctcccttgcaggcccagttaaaacaggagcatttagatgtgcaggccagttgttttacatcatgttggaaaagaaatacttttatttaagtaaggtctaattcacaagcaaaggcccacaaagggtcatcatcttaagccctggagtgattcagacgacttttactgtaggctgtattactctgttactcttttttttttaaaaaaaacagaatgaaattcagatgacttgaaatcacatatagttgaaggcggttgagtaatgtgaacttcatctttcccctggagtcttatttctatttactggacatttcaaatgttggatcacctattgcaaagcttgtcctttcaaagtattcatacaatatgataggaaggtctgaaacaacattttaaagattctttataattttctaggagcactgacagtccttaaaggacatttatgataccgtttatgacattaattcagtacatagttgtagagccatttctatgagccaggcacggggtactatgacaaacccagccacagccccttccttcatggagcttatagactagtgtgaaatacaaagatttgagccaagaaggatgtttgctttgaagtgtatttgcttgaagattttatttaaccacaaacaaatagcgtttggatgacttttattactctatatgcatagaatatagaataataaagaatgaatatagaatatagcataatgcatagaacacatgatgtttggtgttttacaataatttgttagtgattacctttgaagaactatctaaacatagtctccatggtgatatggtagtttgcatctttctgtttgtgtagccaccacatgtaattgatctttaaaaatgtcccagttttcttctttagtggacatggagtttattcggtaattgtttaactccaatcagtaagtgattggtggataacttgaaatactcctctccgtttaggctgtagagttttctgtgtcttcactgtcctgtgctcatagcctaattttgaactgaaaagtccacgttgaaagcacaaatagcctttagaaagaaagtattccttattattgataggagtgtttctatgtgtaagaaacagtagtgttcttgcttctttttcattaaggtacaaattcaaaatgtaatttgttctgacctttcagttattatctcattcttggtccaagttaacttgtgccagtgacttgaagatgcaaggagtgcgtgtagatgtcaattcttagaaatggatgttccggtgaaatcagttttggacctagaatctgccaaagctgagcatcatgaaatgcttcgaatcgagagcctcatagatctctctgaggtacaggcagtcccagcttttacacgcaatggattcttagagacagcctcttacagtgttttccccagtacaccggactttgccaaacatctgtttggacaagggtggaaactatccgacgaaggtgtcaaggcttgaggaagggaagcacaggtctttttcagtcagtggctggccagcaaagcagtgaaatgcaaagtagtattaaatagctagcaggacgcctggcctccctagggtccctggagccctggcaagggaaagagaagtttaacgtccatgatgtaataatgtaataactgcctttaattgagagctcatcctctgtcaggcagttggcataattagttcatttgtccccacagtagttctaccaggtgagttgcattagctccgtttaacagaaggagcagacactcagggaaggtaaggagctcagcccaggtgacacctgacagtgggagaggcaggagggacgcccaggtttcgcccagctcggggtctttccccgcccaggcagggtcttgctgggctgccccaccaaaaacgaataccaaactccctcgcgtcttattttgcaaggaatggatgaaactgcgatacttttttatttgggggaaaaaatcctttttcgtactctcccgatcagctacgagtcctcagagactgatagagaattcctctgggacctgcgaaaacggtaattatgagtaagtgaataagcagcttgttccttatttcccatgagcttgaaggtgaaatgcctattctgtttaacacaagtcatgcaatcttgctggtgttaatgagaaattgtgtaatacaccatctcaccccccaaggcctcaaaacaggatttctactgtctttttatttagaaaaggggccacctaagctgccctgtctcctttttatttaaaaaaggggcagcctgagctgtcccctcccttgaaattttcatttctgggaaaagagtaaaagggaaaaacaatatttttggctttatttgcaataaaaatcactttctcattcacataatcttcctttgttagtacagtcacatatctgcggaccactgtaggtgaaaatgtaggctgtctgcatggctatcattgtctcttcttattctctggacattggcaatggggaaatggaaatgattaatttggcaacttttactctattattgcaaaatcatttgtatggtaagtaatttgcatgcaaatgggactggatatcccggcccccctctgcttctcctgtgtcttacttttttaatcttcccttcctatttttatcattgattagaagttacaacccctgggccctttttgattgctctatgagcctaaaatgcagaataagtaataatgtggctcttcatatcctgtaaatgtttcttctaattttggaagccttcttttgggtcctctgcttccactggagcatacacatatttgaatactttctatgtaggacactatatagagagcccatggcgaatgcagtgaaaatatttttgcgacatattttgtaaaatattttgtgataggtagttggtaaaggtcagcttgatccagccttggacctatactgttgtttgccaccatttccttctcctgcagtttcaggagcagaaaaagatgctaatgtgaaaatagccagcccagacctccatccttagtgcaccagaaagccactgtcattgctgggcccctcgttttcctgtgccatccctactacctaccaaactgtcatagaagagaaggttctaaatcagaagccagacattaaggatctgattccactggcagcttgctatgggacctctggaagtcacttaaatttgctgtatttagtttctccatcagtaaaatacattatctatttctttctgattgtataatgtcccaataaaaatctgccttgtgagcattttctgtctatgcaatacatttgtaaataataggaaacattaaaaattacccatattgaatttcagacacggataactcaaacaaaaagatgagaaggaatattaaaagaaatgattaaaaacacttatactatagggttattgttgttgagattatgtgtagtataagatacaagtacacctttaaaaaagtacaacataatagcgaatattaaggcagtcttgcaagtgctgtggtgccatgtgctctgagggaggagggagtgggtttgggaggcaggacttctgaaaagctggatgattggctggaacagagaagagcaattgttgagccttagactcataagtaggttgattgcccagatttctcagttttcctcctctagctgcttattgtggtactgtgtgtctagaaccttctacacatgataccttactcacacttttttttttaaaattatactttaagttctagggtacatgtgcacaacatgcaggtttgttgtatgtatgtatacatgtgccatgttggtgtgctgcacccattaacttgtcatttacattagatatttctcccaatgctatccctaccccttccccccgccccatgatagaccctggtgtatgatgttccccaccctgtgtccaagtgttctcattgttcaattcccacctatgagtgagaacatgtggtgtttggttttctgttcctgtgttagtttgctcagaatgatggtttccagcttcatctatgtccctacaaaggacataaactcatccttttttatggctgcatagtattccatggtgtatatgtgccagattttcttaatccattctatcattggtggacatttgggttggttccaagtctttgctattgtaaatagtgccgcaataaacatacgtgtgcatgtgtctttatagcagcatgatttataatgctttggatatatatccagtaatgggatggctgggtcaaatggtatttctagttctagatctttgaggaatcgccacagtcttccacaatggttgaactagtttacagtcccaccaacagtgtaaaagtgttcttatttctccacatcctctccaacacctgttgtttcctttttaatgatcgcccttctaactggcgtgagatggtatctcatcgcactcacactttcttgcttgcttgctttcctccctttcttctttcctttctgtctttcatctatccatctatccatcccgtaggctctgggatggtggtatcagtgcctaagagttgcaagcctgctacttaaataggtgtaaccaggcaattagcagagttgactcattctttagaggtttttgtttcagaaaaatgaaccaaaaatcatgatctgaaagcagctggcttcattgtattgtgcataaggtgattcattacagtctttcttagacattaacagattgtatatgaataacataggattgtagtatctcatgtttgaaaagatgttgggggacatccaatctagttatgctttttgatgagtgacttccctctctaatatctagccacaggcatctttgatgagcatctttggaaactgttgtaccagaaagctctcttgtattaccttctgtgcactggtctcttattatccttttgtggttgtgagaaacaagtttagttcctcaaatgtgacagatcatcaaatatttgaaggcagctcctctagctcaagatgccttttataggaagctgtccccagctcctttacttattcctcataatgcacactgctgtgtgtaatctatgctcattagtctgaacattactgagctgagtaagaatatcaaaatttatgaagaccaaaaagagatctgtaaaattatcataattaatttagtaatggcaaagctagtaataaattctatttcaagtgtgtgattgagtccctctgaagttccattttaggatttggttccttgaatgattcaaaattcattataccagtttgcttaggggatgaatattttcattagtcagagtttggaagccaggtatgggttacatgtgtattatgacaacagctgccattgctgactgctaagtaggtactaggcactgtataattcttagacaattatggactaaaatatttcaggaagaaagtgagctttaaatatgcagaaaaaggtcataggatattagggggtatgtttcatatagtcaaaaacataaaatgactgtaatcccagcactttgggaggctgaggcaggtgaatcacctgaggtcaggagttcaagatcagcctgacaaacatggtgaaaccccgtctctactaaaaatacaaaaattagctgggcatggtggcaggcacccacaatcccggctactcaggaggctgaggcaggagaattgtttgaatccaggaggcagaggttgcagtgagctgagatcgtgctattgcactccagtccgtgtggcaagagcgaaactctgtctcaaacaaagaaacaaaaaaaccaaccaaccaaccaaccaaccaaccaaacaacaacaccaacaacaccaccaccaacaacaaaaacccataaaatcccattggctggggaagacagcaagtttcttcaatgtcagcaataaaactttcttgaataatatgctgttagtatttgtgcattgtgtcattaagtcggtccattgatctttattatcttgtttggatactaatatgtctggttatattttcaggtgtatttcttgtaattttttttgtatctttattgcctttgataaaagtttaaattaaaaatgaggccaggtgtggtggctcacgcctgcactttgggaggacaaagcaggaggattgcttgagctcaggagttcaagaccagcctgggcaacatggtgaaaccctgtctctaccaaaaatacagaaaattagccagacatagtggtgcgcacctatggtcccaactccagctactcaggaagctgaggtgggagggtttcttgagcccaggaggcagatgttgcagtgagctgaaatcatgtcactgcactgcagcctgacagagtgaggtctcgtctcaaaatacaaagaaacaaataaaaccaaaaactaaaagttgcatggaatggcatttacacagctgttaaatattgcagactttcattttcctttgtgaatgtctaaggccgtgatggtattttggaaacatcttttttaaaaaatatgaggtatttggtggtggtggcggggtctattctctatttaaaatggaacgaatcctaatggctaagtaagatcaagggactttaatacacatctttaacctggtcctacctttttcaagtgaattttctttgtctttttttatattatgacacagtaactgggaagagaatcatgcaataaatatcgtcatcaccagtaagtctagaatagcgtgcaaaatttctgtgctatctttttttgttccattttggacctgcttctttctgttttgtttctagtggcagtggagaaaagcttgttttttatgcaaaacatcccaataatatagaagagaaaaattgcacaatagcagtttctaagcaatgaatgagaggacacgtatgttggtgactttgttgtttctcttcatccctccaataaataaaaccgagagttttgtggacagggatttattagagtttcatcatttagttgactggcttattaaattccacatggaaaactagcttgactctccacatttctgtcctttaagtaaggtgacctgcttgatgctggattgatgtttcaaaatattttaaaaattcaggctactctataagaaaagcttatttggaaactccttcttttgagatgagagttctaagtgaagcgttatggcctatggttatgactagctggggtagcatagatgatggtggagcagatagaaacagcagggcaagtttgaagtgctcagtggtgctagcctttcacaaccctctttcccttactttcaggaaacttatgctctagaactagggtttgaattgggtcagtattgaaatgatcttagtgagaggccaacttgctggacttctcttctagatctgtagttataaaggttagctcattaaacccagtgacagtagatggtcatttatttcgtgtttattacagtggatggtcatttatttagagtttaagaaaaccccatggtagatagtcatttatttagagtttaaaaaaaccccactaagatttgtagatgatgttttatagttttatatatattaactctttttagtttttacaattatgcttggtagcaggtagaaattttaaaaagaaaaaaattactccagatacatccatgtggagacattgagaggtatattttatctgtttgaggacagctggttttctccttagatactagtgtcttgactgtggggcagggagtggctttcagccttccagactcagaaactagattttattatgtcactgtactaagcatctgtctcttattgtgaaactcacataatcagccaagtctgcctgactaaattattctcttcctataggcctctggttcttattttaagattaaagacccttttgagaatcctactaagtgagagcctccccctcccaaaagtgcgctaactcacttacacagatttatctgaaaagctacactataactagaatgtccagtttgctacattgcattaaacactggctcccacaggagcctacgtgcccagcgtctgtgtggctggagctctctctcgtgggtcccccttgtgggaagcaaaacgaccatcagaaggtggtatagcgagcacagacccacagtcggatgagtcagatggttacttgggaccaagtcacccctcctaggagtggcttacgctggatgtccagtacctgaaatccctgactacagtggctttgggacaagtcatctttccatattttcatgtttcccattgtaattggtgggcacacgtccactggatttgagactatagttcatgaaaccactgccaaagctgcctagaccagaaacctttgccatttcttggccatttgtgttatgtattgatttaaagtttttattctcagagagcaagcttttttctttatttagagattcttggaaatggctctgtaatactcatcatcttattttagaagaaggaaattcaggttcagggagaagctaattgctcaaggtcgcgctgataacaaatggtgcagctgagcttcaaatccaggttttctgattccaaattcagcgtattttcagaaaaaccttcagactgtctttttcctggtgaatcttattttatgaggagggggctcatggatttgactagaggagcactgtcaatttcagacgttagtgacacaatttgaaaatgcattgtattcattcagtaaagattatccactgcaggggtctgaggaagtgctccagtagcataatttcactggccatgttaacttaataataaatacattaataatttcctagaagaaaagatgtcatagattccatgttaactaataagattgttattaataatgatggcagtgttataacttgagaaaccaactaagctacatgtcatgagttcttaatgttttcttaccccaaacatctttttgtgattttaggtgcattcttaattaaaattcatctccatgcctgccagttggtaaatgagtatccttgacttgaacacgtttgtcagttactctagatacaataaaggattttttttttttttgagacagtctcgctctcttgcccaggctggagtgcagcggtgtgatctcggctcactgtaacctccgcctcccaggttcaactgattctcctgcctcagcctcctgagtagctgggactacagatgtgcaccaccatgcctggctaatatttttctactttttgtagagacagggttttgccacattgcccaggctggtctcgaactcctggcctcaagtgattcaactgcctcagcctcccaaagtgttgggattacaggcatgagccaccgtgcctggcccgtaaaggatttttaatgttaaacttggcactcattagcagttcattctaaattgtgatggaaaattaatggagcgggttgcatatctaacccctacccagaaaggttgttgagctcagcttgggacagagttgtatttgtcaggagcacattagtaaatccacttatggcttttgccttcttcacctagtaatgcacgtggagcttttcctcgtcagcagtatatagatctgttcagtgtttggaattgctgcatgagatgtcagaactctgatctacttgaccctgtgctcataagcccaagagcaattgcagtgaatgttcttacataggtgcctttgggtctatgtgtgagcctttctctaagatagacacctagaaataagtaagatatgggcatagtctactctacgtagagctgcaaagaaattctaattttattcagaagctttactgttaagagtaatattatttttagtttgaaattatttcatataaacaattatttcatatatatatttgggtaaaacaaaaaagaataatgtcatttttggttagaaccaagaatttaagtgtaaatgaagagatacatgagtacaagataagagttaaataaaaattctgtaagatcaaatttgaattggaaggttatttgaaattcatgatttttttttcaaatatgtgtgcttatcatccccagtctttaaaaaaatcgaagaaacaattgcatttccatcacataggcacctcatacacctgcgcctgactccaggtgtgggtgagatgagcctggaccctctgttacctgttgtatcagaaaaaaaaggagccatccaagaaatgtggtgggcaccttcgctaacaaactctgaggccagaagaaggggtttccactggctaaaagtgagacaccctgaacatcaaaagaatatgactgatacaaaccccctgtggtgggcagaatgatgcccccctgaaatatccacatcttaatccccagaacctatgaacatgttatgttatatgacaagggggcgttaggggtgtaggtggcatcatagcagctaaggtgctgagtttaagataaagagattatcctggattatctaggtgggccctagtgttaccgccagggaggcggagagttggtgtcagagcgatgcaacatgagaatgagtcaaccaaccactgctggccttttgaggaaggaggaaggggccatggaccgaggaatgtgggcagcctgtagaatctggaaaaggcaaggaaatggcctgtcccttacagcctccatgtgagaccgcagtcctactgacactctgaccgacctcagcccagggaggcccatttcagacctctgacctgcagatctgtaagagagtcaatttctgcttgatttaagccaccaagtttgtggtaatttattatggctgcaataacaaactaataacaaagcatgagtttgtggatatctcatgctatccacaagagatccccaaacaagacagaagagaacacctcattgatcaccaccagcagtagaaccaaggcacctactctgtctctgaatagtggcaattgaaaaggtaaagaattaagcatttatcctgcctttcctgtaaaaactgcttcttagggtatttagaaccctagttgatggttggggtggcaggacaggaattctttttttttttttctttgtgacacgctctcgctctgtcacccaggctggagtacagtagtggtgtgatcacagctcacttcaggctcaacctcctgggctcaactgatcctcccacatagctgggactaagggcacatgctaccatgcctggctaatttttttttttttggtagatatggggtttcgccatgttgccaaggctggtcgagaattcttgggctcaatgatctgttcacctcagcctctcaaaaagttgggattgcaggcttgagcctctgtgcccgaccaatgaatgaggggacttctttttttatttttattattttttttttgagatggtgtctcactctgtcccccaggctggagtgtagtggcatgatctcagctcacttcaagctccatctcccgggttcacggcattctcctgcctcagcctcctgagtagctgggactacaggcacccaccaccacacccggctaattttttgtatttttagtagagacgtggtttcaccgcgttagccaggatggtctcgatctcctgacctcgtgatctgcccgcctcagcctcccaaagtgctgggattataggagtgggccaccgagcctggccgaggggacttctttacagaagaatggcagcaaattaatgtggaaggaatggcgaaattttaaaaaaatccccattttgcaattcttaatgaaaatattgatttaggcaaagatcatcaatgtatgatatcgctaaatgaaagattgatggggaatttcagatggagagatcagactatcaccaactgaattttctaagtaaaatttgcatcactaggatgaaataactgtgtaccccctaatgtgaggcaatataagtaccaaaaccatctcaaaagtattcctgcccccaaatggtggacttgaatatgatcaagccttttgaggtaactttcagtttataggaaatatggagagagaggaacagtgaaagaccttatagggaagcaacagacagaaagggcatcccccatgatggcttcctcggcttcctcagggggtcactgcagataaaggtcaggggtggggacagtcaggtactctccctgtctgccttaaatcccagaagagatttaagagatggcgctatcagatgaatgtgtggatcttggttagatccagattgaaacccaccagctatacaaaagacacttgagtcatggaaatgtggttagagactgggcattggatcttcaggaattatcaatttgaagggggagttgggaagtgataatagactgtgtttatatgagaaaattatccataatttttagaaatgcaaactgaaataggctaaaacgacatgtggtctgagatttgttattgattgattgattgattgggatggagttttgctcttgttgcccaggctggagtgcaacggcacaatctcggctcactgcaacctccgcctcctgagttcaagcaattctcctgcctcagcctcccaactagctgggattacaggcgactgccaccatgcccacagctaattttttgtatttagtagaggcggggtttcaccatgttggcctggatggtcttgaactcctgacctcaggtgatcctcagatgagccactgtgcctggctgagatttgttttaaaatgctttaaaaaataaaggtgggataagtcgagtggagtggctcatgcctgtaattccagcactttgggtggccgaggcaggcggatcagttgaaccaggagttcgagaccagcttgggcaacacaccaaaacctcatctctacaaaaattagttgggcatggtggcacacacctgtagtcctagctacttgggaggctggggtgggaggatcacttgaacccaggagagtgaggctgaagtgagctgagattgcactcctgcactctaatttgagcaacagagtgagactctgtctcaaaaaaagagaaaagtaaaagaaaaaaaatggagggtggggtagggaaaagtagcagattacaatcttggtaacttccaatgaggtgctgagtgatgggtctaggtgttcactatattatatccttttgcatgtttgaaaacttttgcaataatttttcaaaacagtagagaagatggctaggtgtgaatatcacaactgtgtccctgcagggctaatggaagcctcagttttcccaatgtcatgtgtaatagcactggtgacttaagatgtactatataatttctatgacagcatcatacacagatgcaagatgcaagtgtactgcatctcaaacaacttagattgacgggaggatgatgtgttttttggaaactgcattagatgactcaaaaagaggctctgtgacactgattacaaagatgcgggtagagttttaagaggctcgtttgcaacctaagagtcccgactaatccaaccagagtggacagatttacaacttcttgacctgaaggcttgctatagaaggatgagaaaaaaaaaatgtaagaaggctattgaaaggagaaagcacagtaagagatcatactttagaaaacgatgatctgtttacttcctgagtgcaaaagacttcactgacttattcagatcatgggtatctattaaatcacggctctgatgtttaaatttagcagaaaaaaaaaaaagtaacccatgctctttaagataatctaccctctaagcatactatccatgcctaatgaaaccttgcaatgtaagtctctcttattaaaattatgttaacagctttctatttttaaattacttgaatattaatttgtgaaaacatttcagaataatcattttaaaataaataagtgtttcatggctgggcgcggtggcctgtaatcccagcactttgggaggccgaggcgggtggatcacctgaggtcaggagttcgagaccagcctggccgacatggtgaatcctcgtcgctactaaaaatacaaaaattagccaggcgtggtggtgggcacctgtaatcccagctactcaggaggctgaggcaggagaatcacttaaacccaggtagcggaggttgcagtgagccgagatgagattgtgccactgcactccagtccaggtgacagagcaataccctgtctcaaaaaaaaaaaagagtgtgttgctctaaaccgggcctcactaagtaattaccaacaggaccagtgtgaagaaaaaaagtttattaagagaaaaattttaaaaaatctgagtaaattgagagctgtaacatatttctagacaggaaaactcgacattgtgaagatgtcaggtctccacaaattaatctgtaaattcaagaccaaaattcaaatgagaatcattccaaatgagaattttagagaaactcacaagccagtgctcattcatctgaagaaaaaatgggcaaaaataaccaatataattttggaaaagtaaaacaatggagatttgctctaatataaaacattcctctagcaactaaaacagtgtaaatattcatgtatagatgtgtacacatatcagtttggtttatgttaaatacaggtggcatttcgagtggaggaggaagagtgatgtgtggtagctgtctatcaaataaagccataattcctccacattatacacaaaaataaattccagggtatttaatgagataataaaaaagctaaaaatacaaaaaaggaatatattcttattgtggagtacagatactctgggctttcctaagcaaaccccaaacctggaaaccacaaaggaggagatgaatggatacgaggacatgaatgaaaagttggcatgtgacagagatctcagaatccaaattaaaagacaggaggaaaaattacattgcatgaccttctgtggagcatgttttagtttgtaagtctatctgcttagatagcgcatacttactaaaattcctaactggctcttgtcctagggaagagagggggtaggaggcctgaactgtgtttgggtgtccaggaagtaaggcaatttgtatcaaatgagtcgcctgtttgctagtggtaatttcatccgttagtcattgggaaggaagagcttgctttaaaaatgccacagaaagatggacgttaatttcataggtggtaatttaggaattcttctcacatggctacaaaaataagtcagtccaaaagtggaggctatttgtggcctggcgtttttctgtgtactttttttttttttttttcttagttactgtcatccattgtctgttccattaggttatttggggcaggctaacaggacttacacagtccttccccttggaaggatcagccttgcccacggtcccttagattctgtcattgagctgtagtgacctgggttctggggcaccctgcagtcacactgtttagactgtctgtgtcctctcctgtcaccccctctggacatgggctccttgaaggcaggggatgagtggggttcactgtgtattctgagggtcagactcagtgtctggctcagggtaaggatgcagcacctatcttttgaatgagcgaatgggtgaatgaacagatgagttgtcttttccttttcctcccaatgagtctatgtatttaatagcctatattagacatagctaatataccaagtatttgactcgttagagacagctgtggcaaagatttgattcttcaaatggtgcgagatcagaaattcttgaattcatttgaatgtgcagaaatattgtataggttataacatcatatttcaaccccaaatttggacagatttggcactatagcttttataaactatgaaaaatagttttctctaaacaatgctacggcagcttatgtgagaaaaatactagagaaaagctaatgatttattaatgagtaaggaaatatgcaaatatgaaactagaatcaactgggggcagaagtagggaagtgggagtaaatgcctaaaatctttgggagtactttttctggaagactttgatttgttttgaaaagtggctttgaaagctctgctttagccatgtggtggttcccccattatctgtggttttgctttcagcagtttcagttgtctggagtcaattgaggcctgaaaatgttacatggaaaattccagaaatagataattgctaagttttaacttgcatgccattttgactagaaagatgaaatcttgcaccattctgtctggaacgtgattcctttgttcaaggaatcctcagtgtagatgctactgccctgtgggtcccttagtacctggcttaggtatcagatcctttgtaacccttattttattgaatgatggccccaaagtgtgtgagtagcgatgctggcagttcagatatgccaaagggaagctgcaaagtactgcctcagtgaaaaggtgaacattctcaatgtaagagaacagaataaatcatatgcggaggtttctaagaagtaagaatgttctatccatgaaattgtgaagagtatattgttataattgttctattagcagttattgttgatcccttactgtgcctaactgataaatttaactttatcatagatgtgtatgtataggaaaaaacagtaaatataggattcttatactatctgcaggttcaggtatccactggccttgtatttctttttttagtcaagatgatttgagaaacttagatacagggaaaccctgtgcccggtcacttgaatggaaaggccgtctttattaatgaaaacatggcttaagctgttgtaaccaagagaccccaaaatgagatggcccccacgtccaggccacaccacagaccatttacatcagactctccctggagaggcccagtcaccaagctttttagaattcttcccaggtaatcctaaagtctaggtaaagtggagaaccactggcctggagttattcagaactgactagggaggggactgggttttgcagcccacagctttccctcatcctgggcttgtagaacagctctgcctgcctcgctatagggccttcacctctcggccaagcctcgtgttatgggtgtttcccactcaggaggaagtggggtgcacaagttccttttaaggaagtgaagtggaagtagcatgtttcactcacattccattggcgtgtgctaggacctgtgactatgtaaccgcaatagaggttgggaaatgtgatgtgaatctggttggccatctgccctgctcatttttgaggtgggaaggtttctgttactgataggtagaatgtaatggttaccatgctatccattaattaaaactatttattatcaattaccaattatcaattctaaagctgaacagagttcaactgacctcatatatatgtcatgtgagataattatacacatacacacacaggcaagctatgagctagatgcaaagacttgggagaggctttagtttacgttaattacaaagttttaaagtttacatttactaagcttttagtttatattaatcataaagttgttgctctttgttccactgtcatttatgagttgtttaggagtggaaacactgctgtgggtgactttttcatttgtttgggctcccttggtgcaaacttagaggcagaaaagcgttttcagccaaaacgtattccagtgatgtcagttgcaatcctgggtcatcacataaaggttatagcaacttcaagggtgtagaatctgaaaaaagttaaggttaaataggaatatcatttctggtagggcatgacattttctagagcccccttttaattatcttgctatatacactcttacttgtagaaaccattcttgaagggttggggaaggctccacggtgttggtgggtacagatttagtataaatgaattagtcttactcatctttctatattcttgtgaccagaatacttccagacccataacagattcttagcaaatattaactgacatgaatatgcttatatcattgtgtagtttatttagaaaaatgatactctttcactcctttgtggacatttcacagtgacatgttgagtcctttggtatgcaacagtgttgaaggtgggggattgagtactagaatgattgctgatgtctcttcaagggtggtgggagacacagggacttctatcattaacagttagaaagagtgaataagacctgctgtgcaataacacaacagagtgactatagtcaataataacttaattgtacattttaaaataaagagtataattggataatttgtaactcagaggagaaatgctggaggggttggatactccattcttcatgatgtgcttatttcacattgcatgtctatatcaaaacatttcatgtccccgtaaatatatctacctactgtgtacacacaaatgttaaaagataaattaaaaaaaatcatgacagtccattgtgggaaatgatatagcagtgatgtacagcaagcagtaggaacagaggtgggagggctcacctctgcagagttggggagggctgcatagtcttggtgacccctgaactgggtcatggaggatgagtaggagattttcatgtgaaaaggaaagggcattagagggaatggtatttacagagtgatggagctgtggaagagcctgtgtctttcatgaaaaatgaaaaaatcaagtgtggctgcagtgtgagaaagacaacagcaagacctggttgaggcagcctccttgaaaatgctccctgcagtacactaaggggtttggacgttgggcaaagcgagaggcccttgcaatctttttttttttttgagatggagtctcattcaggctggagtgcatggcacgatctcagctcaccacatcctccacctcccatgttcaagcaattctcctgcctcagcctcctgagtagctgggattacaggtgcctgccaccacgcccagctacagctaatttttgtgtttttagtagagacagggtttcaccatgtcagccaggctggtctggaactcctgacctcaggtgatccccctgcctcagcctcccaaagtgctaggattataggcgtgagccaccgtgcccagtggcccttgcagtcttttaaatgagatgattacatggtccgatttatattttagaaaaattactcttggaaacaaggaggctgcaaccctccctgcatgaggcttcctgaccctagtctctgtcctctaataatgccacagccatagaacatagtctcttctgtattattcctgatttaaaggattttgatgaaaaggtaaatggattctgaaatgattcttacaactaatttattttatttttattttttattttttgaggcagagtcttgctctgtcacccaggctggagtgcagtggcgcgatcttggctcactgcaatctctgcctcccaggcttaagcaatcctgccacgtcagcctcccaagtagctgggaccacagacacgtaccaccatgcctgggtaatttttttatagttttggtagagatgggtgatgtggtttggctgtatccccacccaaatctcatcttgaattgcactcccataattcccacctgtggtgggagggacctggtgggaaataattgaatcacggggcagtttctcccacactgttctcgtggcagtgagtaagtctcacgagatctgatggtttgataaggggaaacccgtttcgcttggttctcattctctcttttgcctgctgctatgtaagacgtaccctttgccttccaccatgattgtgaggcctccccagccacatggaactataagtccaattaaaccctgtttcctggatacattacccagtctcgggtatgtctttaccagcagtgtgaaaatggactaatacaatggagtttcaccatgttgcccaggctggtctcaaactcctgagctgaagcgatccacctgcctcggcccctcaaagcgctgggattacaggtgtgagccaccacgccctgcctgttgtaactaatttaaagggatagtttcaagtataaaggttcagtctctttgattaggtaaaccgaggacaccataaatttatttgtcattcagctggtgtctgtttggggatgatttttgtatctgatgactgtgggccagtgaaattcaagtatatttattgtcaccttaatatctagttatattgcaaagaaaaaggcattaaaacagaatgtggattatcaaaatattataggaaaagcacaaaataaatttgtagttagcctaattgggttgttatctgaacatagattgtcctgtgctgaattgtttagtactatgcaaattatatgagactttcctgtaaaagacataagaaactgaggaaactcaaagagttgacattaaactatttaagattcttttacagactacatcagaatcctggtggagtttagtggttttaaatctagtggtcaagtctttattgtgactttggataacagagctctgttttgcgtgcttgatgagtggtttgtggaaaatacttagtaactacatataaggaaagtagtttcattttgggggaacagaatcttgatatgattgtgtggtcattaaaaagaatcttttggttttcttgagggtcagtaatggtaacaattctcatttgtgtgctgcttatagttcattaattttttttttttttttttgagacaaggtttgtcgcccaggctggagtacagtggtaagatcatagctcactgcagcctcaaacccctgggctcaagtaattctcctacctcagcctcctgagtaactgagactacaggttcatgccaccatcttggctagctttttaatttgtttttgtagagaggggttctcgctatgttgcccaggcagttctcgaactcctggcctgaagtgatgcttctgcctcagcctcccgaagagctgagattatagagccaccaagcccactcactgcttatagtttagaaaacactgttttacaaacttgttcaacctttatgactaccttattatgtgctactagtttttctaggcaatatgttacctattaattaaaatatttgcttaaatgcattttattttggacattagaataaaacataattaaacctcagatagaatatgtaggattttaataatgtgaggttatctagcagtgtcctaaacattgtagtttctctaccagtaaggtgttgacgtacaacctagcccacctattcttggcccgtagggagcagatatctggtgtctggtctttcaaccactttcgtagtagaaaataaattaaaattataatacaatatttattatacttaccatggatttaagtagcagtaggccatgacaggtagggctggtatatttccagccagttggtattaaattaacacaagtcattatgcctccaagcagtatacagtgtatgatatacataactcttattttggtgaggaggagtataaaagtaataaccctggactctggaggccggaatttgatgctttaaaactttgtataatgaaaattttaaacatttacagaacgagagaataggagtatgaaattgatacagccatcactcggctttctcagttattaatactgtattagtctgttctcacactgctaataaagacatacctgagactggataatttataaaggaaagaggtttgatggactcacagttccacatggctggggaggcctcacaatcatggtggaaggtgaaggaggagcaaaggcatgtcttacatggcagcaggcaagagagtgtgtgcaggggaactcccctttataaaaccatcagatctcgtgagactaattcactatcatgaaaacagcatgggaaagatccggctccatgattcaatgacctcccactgggtccctccctcaactcgtgggaattatgggagctagaattcaagatgagatttggatggggacacagccaaaccatatcaaatacatagctaattttgttttatctatacctcctatttcccttagattattttgaagcatgtctagagatcatatatataatttcatctttaaatatttctatatgcattcctgaaagataaaaactctttcagaatacaaaagtgaaagtggaatacaatgccactgcgaaaaaaatgttcccttaatattatcaaatagtcaatgcacattctcatttctctatttttttttttaaagaatactgttttacttgaattgagtttttaataaggtccatacattatgcctgattgttatttcttttgattcttttttgacctatacattcctcttctatcattattttctcttgagactttttgttaaagatatcaggtcattttgttgtgtagtttccccacactcagggttttacttactgcatcctaatggtgcaattaaaacaaacaaacaggccgggcgcggtggctcatgcctgtaatcctagcattttggaaggctgaggcggatggatcataaggtcaagagatcgagactctcctggccaacatgttgaaaccttatctctactaaaaatacaaaaaattagccaggcatggtggtgggcacccacagtcccagctactcgagaggctgagggaggagtatcacttgaacttgggaggtggaggttgcgccactgcactccagcctagcgacagagcgatactgcgtctcaaaacaataaaacaaaaaacaaacaaacaaatagcattattgaggtataattaacctaagataaacaacatattacaagtgcacagtttggtgagtttatctacattggcaaaaccattacccaaattcagataatgaacgtctcaattgtcttaccagctgggcgttctacaattcaatttgattttgacaccaccttaagttagcagagaccccctccccactgctaggttaagggctcattcccacaagactgccccaattcagatgccagctaggaatggggttcccagtctcccatacttctgcctggctgaccacaaattcacgggctcccatgaccatcctctccggtgtgctgtgtcactagaacaactcacagaactcaggaaaatgctatccttatgattagttttattatgaaagatgcaactcaggaatagcaaaatggaagaggtacatggtgcagggtcttgcagggaggggtagagagcagagcttctgtgccctctctgagtgcaccaccttcccatctcatgatgtgttcacctggaagctctccaaactcttcaagagtttttaagcaaagtaggcttgattgcagaaagctttgggtgttggtgacagaactcaatccccagcctccctgaggtcaggggataagggtgaaagtcttaaccctctagtcacacttttgcttcctctggcaacaagcccccatattgaactatctagaagcccaccaagagtcagctcattagcataaactcaggtatggttgaaaagggctccttaggaataaaagacactcctatcaggaaatttcaagcgtttttggagctctgtgtcaggaaccagagacaaaaactaaatatattttttattataccacatgcaccatccttaaaagtttgctcctgcctctttgtaatcaaacgttgtgtacttttttggggggtctggcttctttaaatcagcagttattctgagatccatctgggtttttaaatgtattcatagttcattcattttattgctgagtactgtttcattatagtgatatgcatatttacttacccattgtggctattgtgttgcttccagcttttgaccatcacagataaagctgctgagaatatccatgtataaatatttgtatggatatatgctttcatttctctcaggtaaaatacctaaaaatggaatggatttatcaaatggtaggtgtagtttaactttactctctaagaagctgccaaagtgttttccaaagtgtgtgcttcatttgacattcccactagcagtgtatgagaattccagttactccatatccctcccaacatttagtatggtcttttgtaattgtagccactctaataggtatgtagtggaatcttcttgtgattttaattcgccttttcctaatgactaatgatgttgaacaacttttcatatgcttatttgccacccacatatcttctttgaagtgtctattcaaatcatttgcccattttttattaggttattttcttattcttgagctttaaagcgtctttatttatgttgggtacagatcttcaattggatagatggtttgccagtgttttctctcggcatgtggcttgtcttttcatcctcttaagtgtcttttcaggagcagcagtttttaattttgacgaaattaatttatcagtttttctcttattattcatgtttttgctctcatgtctaaagtctttgcttgaactagtcacaaagtttttttttatattttctttgagaacttttatagttttaggctttatatttagacctatggtcaatcttgaattactttttagaaacaataattgcagctttaattttagatttaaggggtacatgtgcaggtttgttatgtgggtgtattgtgtgatgatgaggtttggggtatgactgatcccattgcctagttagtgagcacagtatccagtagtgtttcaacccttgctcccttccctccctcccccgccattcatccctggtatccaaatccagcagcacatcaaaaaggttatgtccatgagtacccagtgtttagctcccacttataagtaagaacatgtggtatttggttttctgttcctgtgttaatttgcttaggataatcacctaccgctgcattcacattgctgcaaaggacatgatttcattctttttaatggcaatatagtatcccatggtgtatatgtaccacattttctttatccagtccaccattgatgggcatgtaggttgattccttgtctttgttattaatgaatagtgctgtgatgaacatatgagtgcatgtggttttttttttttcttttggtagaacgatttattttcttttggaaagaaaataaatatattcagtaataggattgctgggttgaatggtacttctttgttaagttttttgggaaatctccaaacagcttttcacagtggctgaattaatttacattcccaccagcagtgtataggcattcccatttctccgaagacttgccagcatctgtttctttcttttcttttcttttctttctttctttttttaaataatagccatttgcctggagtgagatggtatctcatggtggttttgatttacgtttctgtgatgattagtgattttgagcattttttcatatgtttgttggttgcttgtatgtcttcttttgagaagtgtctgttcatgtcttttgcccattttttaatgtaattatttgttttttgttgttaagttccttatagaatctggatattagacctttgtcagatgcatagtttgtaaatattttctctcattctgtagggtgtctgtttactctgttgatagtttcttttgctgtgcaaaagcactttagattaattgggccctacttgtcaatttttgttttctttgcagttgcttttgaggacttttttttgcattttttgaggacttttttgtatatggtaaaaggtagggatccagtttcaatcttctgcatatggctagccagctatcccagcaccatttattgagtagggagtcctttctctcttatttttgttgactttgtcaaagatcagatagctaaagctgcatgtggctttatttttgggttctctcttctattccactggtctgtgtgtctgtttctgtatcagcactatgctgttttggttactgtagccttatggtatagtttgaagttgggtaatatgatcctctagctttgttcttttttcttaagattactttggctatttgggctctttttttattccatattaatcttagaatagtttttacccatcctgtgaaaaatgacattggtagtttgatagcaatagcattgaatctgtagattgttttgggcagcatggccatttttacaatattgattcttccaatctatgagcatggaacgttcttccatttgtgtgtatgtatcatctatgatttctttcattggtgttttgtagttctactggtagaaaaaagtcaaggaggagggactcctccctaactcattctgcaaagccagtattaccctgatgccaaaacctggcaaagacacagtgaaaaaagaaaactacaggccaacatccctgatgaacacagaggcaaaaatcctcaacaaaatactagcaaaccaaatccagcagcacatcaaagaggttaattcatcatgatcaggtaggcttcattcctgggaggcaaggttggttcaacatatgcaaaccaataaatgtgatttaccacataaaaaaattaaaaactggcccggtgcagtggctcacgcttgtaatcccagcactttgggaggctgaagcaggtggatcacgaggtcaggagatcgagaccatcctggctaacatggtgaaaccctgtctctactgaaaatacaaaaaattagccgggcgtggcggtgggcacctgtagtcccaggtactcgggaggctgaggcaggagaatggcgtgaacccaggaggcagagcttgcaagtgagctgagatcgcgccactgcactccagcctgggcaacagagcgaaactccatctcaaaaataaataaataaataaaataaataaataaaaacaaaaccatatgatcatctcaatagacgtggaaaaagctttcaataaaatccagtacgcttcatgttaaaaatcctgaacaaactagatattgaagggacatacctcaaaataataacagctatctatgacaaacctaaatacaatatcatattgaatgagcaaaagctggaagcattccccttgagaactggaacagacaaggattctcattcttgccactcttattcaacatagtactggagcagtcaggcaagagaaaaaatagaaggcatccaaattggaaaagaaggagtcaaactgtctttctttgccgatgataatgattctataccgagaaaaccctaaagactctgccaaagactccaggaattgataaacgacttcaggaagtttcaggatacaaaatcaatgtacagaaatcagtagcatttctatacaccaataacgttcaagctgagagccaaattaaaatgcagtcccatttacagtagctgcacacccacaaaatacttaggaatacatcaaattactttttgtgtgtagtattagacaaccagccacattctttgagctaaaaataaaaacatgcaagatattaaaaatacaaatagggactgaatagtacagtgaagaaaattacaagtagaacataagggaatagtcaagaattgtaggaaaaaataaaaatataagtacagactagatttctcatgtttaggaaattagactttttaaataaataaaaaattgccaggcatggtggcttgcaccaataattccagccacttgggaggctgaggtgggaggatctcttgaggccaagaatttaagaccagtctgggcaacatagtgagactctgtctccaaaaaaaaaaataataattactgggtgtggtggtgtgcacttacagtttctgctactcaggaggctgaggtgggaggatggcttgagctcaggagtttgaggccgcagtgagctatgatcacaccactgtactccagcctggatgacagagcgagacccgctttgtatgtatgtgtgtatatgtaatacacatgtatacgtgtatatatatgtataaaatgttctacttcaaggaagatgattacatgaaggtatataagaaccaccaccaccaaccaccctctacaagaagggaagagtaaaaatcatatcatggtaggaattgtatggaaaaactggaaagtcagaatggaataggtagtacattgctaaatttgttgattgttttagaatgcttctggaacacttcttcaagagtattcatggggaaaaatgagagtcgtgggtaggtaggtgaaaaaccagttgtcattcatgaaatgttggatgaatcaaataaatgagggcttttaatttactaaagaaaaagattgctgttcttcaaaaagaagtaatgtgatctatgaatagagtttagactcaattgaactattctgcttcaatcaagaaaatatttgacaatatgaaaagtgagagatgaagaacattttaatatctagtttttacttttatattacttgcattttaaacatctatttgaaaatgttaataaattagcaatttcaaaaaaatttaaaattatcatttgatttattccctcagaactttgagacaggagagtactatgagtgacttctcatagctaggtataattaaatgcaggggcaagcaactggctattctatgcactgttacaattagtgataggccatccctggcagagtcttagcatgtcttgtaacttgtttgaaaaataaacccttcctcttcattcatatctttattgagactcataatttacttgatacttaccatggctcaagtgctggacttatattcacagaatttaactaatcatggcacttgattcatgatactctctcattattaatttatgcatggccttctttattttgtaggcattgaatcattcattaattcattttaaataatattataagcacttatagtaccagcatgagaacaaggatactgagaataatttccttctactgtgagttccttccccattccatctcctggccttgtgtttcctttcctccttctccctgtaggcagccactcattatgaattacacattacacacttccctgcctttcagaaatgtatggttttattacatacatgtatttctatagattatatttttagttttggatttataattagggtctcatgctctgtgtctgaaagttgtgggacaatatcaaatgttctaacatgtgagtaagtgaaatatcagaaagagaagagaaagagccgactaaaaaaatatgcagagaaaatggctgagaattttccaaaatcagtgaaagatagaaagttgggaagggtaggagaaagggtggggaaggaagaaatttgttaaaggatataaaattacagctagataagagaaatacattctaatgttctatagcactgtaggattactatagttaacaataatacataatttcaaatagctggaaggagaacattgaatgttcccatcacaaagaaatgacaaatgtttgagataatgggtatgctaattaccctgatctgatcactatgcatcgtatgtatcaaaatatcacagtgcgccccatgaatatgtacaattattatgtgtcagttaacaaagttaaaaaaatgttcagagaaccccaagcagggtaaaggtagggagagaaagcatacctctagatgcattatagttaaactactgaccaacaataaagagaaattcttaaagaagctagataaagaaaggcagccggattaaaacaaaatgtatgtacagaggaataaagataaaaattatagcacaattcttatataacctatgcacgcagaagacagtggagtgacatcaagtgctgagagaaaacaaaacaaacctgccaacctgggatcctatacccaataacaatatctttcaaaactaaaggcaaaacaaagactttttagacaaacaagagctgggaaaattcattgctagttaacctgcactacaagagatggaggaagtgtgttgggcagaaggtgtatggtaccaggtgacatttggatctccacaaagaaatatagagtacctgcaataatgtaaaagccatcgaatgtaaagacattgcatgtctaaagccaaaacaatgcaaatatattatgagatttagaacatgtaggaataaagcatatgacaataatagcacaaatcatagacaggacatggaaatgtaaaatgttatttagaggtagactatggtaagtaaaaatgtgtattgtaaaccctagagcaacccctaaggaaaaaaagaaagaaaagagttaaaataatctaggaggggagataaaaattgaatcataagaagaaggcaagaaaagaggaaaacaggaacaaaatacagacaaaagcaggttcagtgttattaagatggcagttctggtcctggcttggtggctcacgcctgtatcccagcactttgggagtctgagccgggaggatcacttgagcccaggagttcaagaccagcctgggcaacatggtgagaccctgtctctacaaaaaaaattttaaaaattagctgggcacagtggcatgcacctctcttcccagctacttgagagtctgaggtgagagaattgcttgagcccagtaggccaaggctgcagtgagccatgatctcatcactatactccagcctgggcaacagagagaccctgtgcgaaaaacaaaaaggtggcaattcttcccatattgatccatattgatctatagatttactgcagtcccttttgaaatccaagcagaataggcaacacaattttgaaaacagaacagagagaacttagactggtttgaccacttcctgtagagctgttgtcatcaacatggtgctacactggcataaagaacatagataatggagcagaatatggaggggagaaatcctcacatttacagtaattgatttttgaaaaaatgccaagacaatttagtgggggaaatgataggaatttcaacaaaatgatgctagaaaaattgaatgtccatatgcaaaaacaaagacaaaaacaaaccaaaatcccttagatatttatctcctaccatactcccagaataactcaaaattgatcataaatctgcatttgtgagctaaaactataacacttctggaagaaagcataagaaaaagtttttgtgaccttgggttaggcaaagaattcttagctatgacaccattaaagaaaaatattgataaattgggtttaatcaaaaatttaaaacttgtcctttaaagacaccactaagcaagtgcaaagacaaattatagactctgagaaaatatttgaaaatcacatatatgccaggtgcagtggctcatgcctgtaatcccagcattttgggaggctgaggtgggcagatcacgaggtcaggagatcaagaccatcttggctaacatggtgaaaccccgtctctactaaaaatacaaaatattagccgggcgtggtggcgggtgcctatagtctcagctactcgggaggctgaggcaggagaatgatgtgaacccgggaggcggagcttgcagtgagccgagatcatgccactgcactccagcctaggtgacagagcgagactctgtctcaaaaaaaaaaaaaaagaaaagaaaaaagaaaatcacatatataataaataacttgtatccagaacatataaagaactctatgaatattaagataccagtcctcctcaaattggccaaatatttgaatagccagttcactacagaagatacatgaatagctaataagcacatgaaaaaatgcttattattactcattagggaaatgcaaattaaaaccacagtgcgatgctacttcacacccaccaaaatggctaaaataaaaactcagaaaataagtatgttcaaggagaaacaggaattctgtgttgctgatgggaatctgaaaggtatagccacaacagaaggtggtttggcagtttttaaaaaagtcatactaaaacatatttaccatatgatctagctaattcacttacctgtatctacctaacagaagtatgcagattctttaagtacttcaattaaaagagatcatcaggtagggtgaaaaagcaagatccagctatacagtcagctgcccatatctgtgggttacagtcagctgtccatatctgcagggtttttttttttttttttgagatggagtcttgctctgtcacccaggctgcagtgcagtggcatgatctcggctcactgcaacgtccgcctcccaggttcaaatgattctcctgcctcagcctcctgagtagctgggattacaggcaaccgccactgctaatttttgtatttgtagtaaagacagggtttcaccatgttgtccatgctggtctggaacgtctgacctcaggtgatccacctgcctcggcctcccaaagtgctgggattacaggtgtgagccgccgtgcctggccatgtctgcaggttgcatctgggtattcaaccaactacgcctcaaaatatttggaaagaaagaaacaatgagaaataacaatacaacagtaaaaatacaaataaaaaccaatacagtataacaactatttacatagcatttacattgcattaggtcttataagtaatctagagatgatttaaactattcaggaggatgtgcataagtgctctgtagatactaccccattttatataagggacttgagcatcctaggattttgggatccgaggcgggtcctagatagaactcatggcttgtataccaacggatgactatctgttgtaaactggaaacttattttaaatgtgaagatataaatccttaaaggtaaaaagatagacaaatataatactgtataagcactaaccaaaagaaagctggaatgacttgattaatatctgataaaatagacttaacaaagattataaacaggcattaaaaaggtgtatttcataatgatcatggggttatttcaccatggaagcacaacattgttcttaaatattcatgtacttaacaacagagcagtaaaacataaaacaaaaacagaattgaaaagagaaatagattcacaattttagttgacggtttcaacactcctctctcagtaatttatagaaaaagtagacagaaaatccataaggatatagaaaaatctaagcaacactatcaaccaacttgacccagttggtgtttatgaatcagtctatccaacagcagcatacacattccctttaagtgtacgtgaactactcaaaacagtagatcatattctaggcaataaaacacatatcaacaaatcataaaagaactgagttattcaaagtgtgttttctgaccatgaaagaattaaagtaaaatttaataacagaaagataactggaaatctccaagtatttggaaatgaagcaacacatttctaaattactcataggtcaaggaagaaatctcaagggaaattagaagataattagaataggatgaaaatgaaagtagaatatatcaatatctgtgagatgcagttaaatcgatgcctagagggaattttataattttaaatggttacattagaaataatttaaattcattgatccaacttcttaagttagaaaagaagcaatgaagacaatacaatgtgtacataaggatagatgtacagatcaatgcaacaggatggtccagagatagacctgcacatacttagtgttgaaccaacaaaggtgccaagataatttaatggagaaaaagaaagaaggaagtcttttcaacaagtaataccagaacaatgaaatattatacagaaaaaaaagaactttgatttctaccttgtactctacacaaaaattaacctgaaatggatattagaccatatttgtgtttacacaaaagcgaaaacttttaaacttgtgaaagaaaatatagcttacagtcttcatgaccttgaggcatgaaagacttcttaggacagactgtccatcaaagaaatgtcaataaattggaactcatcaactaagcacctctgctctaagaaggactccctgaagaaaatgaagagctgaggtgctcactgggagaaaatcttagcatcacataaatctgacataggacttatttctggactaaataaagaagttgtacaactgaataatacaactcaattaaaaggtagaaaaaacatttgtctacacacctctaaaaagaagagaggaggattccaataatcatgtacaaacatgctcaacgtcattattcattagggaaatgcaaattaaaatacaaagtacaataaaatactactacacacccaacagagtggccaaaatttaaaaagacttacaacccaagtgttgacaaggatgtggaacaactggaactatcatacattgttggtgggattgtaaaatggtagaaccagtttgtaatatagttcatcagtttttaataatgttaaatatgattttccatatgaccaacaatttcacttcctggtgtttacctgtgaaaaatgaaaacgcatgcccataaaaagacttatacatagatatttaaagcacctttatttatagaaacaacccaaatgtctgtcaacagatggctgggtaaacaaattgtggaatattcatacaatggcatgctgtttggcattagaaaggaacgaaatacttatgcacatagcaatatggatgaagctgtctcatgtcaaacaaaagaagccagacacaacagacaacatagtgtgtaattttattttatataaaattctagaactggagcatgaatctatgttattagaaagcaggtcaatagttgcctggattctagaatatggggagattgattttaaaggggtgctttttggggcaatggaaatatcctgtatcttaagatagtagttacataggtgtatatgtttgtcaaaagcacatttaacaatatactttctttttgtttttggagacagagtctcattctgtcccccaagctggagtgcagtagcacaatcttgggtcactgcaacatctgcctcctgggttcaagtgattctcctgcctcagcctctctagtagctgggactacagacacgcacaaccacacccagctaatttttgtatttttagtagaggcggggttttaccatgtgggccagaatggtcttgaactcctgacctcagatgattcactcgcctcggcctcccaaagtggtgggattacaggcgtgaggcacctcgcctacctaacaatatactttaagtgtgcatttaattgtatataaatttgcctcaatttgttttaaaaagtaaaaaaaaaagtaatgctaaattattgttcactcccaccatcagtggataatagagattcaattttctactttttccatttggataatcacttttggggttcagttactgaataatccatcctttccccatttttctgacttgctacttctattatatgtcaaagttgaatgtatgtgtggttcagtttctgcactgtcttccatttccttgattagtttgtttatcctgtctttattattttaactttgtaataagccccagtatctttattctctttcttcagaagtgttttggctattattgatcctgtattttttgtataaattttagaaatagcttatttatttctatgttctatgaaaaaccctattggaatgttaatggggattatattgatgtcatagataaatttgggtagacttcaaacttttacagtattaaatttctctgtttatcactgtggtatatcttcctatttatttagatcctctttaatgtctcccaatacaatttgtaatttttcccatcaagttcttgcacatattttgaaagaataatttcaaagtatttgatgttttttattttattgcaagctaagtcttttaattatgttttgtgctgtattgttgcagtatagaaatatgattttaaaaatattaatatatctagggaacttttgcacttgttttagaaagaagctcatttattgatgagcagaatttgtggtgggggggcacaggcatgtgtggtgtgtacgtgtagggtgtgtgctgtgtgcatgtgtttgtgcgtgcagacacatttgtgaatattttggagagcagatatattgagggtgggttttcaaaaccctgaagttattttctgcagttgagtttctgcgtgttaaggttggccctgtgttgcaggaggggatggtggctaaggccatgaagtttctggcttttaggctggtctgcatttcacgcagttgtggcaagaagggtctcttgtaaagctgatatgaagtcaagacatccgtatctcttccatcctggggatggttactcacgatgtaggctgtattgttaaaaatgtgtcactcttcccttccagtatccggagtgtgatgcagaagtaccttgcagagagaaatgaaataacctttgacaagattttcaatcagaaaattggtaagtcctgcttgttcatttggcatacggtaattttagtgatgaaattgggcgatactatagtaatatatgaatgcaccccctagtgctttatatcctctatagctgtggctgggaataaaggaaatttcatgtaattaataaggtatttaatgatgacttacattcctagtaacatattctatgattaagctcttgggaaatgggtaattctaggatttttacatgaactcagcgttgctgaatgtaagagaataggatattcctttcttttctttgcgtcttgcctgcctcgtggttactgaggtggtttgctggggagctgtgtgtaatagctttaaaattattttatggctggaggaaattactttatgaaaattccaagaaattaaagttccctagaactcaatttgtgctctgtttccatgattaatagacatagactgatagatccctttaagactgcgtattcttcgagataattctgggcttgcccttttgtttgctgatgaggagatgtagacacagggaggtggagtgacttgttctgattcccagttctccttcttcttaactccgataataaaatattaaccagtaaataataaaatagttaccagtagaagctggtgcagaaatctttggatttttgtaaaccactttatctgatttacaaaaatcagcctgtctgtgaagaggttctttggtagatacagtttctttgatcacgcatgaagtacagtggggaaaaggtggacggagtggtttggagaagcagatgacgttggtctgtctgtgcctgagcactgtgtggaaagtgattggtctttgccatatagagatatttcatcctgctcctcaggagttggttagggaacagataagttaaaagagtttggctttcattttgttagttctcacggcttctcattattttcatggtgtgtggttactgtaagctacataggtgttctcctttgcttctgattttgtgctaaaaaacaaaataaaactcatgataacaagagagagaaactatatctctgggagcggagggaaaaaggaattatttatctttttatttgctagttaaaattttttaaatttattttttgtggatttattgaggtatatttcacatagcatacaatccacacattgaaagtaaacagttgagtgactttttgtgtattcactgtcatacaaccatctgcactgcctaattttagaatgtttttatcaccccaaaaagaacttgtacccattagcagtccttctgccttctaccctccctcagctcccggcaaccacgaattgagtttctgcctccatggatttgcttgtgttggacacgccacatgaagggaatcacacactgtgtggccttttgcactgggcttcttcagcataaggccttcaaggttcgttctggtggttgcatggatcagaacttcagcctgctttcccttcagctctcattccagtttctgaaatgcatccaggattcttcttttgtgttttctgttctctctcccttctgtagctcctttcctgtctacagtccccgcaaacatacatacagccccccaaacatgtattttccatagcctggattaaaaccttaactgaccctggcaccgggagactctgacctgagctcccaatggcattagtgtggctgagtatctcagttgcacggattgttctctgagagcagtctcactgggcgctgatgggctgtgcattttatctgaagctgttaaacattgtttaaataaataatttcttctgttcccttcaattcgtgaccttggatctggtcaggagaagctgagtttgagcttgggaaggtcatggtcacaggaaagaagagcagctgatcggaggcttagggagagcgcacaccaccatctgtaattacgttttgacggagctgtctagtgttgttggcctgctccccgtttttctctgtagtagtctcactttctgcctggtctcaggcattgggggagagtggaaggtgggccatggtgggagtaaatgtgtctgacactccaggtcttccttttccaggttccgtttgcgccttccatcactgactccatgcgttcctgccctactctttcccttctccatctttccttccctctcccctcattgttttgctggtcctcttgttctgtttcaccctctgtctgcctacccatctgttccttttccctctttccttacctcccaaggtccccgacacacaggatcaccatagggcttgggaactgccctccaatgtgtgctgtgggcaattggtaaaaatgttttcaaaataaaaccatagaagtctttaatttacttggcctctgaggcgttgccgaactggcagattgtttggctacacactgaagtggttgttatttcattactttttatctataaaagtagggataataatagttcaggtccatgaggctgttgagagggtttagctggtggtgtacatgaagcccttaacacgacaattggctctcagcagatgctcagtgaatagaagcaaattgtttatgttaaaaattttcaacatacagaaaagtagactagaataattaaccccacatgtatgtatatgtatgtgttgtgtgtgtgtgtgtatagttacatcacctatatttgatacatttcaccattttgctatactatgttttcccatcccgtctttttttgtggttactgaataattaacaaagcagtcacagcgttttgtgctatatgcatctctaaaaagtatgcatgctttcttatacagccgcagtacctttatcccaaacgtgaaatttatcatgattcttagtgtactctaataccgagtttattgtcaaatttctctgattaacttaaaaatgtttttttttttactcttggtttgaatcagtattcaaatactgttcttgtattgtaattgatgataatatttcttgtaatctagaccagttcccccacattgcccccgccagcacatgcacaggtaattaacttaccgaagaaattgggtcctgtgtgttgtagaatgttccacgttctgggcttttctatctgcttcttaatggtatcatttaaaaaattttttaaatttttatttatttttttttgtgacagagtcttgctctgtcactcaggctggagtgcagtggcacaatctctgctcactgcaacttccgcctcccaggttcaagcagttgttgtgcctcagcctcctgagtggctgggattacaggtgtgcaccaccatacccagctaattttttttttttttttcagtagagacacggtttcactatgttggccaggctggtccggaactcctggcctcaagggatctgctcacctcagcctcccaaagtgctaggattacaagcgtgagccaccatgcctggcctttaatggtatcacttaaattgtacttctgtttcctacatttcctgtaaaccgagactttgctctaacagcttaatgaggtttagcttcagctgctttttggtaggagcactttataggtggtgctgtgtacgtcatagcaggaggcacatgccatttagggtctctgtagtcaggtctctaaagtgggctcagatgtggtcggtgtcagtttctcattgacaatcattgtctaaatcggttattttattagggatcaacttaactaatgttaagacacataatttctatataaggatgaggataaaagtagctgcacttaacccctttcttctgaatagtggcaattaaaaacaaagaatgaagtttattagggagttacaaaatggtgagttttctaaatatacaattccttctgcattgattacttttattcctcaatgggaggatatttagttgcctttaaatatattttaattagaaaggtacgtgttcatggtgcagcctcatgacccttgcctcgtggtgttgcccccatgcgtaacatggctaaaagagattctgcaggtggaattaagatgattgtccgagtgggcttaatctactcacatgtgctctttaaaagcagagtttcctcaggccagcagcaaggaggaagtcagaaagatatgaagctcaggaaagattccacactgttgctagctctgcagatggagggcgtgtgggtgctcactaggagctgagagtggccctggctggcagcagcgaggaaacagccacctccatcccaaaccacaaagcacagaattccatccataactggaatgggtttggaggcagattcctacttggagcctgtagataagaacccgggctgaccgacaccttgaatttgtcctggtgagaccctaagcagagagcccattggagcccactcacacttctgacctatagaactgtgagatgatacgtgggtgttgttttccagtcactaagtttctggtgacttttgacacatgagaaaactaatacagcaggtaaaatctccattcgttatttttaattgccactattcagaataaagtggttacatgccagttacttttatccttatccttatatagaaattttatcttaagaaatattaagttgatccctaacttgctgtcagtaaaacttaacacatttagatattgacacagtatgtttggttttaaggggatactggttattgaatagacaggaaaatcattgtatcagttatagttaagatgcttttgtgactatttttcttctttaagatacattgaaattgtaatttcatcatatgaagtgaggcacatggcatttgataaagtccatctgtctgtggacaatctacttagcttctctgtctgcaagttcactcctgttagaggagcatgtttgaaactataagaagactccaaaacagatcctttttttttttttttaagacagtcttgccctgttgcccaggctggagtacagtggtacaatcttggctcactgcaacctctgcctcacaggttcaagcaatgctcttgcctcagcctcccaagtagctgggattacagtcatgtgccaccatgcccagctaatttttgtatttttagtagagatggggttttgccacgttggccaggctggtctcaagctcctgaccttgtgatctgcccgcctgggcctcccaaagtgctgtgattacaggcttgagccaatgtgcccagcccccaaatcgatacttaatacatgaagtatgtaaatgtcattctcatgtataaagaacgtggtaatataatattatatcacatactgccattaaaggcatttcattttataatactggcttcagaactcaatccccagtttgaatagtaatctttttcaatttgtgtgaaataatttggtgtctgatatatagacacaaaaactttgcaatttttacttttttttttttttttttttgagacagagtcttgctctgtcacccaggctggggtgcagtggtgcgattttggctcactgccatctctgccttcccagttcaatcacatctcctgcctcagcctcccgagtagctgggattacaggcacacgccaccatgcctggctaatttttgtatttttttttaaggagacacagggtttcaccatgttggccaggctagtctcaaactcttgaccttgtgatccacccacctcggcctcccaaagtgctgggattacaggcgtgagccacctcacccagccctgcaatttttactttttaaaaaatgacttgtccaggtgtggtggctcatacctgtaatcccaacactttggaagtctgaggcaggaggatcacttgaggccagacgtttgagaccagcctgggcaacacagtgagaccctatctgtatagaaatttaagaataaaattagctggatgtggtgctgcatacctgtagtcccagctactcaggaggctgaggtgggagggtttcttaagccttggatttcgaggccttagtgagtcgtgatcgcatcacggctgtccagcttgggcaaaagaacgagactctgtctcaaaaaacaactctcaaaatgcaaaactactatataccattcacccattgtaaatgtattatgtgatgattttggtaaatttctacagttgtgcccccgtcaccacaatacaatttaaaaacatttccatgcctccaaaagatccctcctgcccatttgtcgttactctgctcccatcctcagccccagacaaacactcatctgtctgtttctatctgccttttctagacatttcataaaaatggaattatacggtataaagtctgtagtctcttgcatctggcttctttaacttagcataaggtttctgaagttaatccatgtcgttgtgtgtatctgtacttcattcctttttgttgctaaatagcattccatattatggacagagcacactttttttttgttttttgttttgagatagagccttgctgtgctacccaagctggagtgcagtagctcgatctctgttcactgcaacctccgcctcctgggttcaaatgattctcgtgcctcagcctcctgagtagctgggattacaggtgcatgccaccacacccagctaatttttgtatttttagtagagacaaggtctcactatgttgcccaggctggtctcgaactcctgacctcaagccatctactcacctcagtctcccaaagtgccgggattacaggcatgagccacggtgtccggcctacagagcacactcacttcattcagcagttgatgggcatttggattatttccactttttgcctgtttatagagcagttattgccactttttgcttgtttatagagcaatgctaccataaacatttgtgtacaagtattttatgggcatatgttttcatttctcttgagtctttacctaggagtggaattgctgggttgtatggcaaatttgtgtttaactttttaagaaattaccaaattacttttcaaagtggctgtactgttttacattcccaccatcaatttatgagcattccaggtttactatatcctcaccaatacttgctgttatcagtcttttttatatccatctgaatggataggaagtggtatcttgttgtggtcttgatttgtgattctccagtagttaatgatattaaacatgtttgtgctaattagttatttgtatatcttctttagtaaaatgtctacttaaatcttttacccatcctgaaatttggattgtctttatgttatttgttgtttatgtatgatttacaaatgttttcttctggttggtggctggaatccagtctctttcattttcctaatggtgacttttgaagcacaggttttatttttgaagtccaatttatacatttttttcttttatgactcatagtttagtgtctttttttttttttttttttgagatggagtctcactctgtcactcaggctggagtacagtggtgcaatctgggctcactgaaacctccacctaccaggttcaagtgattctcctgtctcagcctccagagtagctgggattacaggagcacaccaccacacccagctaattttttatatttcagtagagacgggttttcaccacatggcccaggctggtcacgatctcttgagctcaggcaatccacccgcctcggcctcccaaagtgctaggattacaggtgtgagccaccaagcccggcctttagtgtcatatttaagagctttttgcctaacaaatttgcaaaggttttcttctgtttttcttctagtagttttattgttttagctcttatatcttggtctgtggtcgaatttgagtatatttttgtctgtggtgtaaagcaaggtctaaatctatcttttttgcatgtggatatccgattttgtgtttctcattaaatttgttcccaagtattttaatctttttgatgctattgtgaatggaattgttttatttattttaattttggttgttcattgcaagtacatggaaatagaatgagtttttttgtagtgatcttgtatccagtgatcttcctgaattagtttatcagttctagtaaggtatgtctgcatgtgtgtgtgtgtttgtgtgtgtgtgtgtattccttagaattttttatgtattgaatcctatctgaataaaaagagttttacttctttgtttccagtctggtgtcttttatttcctttcagtttttacttttcactttaatttcttaaatgttttttaagttggtctcaaacatatttagcatgatatcaaagaacatttacctagaaataatacataaattatatttgacatttagggccaaggcataagaaatgtacttgctgtgggctttgaaagcaaagtgtatgtttcattataaaaagaatacattgataaaaacagaaactactacctctaaaagttaaaaaaaaaaaaaatctgagcagtttctataataataaagatggatgtagatagaccacagatgcttattttaaaaatttggtaattattaaaaaaaaccccaaaatactaaaaaacaaactaaaacattttaggatcacttttttgtcagtttcaatgaataaacttgccactcgatttcatcatttgtaaaattattgcttgacatgtttaatatctaaaatataacatagatggttaaaagctgaaaacatgtataagtcagcagctttggattcaaaagttgaggttaaattacagcaaatagagccgtcttgcataaggttgtagagagggaactgttatcctgggaaccaacttcaactttgttttcctctgtgttcctacctttgtttggaagtgtttgtttctgtcacagtgaagggcctcccctgacagatcccctgattgacagtgacacagtcagttcccaccctgccttatctgtaagagttctctagccagagcaaccacagcctcagagaagaaaaacctggggccctattcaattctgcatccattatccatgcctttgtggagacttttcctgagggaaagagttaaagaggcacgtaaactttcaaacagcagagaccaacagtggactaagcacagcgaattggattttctgttgaagaggcagtgcagtggccgggttcaggcagtaacgggagcctgggggacttagggtcacagcctctgcacagtttcaacttgggtttcctaataaaaatgctgcccagagaggaaagacactagggtagaggaaaagctgtttcttacaaacctactggcaagtccgtcttcttttcagctgacttcatcacctgtgttggactaaacaagtctgggcatcagctcctggtgctggagtctgcctgggctgggagccgccacatgcccccgcagtgcagcctctgcagctctgaacatttgggacatctgagcattttgggttaaaaaggataaaaagaggagaaaaaggctaaaccagttctatgggaaaatttggttgtcttctttttttttttttaaacccagcttagtagggctggttttccttcttaaaattatcattcaagttcaaagaccagccataattatcatcgccccacccaaaaaaaaattcagaaaagctacattttactggaaaagcacaatcctttaatatctactaatcactagaaactataggagcactgatttgccagctagcaaatgtattatcttttttttaatgttatttatttattttttgagacgggtctcattctgtggcccaggctggaatgcagtggtacactctcagctcactgcagcctcaacctcctgggctcaagcagtcctcctgcctcagcctcccgagtagctaggactacaggcacaggcatgcgccaacatgcctggctaatttttgtattttttgtagagataaggatttgccatgttgcccaggctgatcttggactcctgggctcaagagatccacccacctcagcctcccaaagtgtcgggattataggtgtgagccactgtgctcggccatctattatctgctaaatttttactgcttaattttcccagagctcttctgagtgtgtgattggaatactattagtccataattggatttactattagtttaagacagtgatgctacctgtgtactagacacttcagtgagtattttatgtgctggtaaaatatgatcaagcttgcacaactcccaggtggcagagccagagttggaagtcatgtgctttttctgcctataaccagcaaaatttagtgtggaaattagcatgcatatgaagttctttaaaaaaatgacatatcaactgtataatttttatttcctatataataatactaaaatccaggatttggcagctgtgcacaaagatctctctgtagctggtctactttatgtgctttgctgaaggggacattcaatcaaatatatttgagtccttcactgggaatgtctctttaaacaaaaaggcacatggagaagactaagacagaaggctcccatccctaaccagctcaccctgcaaaagatggacagcaaaatgtgtgtggaagtgcacagacctctgacattccagtactgaacagttgttaagtgtgtttactatcgccaagcagcccctgagattcccagaagagcctactggtcattttcctgaggcacgaatttaaatcctaaagcaaacgtggggaagttattctcttagccaagaggtaagccttgctgatcagccagcctctgcagctaaactcaactttgtagctctctctctgccagtgtccacgtattttcggaaaaaaaaattatatgctctgtcaatattagcaaatgtgggatcttaatttatgttgctagagaatgccaaggacctatgaaacagcacctctgctggaaaagttctctgtaaactttttgaactgacagtgggggacgatggggctgttttaggattttaagagccctcaattggttttgaaattcaaggtggtgctgcattgtcataatatcttctggttttagatttttttggagatagcttttctgatggttttacaccttgtctttgatttattttagtatttctacttctagtcaaagttaaaaccaggaaatacagagatgtgctgtgggggtgatggttaagctttgtttgaaacttgttgctcaacattcagttgttcgtttaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgtgcacatggtggctttaaacagggtgttttaagaaggtgccattcataaggacaattgagcaaagtcctctgggagaggaggggccgagcccctgtggatttatctgggggaagagtacccaggtgaagtgttgagcagggcaaagaccctaaggctggaacctcagggttgaggcacagcaaggaggccagggggctgcagggcagggagtacagtgggagttggggtgagggtggagagtggccaggcccttgaggcccttgtgagggtttctgctcttacccagagtgaggtgggacatagggaagtttgagagttgggatggcataatctgactcaagtgctcctggatcagtctggccgatggggaggcatgggccagggaggttgtgttagtcctgtctcacactgctgtaaaggactgcttgagactgagtaacttatgaagaaaagaggtttaattgactcacatttccacaggcctaagaggaagcatgactgggaggcctcaggaaacttacagtcatggcagaaggcaaaggggatgcaagcaccttcttcacatggcggcaggagagagagggagggagagagagagagagagagaaagagagagaggcgaggtgccacacgctgttaaaccatcagatcttgtggcaactcactctcatgagaacagcaaggaggaaatccgtgcccatgacccagtcaccttccaccaggcccctccttcaacattggggattataattcaacatgggatttgggcatggacatacatccaaaacatttcagagacctcttagaaagctaaaggctgtgagagacgatgctggcctttagaccattggggttgccgtggaagtagagagaagtcatggaattcccagttttgaagatagagtcaatagatttgtaagaaattatgttgcagtacaaaaaagggttgtggggagaagtggtttgctggggacacttgtcctcaggtctaaagataaaggagaggttttgataagaggttgagactgtagggcgatgatgttgtttatgcctcttggaattaaagtaacttgatttgcacagtgggccatttgctggagtattgtcacacctcctttgcattctagctggtgctttgaggtcagcattaagctaagagctttgtcctgaggctgatagctttttgctagatgaacagagaagattcttacgggtgtgaatcaggagtgaaatcccagctgggacagagagagtccttctaggcccccagagagtctgtttataacattggagcacaaaaagagaaactaggacaactttttaaagaagcacatattcttaccttatacgatgcacttactctccaaagaaatatatatttttttagtttaaatcattgtcagcctttggaatttgctctttaggaattcatttccttgtcttaaaattatggctatttaagaagattgaaattagttgtttttggcttctgcttttcagccagcagttgagttccgaattggtgacagaaaagaacttgaaatggaatagcttgctgggaatagtgattttggccctttctctcagtgttgccttttagtttattttcagaatatacccgatttcctattcatgaggtaccaaatacaagaatccaatgttatttttttctcgtttactaataaatgtgctctgtacttgtattcttactttttaaaacaatttaattgatgtaaatatgcatttccataatatgcatttccataacttcagaaagcatagtcttgccctttgggttcaacccaccccagccctgggcagccactgatctgctttcagtcacaatagattacattcaccttttctagaacttcatataaatggattcaaacagtacatgctcttttgtgtctgatttatgtggctcagcataatattcttgagattcttccatattgtggctcctgttatcaggattgcttttctttttttttgagatggagtctcactttgttgcccaggctggagtgcaatggcttgatctcggctccatgcaacctctgcctcctgggttcaagcgattctcgtacctcagcctcctgagtagctgggactacaggcacttgccaccacgcctggctaatgtatttttagtagagatgaggtttcgccatgttggccaggctggtcttgaactcctgacctcaggtgatccacctgccttggcctcccaaagtgctgggattacaggcgtgagccaacatgcccagccaggattttgtttcttttttttgctgaatattattttacgtgcatttaacacagttcacttatctgtggacactggaattgtttccagtgtggggcaaatatgaataaagctgccacaggcatttctgcacaagccctgtgaacatacactatcatttctctttggtaaatacctggaagaggaattgctggatcgtgtctgataggtgcacacacattacgtttgcgatgtctttttgaggagttgacttatttatatcacagtgaaatgtcttttatcctggcaatatattgctctggtgtctactttgtctaatattgatttagtcactccagctttctgatgttagtgtttgcatggtacatctcttctccattctttgatttcaaagtgtctctatttaaagtgtgtttgttacaggcagaatctgcttgagactgctttttaaacccagactaacaatccctgttatttcattagaatgtttagatcatttacaattagttatcaaaacagttggagtgaagtctcccatccttctaactgttttctgtttgttcttttttctccttttcctgttgtcttttgaattgaatatactttggtatgttaggttattgccacactggcttattagctgtacctcttcatttttttttttttttggtgtttccaggaacctctgcatccctgaactcttgatgccctcacctcagcaagaccaccaaggtctgcttgggtgtccctcctagcgctgcagttcagtgcagttgaccactgtcctaaggtacctctaggccaagagccagctcatcctgggatcctcctagtttattttccttctctgaaagaccgcaaccctttccatgtctgaaaacagttatttcatagaacttttctctctagcttcctggctggtcatggtgagagattaagtctggtccttattattgtattatgcccttgaagtataatttcatttttgaaatatttggctcttggtgagaaaatttgataaatacttgaaactgagactccctgtaaaatcctagacatatagcgcctttgttataacttcatggtgcaacacaaacatgatggttggcttccaggttacccataacagcacaggtaagtctaagaagctttagaaaaggctgtatccatacagtttgggtcatgataacagttaatgagccccttggtgctcagtgctctacatacgtgatctcatttagtcttcagaatgaccctgtgcagatcattcttggcccccttttacaggcaaggagccgagcctcagaggtgaagggatttgcctggtgtcttgcacatagtgatgggctgaggtggagtctaccacactccaagctaaagcttttgaccactatactaagctgagtaaggagtttttgttgtcgttgttttcgataaagggtcttgctctgttgcccaagctggagtttagtggcgtgatcatagctcactgctgcctcgaactcctggactcatgtgatcttcccatctcagcctccagggtagctaggactacaggtgcacacgatcatacctggctagttttttttttttttttttttttttgtagagataggatctggctgttgcccaggctggtttcgaactcctggcttcaagtgatcctcctaccctagcctcccaaaatgctgggattatgagccactgagccagaccaaactaagtatttgaaatgtcttaaggggcagcagcaggttaggtggtgctggaacatctatgaagtggttggtttcttcctgaggtagctacttgttgccaggagaaagcattatgattcatttctcacagaaagtggttccctctcccccttctctcttcctttactctctcctgctcctcacattccttcctttactcttcctttcctttgtcttttttgtgtgtgtgtgtgtgtgtgtgtgtgtgtgtgtgtgtgtgtgtgtgtgtgtggttttaaggagtggagagtttaataggcaagaaggaagggagaaggaagaagctcccctgtacagagacagagggaggggcgcttcaaagccaagagagggaaccccaaatggggcggaaaccagccaggtgtatatatagagaggctggagaaggcagtgtctgttttgcacagggctcgggattggtttgaccaggcctgtctttcacatagcccgcgaaaaagctggccctcccaccctagccttttaatatgcaaatgcagggcaccatgatgttctgcacacgtggggatatgtgagggccattaggttgccaggaacatgttgggcaagggcaagaagtcccgcagggattgtggggattgtcgtgttgggtggacctagtttctaattgcctgcatttgcatatcaaaggttgccagcccggctctaagagcaggggctttacaagaagcttttcccaagaggctttaaaaaatgaaaacttcccaaaacttttcctccttgtctgcctaaaatactttcttaataactcctacaacattcctcccagtggagacgccccactagctgctgttaggaggttttgggcgacaactctttctggctacttcctgcagaaaaggggtgttgaatggggaacagcagctaggcctcctcctggagtccatctaagggtcctcagaagaatggcgtgtccttgtgtggttcagttgacagcaccgtttggagtttgattgctgctaggcaagaagaaacaatttgagttgtagtattgagtatacagagtccaaatatcaatacaagacatatcagtaagagggggcttaataaaggggttaacgaattccatcaagaagactggaatttattaaagagggattgtagccactcgggactgaagccagcattttccttgagcctgtcaataattttgatttgatctttaagtacctgtagattttcctttactatactagaggtgttcatccaaaagcagcatgtttcatttaaaagtgcgtcactagacccaataaaaagtcctagcagacttagtgatagtaaaactttcatgcttcctttttgttagtaactattatccctgctatagagatagtagagtgaggacagcaattcccacaagtgtggtgtggtaggtaatttccatctaaaattttacttgccaacatatagaattcccctttgggggtctgtgaagttccttggttttattttcccaaacaaagaaacctctgggttatgggcaccttactcactttcattacctggcagaatttgcaagataattgcccagaactagtatattgattcacatgtttacgttacccatccctattttttctttttttcaagctgcagaagatcaccatttgattcacaggaataggcagagttagtctaaaatgtaggcaaaaagcttaaaaacaattagtgagactaggatttaatgacaaatatatgataacctttggagcaaaatttttctctccagtcctcatttttggtaaaaactaattatgaataaactttagtcttatacttggcctgattatttgcataaagggcagcaagaatggttatttttacatggaccttttggattagctttgatgaaactctattccacaaggaatcttagacaagacccttaaagttgagcccagccatgggtttgtatcctcaaatacctgtgagttgggtgatcctctcctcttgaggtcccaagataaactgggagctcccagacctgttagaaagtgacattctttactgaccacaggttaggaaccctgtgcagagactatagacaaggtatggggccagttctccccaaggggcttttattggctctacatgttaagcttgattccttaaagggaaacacactgtttcagttaaagccttggtaaaataaccagtttttccaactgtgtcctgttggcatcctttgccttttttttctttaaacccctcctctctttgtcaaaatagcaataagatccccagcagaagagaatgaaatcaaaactgaccccacttgaattcatgaaaccacagaatgttaggcctaagtgaaacctcagagtctatgcattccagccccttcatttgattgatgacgaaactaaggaacactggcagagaagtgagttggtagaaccatgcagcttgtcggtgtgcagcaggtcctggaatgcagggaacactgaccttgggcgggatgcggggatcagctccctcagcgtctgagggtatcagccagatcatagcgtttgctgtgcagtgggatcgtgaagagccaggacctgaaggagaccgagtagcgcttacataggttagttgtttaggggacatttctttgaggatgtgatcaggggatcatgtggagcagcgtcgtcatcagccagggcaagagggagtgcagtgtgtttcagaaactgccagaaggcccacgcaggcagctcctgatgagagaaaagaggggaggcagggaactgcgcaggagccagggttttgagtgtgatgggaagctctggtgggtcttgaccaggcccgatgtatgttttaagatcattctagcctctttatgaagaatgaattgctgggatcagagtgggagcatggaaacaggaagaagaatctggagacccctgtcgcatttaggaagtcgccaaaggtggcttttgttagagtaagagcagcagagatgtaagaatgggtggcctgggacatattctggagccagaactgaatagggaagagaagactcaaggagtagttcaatgccatagtttgggggtaagtgtatacatagtttctgtaatttaggggaataaatacattctataaagcatattttcttttgtttttgttttttgagatagggtctcactctgtcacccaggctggagggcggtggcgcgatcttggctcactgcaacctttgcctcccggggtcaagtgattctccagcctcagtctcctgagtagctgaaaacacaggtgtgtgccaccacatgtggctaatttttgtattttttgtagagacggggtatctccatgttgtccaggctggtctcatactcctgacctcaaagcaatctgcctgcctcagcctcccaaagggctggattatgggtgtgagccaccatgcccggccatactttcgtaagttattcaaaactatagaaggagaggagctagctaatgcgcagaaagatgaaatgacgagacagagtgatgcggctacgatggcattgggccttcctaattcccgccgtgtaagcccctgcctttggcttgtgctgctctctgtctcctgtgtccttgtttgcatctgtcccttcccacaagtaacctctgcacttacttgatggcacagctttggtgcagccttagtgagccagctcatttcagttctgtggtttcgtttcataatgagtgattgtttctagtgtaatgtgttgcccttgcctctaccagaacagatcaaatacctcactaattatctcctccctgaccagaaaaacacaaactaagaaacctacacacctgtattcatgcacacgcacatatgcacatgcacacctggtgtcctttcctccctttctattgacattaatgacaccgctgttctccaagctgtccaggattcaaagctctgaagcctcgctgatgccttctcgtccttgtctctcctgccccatcatcctccatttccaccacagccactttaattatgccattattactctgacccagatagttcaggaccttcctaactggctatcctatattaatttttttctttctccagcccttttgttaaacttttaatttttgctgggaaacatagcctccggccaggagtcaggatcaggcacttccaatctccagctcttttcctgttatccggcagtctgaaaacatagtctggtcacggtgtgattgcattccgaagctttcctaagcccccactgcagggtgcagtcagcttgttcctgtcactcaggtacccagaacttgcctccatcttttttttccttatcttttaatttcagcgttcattgtgaacatgcgtcatgctcctggcaccccgcatctgctttcagtctgtctccctctgtggaaggccacctcctttcctatgctcttcagagagattcaccattcaaggattagcttaaaaccctgatttctggccaggcgcggtggctcactcctgtaatcccagcactttgggaggccgaggcgggcggatcacgaggtcaggagatcgagaccatcctggctaacacggtgaaaccccctctctactaaaaatacaaaaaaattagctgggtgtggtggcgggcacctgtagtcccagctacctgggaggctgaatcaggagaatgacgtgaacccgggaggtggagcttgcagtgagcctagatcacgccactgcattccagcctgggtgacagagtgagactccatcattaaaaacaaaaacaaaaacaaaaaaccctgatttctgactatgaataatctcttttgatgttcctgctctactcattgtctgtagcattcatttggcgcttactgtggaaagtatagtactgtgaggtgcctctttaatgtttcccaactgatccttgagatcaaagctcatctctgacgctattttctctttgtaattctaaagcttctagttcagtattttacacatctgaggaattgactcttcttttttggttaactttctgtttccgcacacaatgattttaactgccattagtatcaaactgttatttgcagcatttaatataaagagtgtatattagatgatgaatctctttttttttttttttgagacggagtcttgctctgtctcccaggctggagtgcagtgacgtgatcttggctcactgcaagctctgcctcccaggttcatgccattctcctgcctcggcctcccaagtagctgggactacaggcgcctgccaccacgcctgtctaattttttgtatttttagtagagacggggtttcaccgtgttagctgtgggcggcaagccacccaggcaccgaggcaagagaccgaggacacgagctgttccactataataaaatataaaacaagaatagttataccagatatagatcttagagatgattatatatgaatatcattaatcattagtttgtagcaattactctttattccaatattataataatcctcgctctgcaatcataacctaggaaaaaccaggccatacagagataggagctgaggggacacagtgagaagtgaccagcagacaagagtgcgaactttctgttatgcccagacagggccaccagaagggctctttggtctagcggtgacaccagcatctgggaagatgcccgttgccaggcggaccgtggtctagcggcagcgaaaagtgtcaaggaacaacactcgctacttagcagaccgggaaagggagtctcccttcccccggggaagtttagagaagactctgctcctccaccttttgtggagggcctgacatcagtcaggctcgcccacagttatccggaggcctaaccgtctccctgtgatgctgtgcttcagtggtcatgctcctagtctgccttcatgtttcatcctgtacacctggctctgccttctagatagcagtagtcaattagtgaaagtactaaaagtctctgatatgcaaaaataatggcgtaagctgtttttctctttgtctcctctctctctctgcctcggctgccaggcagggaagggccccctgtccagtggacacgtgacccacgtgaccttacctatcattggagatgactcacactctttaccctgccctttttgctttgtatccaataaataacagcacagccagacatccggggccactaccggtctccgtgcattggtggtagtggtcccctgggcccagctgtcttttcttttatctctttgtcttgtgtctttatttctacactctctcgtcgccgcacatggggagagacccactgaccctgtggggctggtccctacattagccaggatggtcttgatctcctgaccttgtgatctgcccgcctcagcctcctaaagtgctgggattacaggcgtgagccaccgcgccaggccgatgatgattctcttagtgtgaagtcttagcccacgcacctgtctccaagtcgtcttgccgtaggacttgcagatgtttgtgcactgttgggatgggtgataggatgaatatctgtggaaatagagggatcctttgggcagctgttttgagtagggatcagggaatagcagctgtgtccactgcccttcccttgtacagggagtgagagggagtgttcactgatcaagccaacttcatttccgcaagagatatccccacttccgggatgctattaaggcactgggtgttactccctttaaaacattcagagtgaactctcactagaggtattcacaacttaccagatgactttaaaaaaatacctctgttatttaattgacaaattattatattcagttggttataagttaaaatgaattggggcaaaataatcacagaaaccatctgattgctctagcaagtagtcattttatatgcattagatttcacagtaaatatgaaaagcagctctaaccacaagctggtcggggcggcatagcaccaggctgcaggtttgaagatcggtgcacagtcagggctatcgtctgcccccagtgggttggcagtggcacccataccacctggtgttccactgttatgggtttagtcttttgagtcttgaaggcttttgataacatcttcacattctaatagaaatattcagtggggcagaggtaggcaggcactattagtgtataggtgttgacacccaagtacctattttaggtaaggttagggacagggaagaggatgcaagggccatctggggacaggtgtcatggcagataagtgtcatattgcagagtaccttggggaaggggaaggaggacagattcataatacctaccttcagccttgctcagggactcccatgttggggagaaagagtttcttctctaaaatcctcagaactgggctcaagagccgagtttttattttttatgaaacaattgcccacttatactaaaaactattccccagcaggctttttggcatttgaagctttcagcaagcagaggattatataactgataaatattaagtattggaatttctgaggctggatcccttagcctggtggctgaaggccaaccctccctgagcctccttggcgtaataaagcataccttccaccttttccctgtaggaacttgctctgcctaaattgaagtcacactctttccttatctcaagctaaatttcctgcctttgagcactgattcattctttctcctgactctatagcccgttaatctttccaagtctagcttgcacttaatgtcttcctgaaaccatctgtgactgtaccacaaccatctgatcttcctttaagtaaatttatccaacgttcattgagccaattaagtactagccattgtgctagagattagagagaaaaataaacaaaaacagaccacttccctcttgtagcccacagcctagtcagggagacaaatgaggaaccagctgctacttattgaactaggaagagatgtgtccatccttaacatcatgcaggctgtctatttcaaaggccactgtcatgtttaagaggaggatgctagaggcatttctgtcaacgccaggaatgacaaggagccaggaacagacacacagatcactcacatggatctgaccaagtacctgagaggtggacatacagaggattccttaagcaatagtattgacttgcaaatcccaatacagaaaagccctagaaccttctatgcaaaagccccatcatccagggtaaaactgggcaaaggtcctattgagagacagacaggtcattaaaacggggaaacagatggaacttaaacctaagaaaagattttcaatgttattcaaaaataagagaaacacaaaggtgctctgaaatgttattttgttatctttcaaattgataaaaagcccaaagttaaagaacacacttttggtatggcagtgggtttcaaaatgggcactcctatccattgctggtggtagtaaaaatagatactactccagcagaggctagtgtggccatgtctattgaaataacaaagtgtccatatgacgtttaacttacaagtttttctctgaggaaggtatcctgcaagtgtactgaatacatgataaaaagtggatgtagagggttatttattgcagcagttttgtaaaagcaaaatatttggcacaacccaaatattcattggagagcaagttatgtaaattatgagatggaatgccatgcggttataaaagagaatcaagtagctcctcctgactggtataggaagatctccaaggcatagtgttttggaaaaaaggctgatgttgacagtgtgtatagagtacagtggaaaattagagttcatgtttgcacttgcttttatattgtattcgaaggtaatacaaacacttgtaacaaggaaaccccagaatgtcagggactgtacacagggaatgttctttctcatttggtaacagtgcttgtcacaggttgtcacaagcctgtaacatttgtaacaggttgttacagatcagcatgaggcttttctccatgcacttccatcttgtggcactggtgtcccttaggacttgggagtcccttgcagagagctgtcacatcgatttcttaacagccgtggcccagaggtgacataccccacttccctgaaaagatggaagaaactaataacagcaggtgccttgggggtggtgatggtggtacgtgactgggcaggaagatgaagggcaggaaagaggggaaaacttttaaaatatattttagcaattttgaactatattattcatttataaaataaaaacaaatcattgtaataaagccagatcatgctctgaaaatggtaagaacccagtgctgtgggggcatagaaggggcagctctgccttgcctcggggagcggacttccaagtgtgctgctttctgtggtgctcgcttgaagccctaaaggtgtagcaggtgttaaccaggtcaagcctgcaggaaaagaggtttgtgagaaaggggctagacaagtggatggcagagaattgccaggggattggtgaagagagggtggctgccgagatggaaggagtccatgtgcagatacagaggcaggatttacggtaaataggttaatacagcatatggagctgtgggtgctggaacctgctggaaccaccatcaccccaaaggcaactacggttactagtttctcccatcttttcagaaaagtggggtgtgtcccctctgggccaaggccattaagaaatcactgtgatgacttcgatgtcttttctcccaactctatgcaagggactgtaagtcgtaagggacacctggctggtgggtgggcaggtcaggtctgggcaggtcaggtctatgccagtgcatttgcatggtagaggtacaggacagagcgtggtgtgtgttgcagtaacatgaatgtcttatccaacatcctctgcaacacccatggaaagtttcaaagcaaggaagtgtcatgatcagctccagatctgatgtgagtagcatgaaggatgagttggaaaggaggatgacaggtggctgggagcttagtgagggtgctgttgctgtcatctaaggaaggaacactgacgttttagcatttctcctctaccaagtgaatttggcacttaatacaagacaagtaagtgttatcattttgtgtgtagctatcaggatctccaattagagtacaattgcattgaagaccccttcattttacattctagtatcatgccataaatacttcctggctgattctcttattttcaataaacttttattgatttaataaaacatacatatagaaaagtactgaaatcatgagttcatagccacatgaattatcacaaagcaaactcatgtgtatcgattggttggctcttattctgtttcttccttgttaaaattatggttagactcagcatgcttacaacctccccacccccactttgtccggagaggtggatagatgatttgtgttgtacactcagaccctgatttccataatgccagctttaatatttgttcttagagaagtctctgggaaatgtaagtcgtatggcttatttgaataatatttctattttatcttaaattattttaaatctctcttattttaactgtcagtttgtttactgtctgatgtgcagagaactgtgataaatgaaaaaattgagtgcaatctggagaggagtattagcatggtggcatagtcagaaatttttacttttctgtcattatataatggttttaaaaggctgaaagcaatccagccattggaagggtttgatagaattttctcgcccctacattcttacatttccctcccagtcccagttcgcgttgttcctttttgagtcaagagccaattgcttggaacattccatgaatttttctttggccacattcatttccatttgtgcttttgtctgttggactcttaatattcatggctcaaaatctctccgttatctaaatgaatgatcccattaattaatctaggaatattttattgatatgctggaagaatacgtatgtgttgaatttaaattgtgggcaggatggagaacttgggttttagaagaagatccaactgtttacaatattcccaaattatatttcatttataattttctcctcctgtaaagttttaagtcaagaagtaaaagttccagtttgaaatgtagagttaaataaaaataagcgtatttaaggcttatatgaaatagatgattatagttaactgaatactcactttgatttatgtttatttgctcctattggaacttggaagaaaaaaagcagagaattgttaattgggaatgtaggttagtaatccctagccagtagggacatgacatcttatgggagttttcaggttttatagctatatgcttttttctttatttatgaatttgcttttttatttgtcatctacactttcccttattttcatttgtgaagaatgttgtgtatcctggacgtgtcagagtacttgtttatgacctctgtattaccaagaacctttctaatgacttattttagtccacacttatgtgtgtgaataattttatcctccatacaaacttgtgtttatgaaaacatcctgtagacattgagaactatgcaagtgatcaggctggcttctagaaattttagattccaatttgtggcctatttacagccactgtgagggaacatctctgagctttattcctggctcaactgtatgtgtccaattttatttttctttcttctttcatggtgctatttttatttaggtggagggtggaggtgcaggtttattgaggtataatttaaataaagtaaaattcagcaattagatctacaattctgtgagttttgaccaacgcataaagtgtgcagctactaccaaaatcaagatacagagcagttagttacctctccaaattcctggtgacccttcgtagtcaacccacagcttatgctccagctcctggcaactatggacctgttttctgttcctgtgatttctccttttccagaatgtcttataagtggaatcacttagcatgtaaccttttgttccttttatttagcatgatgtgtttgagacgcactttgcacgtatgagtagttcattcccgtgtattgggaagcttccattgtatggatgcatcgcagttggtttatccatccaccaactgaacatttgggttgtttcgagtaaagctagctactttaagtatctgtttgcagatttctatgtgactataagagcatacatttttatttctcttggtaaatacttaggagtgggattattgggtcaaatgacaaatgtttgtttaaagaaactgctttcaaagaggctttacaaattgcattcctactagcagtctaagagttccaactgctccacatccttaccagcattgctattgtcttttcttttttgcttttgttattctagtaagtatataggattatcttattgtgattttaattggtattttcctaatgactaatgatgttaatttttcatgtgctcagttgacatttatatatcttctttggtgaaagtgtgttcaagtcttttgctcaaaaatattggtttgtgttctcattattgcattttgagagtctttcatatattttggatacaagtcctttagcagatatatattttgcaaatattttctccaaatatgtggcatgtctttgcattttcttaagcatgtagaacagaagttttaaagtataatgaaattgaatttgccagttttcactcttatagatcttgttggatcttggtgacctttgctttaacccaaggttgcaaagattttcttgaattttttcctacaattttatagtttgaagatttatatttaattctattatccattttgagttaatttttgtaggaatcacatatttttgcagagatgttcaatgttgcagcaccatttgttgaaaaggctttcttctcattgaatcatccttgcaccttggtgaaagatcaattgattatgtatatgtagatctgtttctggactgtattctttttcattgatctatgtgtttatccttttctccaacagcatactgcctggattactgtatctttataatatatcctttttgtttttttgtttttagagacagagtcttgctctgtcacccaggctggagtgcagtggcgtgatcttggctcactgcaacctctgcctcccaggttcaagtgattctcctgcctcagcctcccaagtagctgggattacaggcacctgccaccaagcctggctaatttttttttttgtatttttaataaagacagggtgtcaccatgttggctagactggcttcgaactcctgacctcaagtgatccacccgcctcggcctcccaaagtgctaggattacaggtgtgagccactgtgcccggcctataatatatcttgaaccagatagtgtaaatcctttttgttattttcaaaaagtttattattctagttcttttgatttttaatataaattttagaatccatttattgattttttacaaaaatttctgctggatttttgactgggatcatgttaagtgtatagattgatttgggaagaatggccatcttaccaatatcaagtcttccgatccattccatgaacatggttttattcttaattatttggatcacctctgtttttgttcattagtattttgtagtttttagcatacaaatcatgcacatatctggttagatttattcgtaagtgttgggtttttttaatgttattattaattgtcctgttgcttaagtttaaatttcccattgttcagtactaataaataaaaatatcaatatggaatgtgtaccatatatatgaatacatctatttaattaatttagttctcaagcaaattataatatagggcacttttgattccattatctcttggcaaaatggttgattgtgtatttcatgataatattttaaatagtttgtttttcatgttttattttaatgctttggttggtcaaacttttgaaactttataagaaaatgcattaaaataatttgataatttgattattagggctttttattattccatacaacatagttatggtgagtgttcactatctgctctttggataatttaatttttatttctagaccttcatgttactgtctaggtgtttgtccctagcttttaaggtctttcaataaccagcttgcttttgtccatttcattttcttcttctctttgatttcatgattattagttatgtttgtatttttcaccattcaattcatgactttctaatttgatttattttatttagagatatagaatcttagagttgaaaaaattctggagattaatccaaggggtttttcttttaaacttgaaaaaatgtactaatattagggaaacctaacacctgttttgttaatttgttcacatggaaaagttaagatgcaaggtctaacatgtaatgctggtttagagatcctggtttagagacaattctagtatggtcagtggggctgtctcatgatatgtgttgtgatgctggatgataagatgtaaggtagttgtttcgtggtgcttgcaggggttggagggaatttccaattatatgggagctagtgtgcttgcttagggtgttttactcaaaaggctatagagaaatataatatgtgaaaatgataatcttcaaattgttatgataaaatattttagaaaactcttggaacatgtaactgatttgctgcattaaagcacctttatgtttcctcccagaattatgtttaattataagggagcttattaacattgttctagttaaattatattagcatttctattatattgtgtttgttcaaggatttaaagtgctgtaagttttcttctagtgcaaatgtctatatatagtttttaaatgggttggaaattactaattataaaaggaataaatatttgaaaagctaatttgacagcaaccatttctattattagtcacataaaatttctaatagttaaaagccaaatttcagttatttttctctagcctttttgccaataattatatataatcttagtcataaatgagttttgtgattttgccgcttttcttataactttgtattttgatatgcattttaaaattatattttgaaataacttcaaactcagaaaagtcgtaagaatggtatgaggaattttgtataccctttaaaccaagcttgtccaacttgcggcccgcgggctgcatgcagaccacgatggctttgaatgtggccccacataaattcataaacttccttaaaacattgagatgtatttgtgatttgttttttgttaacgtgtggcccaagacaattcttcttccaatgtgtcttagagaagctgaaagactagacacccctgctttaaacagtttcattgtttgcatacattttgcctcatttgtttcattattcattctttttatgatttttggggggtgtaatttagagacatcactcctcttgaccattatatgtttcagcccctatttcttaagaacaaggttattcttttagagaaccacagtacaatgttcaaaatcaggacattgaacacagatataatactataatactactgtctaatccaaagtccatattcatatttcaacaattgttccccaaaatgttcttttttgctataatttttcctggttcaggattgagtgtgggatcatgcctgcatttccttctcatacctttagtctcctttaatctggactatccctcagctttcttttactttcttgaccttaacatttgtaaagacacttttgtcaggagaccataggtcagatgtcgtgttgttctcaaggcatcataatgttacgttgtcccaagtctgatgattgttaattttgaccatttgcttaaagtgggtgtttgctagcatcctccactgttagttatgagttttccctttgtaagtaagtaactcgtggaagttacttttgcactacgtaaatattctgctcctactcaaacttatccactagttttggcacccatcagttttctgactccatcattcattccatagtttttgactggcatttgactattaagaaagcgcttttccttctccctatttatttgctatttatatcagtatgcactcatagatccttaatttatctaatgggttatgatctatgactcttcttatttattttgatgttcaaattttcccagttttggctactaggagtgctttcaagctggttcctgttcatatagctccatcatcctacaagtgcttgcttactttctagcagatgtttaaagctcatgttgttatttattcactgtccttgccctagaatcaatcagccttttctctaaggagctctagttgcttttaatggagaatagtgtttagcagcctaaatttggacactagaagtgctcattgctgccggtgtgtcattgcttctagacctttataaacagagcaaggaaatgtttgtgtgtatgtgtacgtgttcacatatctacctaccagaaacaatgaattcaaatagatactcccattccaattcagtgctacaatgtacattctgttctctttccatattttaactctcttatccaaaaagcctcttattatcctcaatatatttactcatttgtgtaagcctagagtacactgtaaatagtttccgaactgctaactcatactgctgtgaaagcaaacctactagctagagttaatatttgtttccagttcttttttaaggtaaatttacttacagtactgtacacaatttaattctgataaatgtattgacccacataacccctacctctatcaaaagacagaatatttccattcttagaaagttccttcatgcctcttcccagtcaatttcatgttcatagacgcaagcatttttctgattttttttttaaaaaccatagatcagttttgcctgttctagaatgtatatatatagaattacgcagcatatacttctttgtatctggcaacttttgaccaacgtaatgtctgacatttactgatggtgatggtaaagtttcgtagtcaacctggctacgttaaatgtgatacccagatagctggtaaaacattattgctgggtgtgtctgtgaggatgtttctggaagagactagcatttgaatcagtgtaaaaagatccaccatcagggatatgggtggctattgcccaatccattgagggcctgcaggaatagaacaaaaaggtggagaaagagctcatcctttctctctttttgagcttgggcatctatcttctcctgcccttggacattggagctccagtttctcaggccttgagactccaggattgatactagcgccttttcctggttctcagacctttggccttggcttgggagttacaccattggttctcctggttgtcaggtctttaagcttgtactgagttacaccatctgtttctccagcttgcagacagcatagcatgggacttctcggcctccataatcatgtgagccaattcctgtaagtctcctcttacttgcttatatgtttctctggagaaccctgactaatacaggtacaatgctggatgtatcagtagtttgttttgttttattgctgaatagtattccactgtgtgaaaatatcacaatctacttatcttcctgttgatagtctttgaatcatttcagataagttatgaataaagctgccatgaagattccctatacaagtctttttggagatataagttttcattggataagtatctaatagaggaatcactgcattgtgtaagtgtgggtgtaactttataaaaactttcaagctattttcctaagggactgtatattctttaccatgctccaaatctatataatgcagcattctccagtgatagaaaagtaataggatatgtgtatatagacagaaagagacttattgtaaggaactggcttatgtgattatggagacgggcaagtccaaatctgcagtgtgagctggcaggctcgagatccaggatagctgatggtgcagatgaagtctggaggcagtctgctgggaaattctcccttccctggggcatctgatctttttgttctgttcaggctttcagctgattggatgcagcccacctacgttatggggagcaatctgcttactcgcagtttactgatctaaattttaatctcattccaggacactctccaagatgaaattaaccatcacacatccaccccttgtcatcctggtgctcatacacatctccttacaccacgattaatctccactaaaggcgataacaaggtcatacttccacctaacatgatacaactagtctgcgtacaatggaagatgcattgactcttttcccagaaaaggatgcaaagtccttggatgatgtttgctcttttcttcgatgtcttgcaacttaaataccatcatgtaaagttaacaatatttaaatgctacactaggaagtcagtatgtcttctgttacatgataaagggacaagaagtggagaagaaagcaaagatatttgcttaacatacacacacacaataagggggaaacactcatgacagttgcagtcctcattcctgtaactggtcacatggttgtagctggtattccttactcccatggattacgtgttccctttaccatcagcaagcacctcagtcggtcatagttctgtacctggtgggatgacttgaatcattactcctaaaaggtctgggccattcatagccctgcctgaattgggttatagttttcccttgactttaatcacaggccatagtaatagtggggggataccctaggaaatctcctgtattccagacatgcttttccttatctctctagtgtggatccccttggcagtcaggatcagttactccagtcaacacaagatctcccttctctgcctgctgattcagaggcatgggggacccaaggtattgtccgtcctcctcagcaactcattggagttctggctgccttgtatccctgctggcagttggggttgtcaatatttaacttagccattctagtagttgagaagggatatcttagagtggcttaatttacatttacatgatgaccaatgatgctgagtccctttcatgggcttactggctgtttctatccctttcttgtgaggtgttcctgtgttgtgatgtgttcaaatcttccttgagttcttttattgagttgttcttcttttaacatggatttgtaagaattgtctttgtttgtttctttgaatccaaatttacaaggcattttttctaacttaggttttataatattttaccccagtccatggctggtctattttttaacactgtcttttgaagaacagaagttctacattttgataaagtataatttatcatttctttctttaccctgcctaagaaatcttttgcataaagattttctgtgaagatattctatatatattctagaagcattataattttagccttcacatttagttctatgataatccttaatttaattctttataaggtgtgaggtaacaattcctttcatctttttccccatatggatatcagctttcccagcatcatttgttgaaaagacttaaattgactatataaatgtgggcatattctgggaccttatatttctgttccagtgatttaatctaatgccactacattatatagccatattaatcaatctaatgtattgattaagattagtatggctatgtaatgagtcttgaaattggatagcgttaaggctttgaactttgttcttctttcttaagatgttttgggtattctaggttttttgcatttccatatatattttcgaatcagcttgtcagtttctttaaaaaggcctgttggagttatgattgtaattgcactgaatctacaaattattctgggaagaattaacatctaagcaatactaaatcttccagtccatgaactgagtatgtatttccatttatttagatcttctttaatttctctcagtaacattttatagtttttagcatactgttcttgtatgtcatttatttgtttattcctatgtattgatagttctttgttattacaaattgacttgtttttaaaattccattttaaaattgtgtgctatgagtttatagaaatttcattggtttttatctaatgaccttatgtcctgtggccttgctaaatttacttacatattctagtagttacttatagataggatttgccaggtaggtaaccagattgaatagaatcagttttagttcttccttttcaatttgaataactgttatttcattttcttactttattgcattggctaggacctccaatacaatgttgaagaggagtgagattacatattgcagcattttcttatctgacatgcattgtattttgtttgtctcacagctcagaaaggccttactgaccattctgtctgaaatacatcttcctctttttatcattatctcagcatcatacttaattactttatattccttgtcataaattatatgtatttctttgttgtctgtctcttacactaatccgtaagcgctttattggaaaaacactgttttcacaatcacatcctcagtgaataacacagtggctcttagtagatactcagtaaatgttttgtagaattagtcaatattgggaggaagttttagcagttatgcagtctattctccttactgtcttaatctccttggcaaaactgaggacaagtattttttcttgcaagaaaattttcatatttctcttttcacctttctaatttttaggagatttaatttcaaattttctcatagaaaccacttatatttaatactttcaaaagttcttaacttacattttataaaaagcaatacaattctttctactaatttttgaaaaattatcgtgatggcgggtgttacatacactaaaaagttaatcaatattcagcattttgcagtggttcaaatatagcaacaaagtaaacacatttcacaaatatctactaagcaggtgttaggtcaccattttttactctttaagatctggagaaattgcagcgatgaagtgaacttgttaggcaaaatatttccttatttttgcctctcatattttgccctaatctaggccatgcttcatttgctttttatataatttaaggctgatgaaggtaagttgcgttcagcctaggacacagtgatctaggatttagccaaaaggcaaatatctttcttcctgctgctcaattttagcagctccatttaaacagctggtagaaagtaaagcttcagtttatgtgcacataggaggaaaataatattttgtgttttctattgtgtgttgaactaagtccttggcttattctactgaccgacaatggagatttccttaaataaataggtaaacacattctaagttgggtgttcattcattcaactccctctttccctcatccctcctctttctgtcctcttccttcctcctttcccccgacttccctccctctccttgtacctttgctctttcttctacctttcttcctttgttctctctcctgagctctgtctttgttacagtcaatgctcttgtgcaaatgtagtagagaataaaacacctgtaccctatgcattgcagcttacattgtagtgggagaggtagacagtaaagaagcaaatataaacatgcgacaatttttgctcatcgtaagtgctacaaagtgttttgtggtgtgtgtgtgtgaatggatgcgagatagagacagcaggacagtgagaatgaatgagaatcatgaaaggcctcctcaaggaaagggatatgtgaagtgagctagtgagctgttcatttagaagatccaggaaaagtgtgtgaggcagtgggaatagccggtaagaaaccctgagaagggaatgagcttggtgtcagagaaactacagtacagaagcttggcctaagtgaagtgagcttggggggagcactgtgagatgaggccagagaaggaaatggtgactccagaggacgtgggtaggctatggtgaagagtttcagtttgattccaagtgtagtcaaaagacagtggtccatgtgtggtattatttcattttgtcatttagacattttgaaaacatctctaatttgatcaaaatacttaagttcaaattctcatgttagttttgtcttccagaaatagaaaaagaaatacatgtggcaaaaactgacaacattgaaaaaagatgaacaaatctacaattacaaatggagagttcaacacttcactgttgatgatggatagaataaatagacagatggccgcgcggtggctcacgcctgtaatcccagcactttgggagggcaaggcgggtggatcacctgaggtcaggagatcgagaccagtctggccaacatggtgaaaccccgtatctactaaaaatgcaaaaattagccggccatgatcgcgggtgcctgtaatcctagctactcgggaggctgaggcaggagaattgcttgaacctgggaggcagaggttgcagtgagccaagatcgcgccattgcactccagcctgggcgacagagcaagactccatctcaaaaataaataaataaataaacagacagacattctgtaaagattcagaggatgatcttttatttctatggatttagggggtacaagtgcaattttgttacctagatacattgcatagtggtgaactctgggcttttagtgtacattgtactcaatctgtgatttttcatggcttactcctctcccatcctcctgccttttggagtttccagtgtctattattttactccctatgtccatgtgtacccattgtttagctcccacttgtaaatgagaatgtgcagtatttgagtctctgtttctgactgacttcacttaggataatggccttcagttccatctgtgttgctgcagaggaccatcttgaagaactctatcaagcccacttggtttaattgcctttgtattcttttaaatgaaacactccaccctataagaacagaatgcaccctttcttcaagtgccatacagcattccgttagatagaccaaaagtttcaatgcatttaaaagcattgaaatcataccaagcatgttctctgaccacaacagagctaaacagaaaatcagtgtctgaaaaatccccaaatattttgaaattaaactacacccttctgaaggactcacggatcaaagaagaaatgacaagggaaattagaaagtcctttgaaatgaataaaaatgaagagacaacgattactcttaaaatcagaatactaacatacgaacagatagagatgtgtatccttcccatttgcctgcttcttgaatttcctacttcctgcctatgttggggtcgttgcagtttctccatgggaggagcgtggctgtgctcctgctgcaggtgtgcgcctgaccctggtaaagtctggctatgcctatttaactagtactcttagtcattctactctagtttgagtgaacgaacacttaccattttcaaaggccacgttccgggaactatgaggggaatttatggatcagttacagaccagttcaagttacaagatccttatgctaatgttaattaaaatctcatcacagccacttcctttttcagtcccacctggggaattctggtccacttcatctctacatggtagactttgtgagtctttcttcagttcctttctgcagcttctgtttctgcgaactctccgtttaattgttttgactttttggaattttataatcttcaagtatctctaccttcagtctggtatcagcttgttctatttaattttgtttatctaggcgtcaccattaggcattaagctaggcactaggttttcaaatggaatgggagccttataaatcaggtaattaattagtgtgtggtaaatattttgacagaatgttggaaaggctaagtaaacattcattcagtgaacatttattggccacctactgtgtaccaggcattgtgcaatagggtctgtctcatcagagaagacttcagagcacagttggcttttgagtccaattctggttatttcaggagttttcaaggtacagagaggggcgtggtattctaggcaaaggtgtttaaaggtgaggcttgtagttgtgaaggagtaaagcatgacctgggaatgggtaatctgctctggcactaggtattcggtagggacttggaaatagtgagtgagtggcaagagaaaggactagaaaggtttgggaagaaaggactagaagggttctggtgtttttttttttgtttgtttgttttttttttagggagtttggtcctattttagtgggcatagtgtttattagtgtcttggtgattctcaccaacacatactgtctgtatctcttattcctttggttgttattttggtcactacaatggtcagcggctccaagtggtggtggtgaatgccagccctgtcgtatcatacttttgtggaaagtggggggcgggggtgaacatgaatagagaaggaatcctgaagcaaggagccaagtatgtggtatttttctgcctggagtatttccttctaggaattaattaattcactagcttcttgaaatcttttttttaaaaaaaaaagtagaggaggaagaggttgaggtataaacacattgctttgaaaacacccttgtgggataaaatttcaattaattgcccaccctgaaattttttatttttttcctttaggtttcttgctatttaaagatttttgtttgaatgaaattaatgaagctgtacctcaggtgaagttttatgaagaggtaagaagtaactgttttactgatgcttttctttcaaaagcatatttaaactgtactttggaacatattaagactacttaatatcttacaaatatttagaaattcattgaaagtaattagtagtgcaaaatatagtatcaagtttgagatgctaacaggtatgaaaagctgagtatgccataaaagtcgcattcttaaaggcttcagagtgctatggaagcaatgagggacagttggactaaagttccagagatgggaggctcatccagagctgcaccaaggaggaccagttattttattttctgtggaagcgtgctagttctggagatgtgagcagaggcagaggactgctactagctttgaaagagatactagccaaggttttctggtcataatggactgacaaattggagatttggtggggggtgtggtggggtgctcaaatgcatgactgattttccccataagaaatttggtgaaatctgaggttggaggggagctgaagagagaggccagaaacttccagaaggcacattgaaatctcctacagccttacagtgcctaggaaacacagacctgctggagtctggagtctgaaaacagaatgggcgagagatggaaactctagaagatgtggtctggtgacattgggtatctacagctacttttcacctagggtttctgttgatttcaggtgtagcaggcagatgggcatccaggcttggctgcttctgggagacaaaaattgcagaaaaggtttctggagctagagtttaaaaataacactagaggagccccacatatgtgattagtcaccctttcaaaacacacgccaagttttcaaactgagtggggtgggaggccaaagagctaagctgaaaacttgtaatgggcagaactgactccagtgctaaggaaataaaagtgtctccttgaactccatagacggcgtgccttagaaacaggatcaaagcaggccaggcacggtggctcacgcctgtaatcccagcactttgggaggccgaggcgggtggatcacgaggtcaggagatcgagaccatcctggctaacatggtgaaaccccgtctctactaaaatacaaaaaattagccaggcgtagtggtgggcgcctgtagtcccagctactcgggaggctgaggcaggagaatggtgtgaacccgggaggtggaacttgcagtgagccgaggtggcaccactgcactccagcctgggcgacagagcgagactccatctcaaaaaaaaaaaaaagaaacagggttaaggcaaaagcagacagggtcctaaaaaatgacaacccaacctagcgccatccctcattggatgatgagctccctccttacctgcttaccagagtacaaagggagcccttttttgtcttttttataggtaggtaataacattatataaggactctatagtgtttagcatgcagtaaagaattatgagacatgctaagaagcaagatcatgtgaatcataaataaggcaataaaagcaggccagcaggtgagtcagatattggagttagcagacaataactttaaaataactatgaatcatatgttcaagaaaaaagagaaaaagatggacaaaatagatgaagggatacataatttcaggataatttgaatttattatgaagacttaaccactttagaacagaaagtactatatttgaaattagaactaatggttcagttcaatagcagattggttagagttccagacacatgtaggtttggagtttcagaaagagaagggagagaatagggcaaaagcaatatttgaaaagataatactaagaattttacaaaatgatgaaagacagcagctaacagagttgaaagcttaggaaaccctaagcagaatgaatacatatgaaacacacctttgggtgtcaatataagactatggaaactatgacaaagtttttaaactaggaaaaaaatatttaaaatagccatggtgagcagtgggaagacacaatacttttaaagagcagcaatttgactgactgacatcttaagaaaaatgatttttaaaaaaagacagtgaggctgggcacaatggctcacgcctgtaatcccagcactttgagaggccaaggcgggtggatcacgaggtcaggagttcaagaccagcctgaccaacatggtgaaaccctgtctctactaaaaatacaaaaattagccaggtgtggtggtgcatgcctgtaatttcagctactcaagaggctgaggcaggagaatcacttgaacccgggaggcagaagttgcagtgagctgatatcttgccattgcactctagcctgggtgaccgagggagactttgtctcaaaaaaaaaaaaaaaaaaaaaaagaaaaagaaaaaaaatgaaatggccatcattaaaggagagaaagataattgccagcctagaattctattcccagcaaaaatttccttcaaaaatggaggacgaggaggtggaggaaggagagggccccgggcctcacctccacccaccgccccctcccaccacccggagctgcagcagcagcgactcatgagagcacagccagaggacagatttgataatgggctgcattaaaagcaaagaaaacaaaagtccagccattaaatacctgaaaatactccagagcctgtcagtacaagggtgagccatgggagcagaacccactgcagtgtcaccatgtccatcatcttcagcaaagggaacagcagttaatttcagccgtctttccattccattataccatttggaggatcctcaggggtaacaccttttggaggtgggcatcttcctcattctcagtggtgccaagttcatatcctgctggcttaacacgtggtgttactatatttgtggccttatatgattatgaagctagaactacagaagacctttcatttaagaagggtgaaaaatttcaaataattaacaatacagaaggagactggtgggaagcaagatcaatcactacaggaaagaatggttatatcctgagcagttatgtagcgcctgcagattccattcaggcagaagaatggtattttggcaaaatggggagaaaagatgctgaaagattacttctgaatcctggaaattaatgaggtattttcttaggaagagagagtgaaatggctgggtgcagtggctcatgcctgtaatcccagcactttgggaggccgagttgggcggatcacctgaggtcaggagttcgagactagcctggccaacatggtgaaaccccatctctactaaaaaaaaaagtacaaaattagctggacgtggtggtgagtgcctgtaatcccagctactcaggaggctgaggcagcagaatcacttgaacctgggaggcggaggttgcagtgagctgagatcgcgccactgcactccagcctcggcgacaagagcaaaaactccgtctaaaaaacaaataagcaaacagaacaaaacaaaacaaaaacgagagagcgaaactactaaaggtgcttattccctctctattcgtgattgggatgaggtaaggggtgacaatgtgaaacaccacaaaattaggaaacttgacaatggtagatactatatcacaaccagagaacaacttgatactctgcagaaattggcaaaacactacacagaacatgctgatggtttatgccacaagttaacaactgtgtgtccaactgtgaaacctcagattcaaggtctagcaaaagatgcttgggaaatcccttgataatctttgcgactagaggttaaactaggacaaggatgttttggcaaagtgtggatgggaatatggaatggaaccacaaaagtagcaatcaaaacactaaaaccaggtacaatgatgccagaagcttttcttcaagaagctcaggtaatgaaaaaaataagacatggtaaacttgttccactatatgctgttgtttctgaagagccaatttacattgtcactgaattgatgtcaaaaggaagcttattcaatttccttaaggaaggagatggaaagtatttgaagcttccacaaatggttgatatgcctgctcagattgctgatggtatggcatatattaaaagaatgaactatattcaccgagatctctgggctgctaatattcttgtaggagaaaatcttctgtgcaaaatagcagattttggtttagcaaggttaattgaagacaatgaatacacatcaagacaaggtgcagaatttccaatcaaatggacagctcctgaagttgcactgtatggtgggtttacaataaagtctggtgtctgctcatttggaattctacagacagaactggtaacaaagggcagagtgccatatccaggtatggtgaaccatgaaatactggaacaggtggagcgaggatacaggatgccttgccctcagggctgtccagaatccctccatgaattgatgaatctgtgttggaagaaggaccctgatgaaagaccaacatttgaatatgttcagtccttcttgggagactacttcactgctacagagccatagtaccagccaggagaaaacttctaattcaagtagcctattttatatgctcacatctgccaaaatgtgaagaacctgtatagaatttctacagggatcaaaagaagaaaatcttctttactctgcacatttttaatggtaaactggagtcccagatatggttccacaaaaccacttttttttaccccaagtattaaactttaaagtacgatgatgaattttccaaccgatttcagggtccaaagaaaatagagctaagatactgatgacagtgtgagtgatagcatggtaatgaaggacagtgaggctactgcttataaatcattttctttcttttcttccccaaagtcagaattgctcaaagaaaattatttattgttatagataaaacttgagtgataaaaagctataccataataaaatctaaaattaaagaatatcatgggaccaaataattccattccagttttttaaactttcttatatttattattctcaaaagttttttctgagttaaatagtcaataggcaatcttaatatatgcctccttttgcatggacatgggccaggtttttcaaaaggaatataaacaggatctcaaacttgattaaatgttagaccacagacgtggaatttgaaagtataatgcagtacgttaacattcatattaatggaactgaaaagtagaataagaaatttttcacttcagtccttttctgaagagtttgacttagaataatgaaggtaactggaaagtgacttaatcttgtatgaggttgcattgatttttttttttttttgagacagagtcttaccctgttgcccaggctagagtgcattggcgccatcctggttcactgcaacctctgcctcactggttcaagtgattctcctgcctcagcctcctgagtagctgggattacaggtagcaccctgtaatcccagtgccaccctgtaatcccagtgccctgagtagcacccgccaccacacctggctaattttttatatctttagtagagacggggtttcaccatgttgtccagtctggtttcgaactcctgacctcgtgatccgcctgccttggcctcccaaaggcatgagccatcatgcccggcaattttttaaggcaatatataattgaaactgtactatccaatccaaggggaaatcttttaatctttagataacatgcggagtaagacccagcatttaaagagcacttttaaaaaaatagacttggtactgtgagatattgctaatatgtccttatggtgatgggtgccacaaatagaaaatagaaccagatcagggacttgaatgcacttttgctcatgtcgaaatagatgaacagagagagtaaaatgtatttcaaagaaatacgagaaaagaaaatgtgaaagttttacaagaagagggatggaatgtaatgtttaatgttgatgtcatagagtgacaaaatggcattgttggcattcatagctcctcacttagctatcttctgagacttttaagagttataaggtataactaactataaaactaatttttcttacacactaaatgggcattatttgttcaaaatagtgaagtttcggcttcacattcattccagtgggatacggcttttatgcaaaacatttttagaactccagttttcaaatcatgtttgaatctatattcacttttaaagtctacttaatggtggtcattttttcccctttagaatatattaaatagttgatttggggaggaaaacttattctgaatattaacagtggtgaaaaggaatgtggaagttaacctttaccaaaagaggaagttggcaaaaacagccttctagcacactgtttaaaatgaataatggcagcctaaacttaacagtttttaccctgaagtgcaaaagtgaaacatacaaaataaaactatttttaagagtaactaaaaaatttcaaaatacaaatttgaatagcagcattagtggtataagtgtctagcaaaggaaaaattaaatctaataaataaaatgaaggtctagtgtgtatgttataaaatactctcttacagtcacaccttaaattaaaccttatactaggttcctctattttcaggatataattcttaactatcattatttacctgatttaatcattagatttgaaattctgtgccatggcatatacgttcaaattcaaaccattttaaaatgtgacagatggacttcatgcaagttggcaatggttctcgtactaaaaactgtggttgttttttctgtttacataacctgcttagtattgactctctaccaagagggtcttcctaagaagagtgacgtcattatttcctcttgtcaacaacttgtgacatgagattcttaaagggctttatgtgaactatgatattgtaatttttctaagtatattcaaaagggtaacaaaattatgttatgtactaaatctgatcaggaaagtaagccaggaaaagttgatggtattcattaggttttaactgaatggagcagttccttatataataacaattgtatagtagggataaaacactaacttaatgtgtattcattttaaattgttctgtatttttaaattgccaagaaaaataaacaactttgtacatttgaagagtttttccaacagcttttcgtcttcagtgtcttaatgtggaagttaacctttaccaaaaaaggaagttagcaaaaacagccttctagcacactttttaaaatgaataatggcagcctaaacttaatatttttataaagtattataatattgttttgtggataattgaaataaaaaattctcattaaaaaatgaagtgatataaggatatagttagacaaacaaaaactgagggatttgtcaatagtggacctgcatgacaagaaatactaaagggaggtactttagtcagaaggaaaatgatctggccaggcatggtggctcacgcctgtaatctcagcactttgggaggccaaggcaggcggatcacgaggtcaggagaccgagaccatcctggctaacacagtgaaactctgtctctactaaaaatacaaaacagccgggtgtggtggcaggtgcctgtagtcccagctactcaggaggctgaggcaggagaatggcgtgaacccgggaggcggagcttgcaggaaaatgatccagatggagatgcagggagaaatggagagcatgaagggtgaatatgtatgtaaaatataaatgaatgttgactgtataaaacaataatgtcgtgtttctcgagcttaaaataatctagaactaaattgcatgacagtagcacaaaatgcaggggaggttaatgaagttaaaatattttaagtttctaggattattgggggttagtgtaagtaataattttagtataagtaataatttccattggattgtaatcagtcagggatgtttattttaatttctaagataatttataaaagaatagtgtatatagtcatgcactgcataatgatattaggccaacaaaagaccacgtatatgacagtgatcccagaagattttaatactatatttttactgtaccttttcagtaaaaggtacgtatattcaaaaggtaagtatattcaaatggtaagtttgaatatacttaccattgtgttacagttgcctgcagtattcagtatagtcacatgctgcacaggtttgaatcctaggagcaataggctacatcatacggcgtaggggtgtagtaggtatacgatgtaggctcttgtaagcatgctctgtgatgttcacacaattatgaaattgcctattgacacatttcttagaacatatccctgtcattaagctccacatgactgtatatctaacaagttaaaagagggaaaaattaaaacaacatttgctaatcaacagaaaggcaaaaaaaggaatataagtaggacataaaataggtgggtcaaattgcaaacaaagagtaagtagctacaaatctatttaagtaattacatttcatgtaaaggattaaatactccaagtaaaagattaggtttttcagactggataaagaaccaaccctcccccaatatactgcttacaagagatataaacacatggatggaagaggtgatataatacgaacactaaccaaagcaaagccggcataactacactagtatcaggcaaactatgcaataatgctgcttttaaataaagatatgtttcttaatgataacagggccaatccaacaaaaagatatcacaaactgaaatctgtaggttacaaataacttcaaagaatataaagcaaaaattggcagatataaaatgacaaatctataatcctgttgggagatattaacacataaccttctagagcttatagaacagacagacaaaaaattagtaaggatatagaagatcctaataaaatgatgagtaaatttgacctaattgacatatgtaaaatgctgcacctagcaaaaatagaattcacattctttttttttgagatggaatcttgctctgttgcccaggcaatgcagtgacatgatctcggctcactgcaacctgtctcccgggttcaaccaattctcctgcctcagcctcccaagtagctgggactacaggcacccgccaccacgctcagctaatttttgtatttttagtagagacggggtttcaccatgttggccagcctggtctcgaactcctgacctcgtaatcggcccgcctcagcctcccaaagtgctgggattacaggcgtgagccaccggcgcccagcccacattctttaacgtacacatggagcatcaaaatagatcatgtgctgagtcctaaaggaagcttctacaaatttcatgattgaaattgcttagagcatgttctctgacaatagaattaagctcaaatttaataacagagttaaactaaagaatccttaactgcctgaaaatgaatatacttctaaacaatttataagtcaaagaggaaagtaaaatagaaattagaaactatttttaatgaaaatatatttaagaaatgatatataccattattattagtgtgatatatctttatcctaaaacattaaatggtcaaaagaaagcatagcatgactggacctgcctgatattagtcatcattgtaaaaatttgaaaattggaggaatattcttttctttctcatttatatatgaaaatatacataaaaatatacatacacatgaaaacttagaaaattatgttaatgtatttttaggaagaagggtcaaattatgatgtacgtttaccataatgtaaaaacgtaagctaaatccaaaaggattttactcagtgaccttattatttcagtctgaatcataatcaggcattttacctggatacgtatcccagcttgatctgtcataaaaaatttctttcttgtgtttctaaaaacttcaactctccagtttcagcatttactaagtcaccttgtcaaacacagagaaatctcctttagcagataatttttgctgggttgaaacagatgggcaatctacttgtggttatttcctaagtacttattgcagatatggtggtgattgctgctcatgcatttccatttgaacttgaagcattggtgtttctcttagctggcatcctccccagctcttctcacctctcttctggcttggcacatggtgggtctggctcatcagatgatccccttggaggatgctgcaaaactcctcagcaacctgctctgtattctttggctgaagatatcctccactcttggggctcaagtgcatttctctaagtcaatgcagcctttacactttgaagttattagtaattcttctctgacccctcatttttgtcagtttagtaatttttctttaatttctgcttgttgatttgtgaccccaatctctagaaaactcttgtcaggtatcttgaaatgtacattttgtacattgtatttccactttcctgtgtccccaaacagttacccatttcccatgttaaagttctaactgcgtatcctggcattcaaagtatctttacattacttattacctacctctccctgttagttttcactaccttcttacatagaatgtctacgttggccaaacctgactaaccagcattccccaaatccaagcccattctttttgttactttactgtgtcctttccccagcctagaatgctgctgcttcgcttgttgaaagcctagctttctctaaggtctagctcaatatggaaaatttctacattttctagcaagtctgtttgtgcagctatttccgtcttctgtgatggctgactcctctgattcttacactgtttgttgtctaatgctcatgtcatgcctaccatgtgcctgctgcttgtgtgtgtgtggtcagcattttcatctggaccattatttgactcatcagcagaagacctagctaggatctaggtgcaacggtgcctcttacttgctgtgggatatggggcaagtcattcagcaaaccctgaagtatctaccttatgtcagaccctgagcttacaaatgcagacactgtccctgtacttgaggctgtcatagtatgagggcttcatatctgaacttcagttacctcatctataaagtgaggctagtgatcgtcttctgcttacttcacaggctaactgtgagtttcaaataggacaccagatgaacaattgctttctaaaccatagtgtctataatatgctgttccgttacgtgcagcatagtggttgaaagttctagtgctgaactctgactgcctggatttcaactctactgcttactagttgtgtaaacttgggaaagcttttctctacctgggtttccttagctaagaactggaatgattatagtacctgtcttgtagggtggttgtgtgtatacacaacacacatagaacagtgatgccccacagctactgctctgtgtgttgatttatatacttcttattccagttagattttgaggcagcttatagaaatatgtacattatgcctagatttaaaaataaataatgggaaagagaaaataaatattattccaaggtaaagttactatatagattttttcactgattcaaccaatatttatttattattttttaaattttgagacagggtctcactctgtcacccaggctggggtgcagtggtgcaatcatggctccctctagtcttgaactcctgggctcaagtgatcctcctgcctcagcctcctgagtagcttagataacagggtgtaccaccacacccagatactttttttttaattttaaaaatttttgtagagatgaggtctcactgtgttgcccaggctggtcttgaatttctggccttaagtgatcctccccccatagcctcccaaagtgctgggattataggcatgagctactactactcctggcataaccaatatttattaaacaccaacattatgccagacactgttcagatgaacagatacaaagaacttatctctttgagcttgtattctggttgagagaaacagacaagaaacaaataataaacaggaaatgtacctggaagtaaaaactgctatgtaatgactcaaaacctactcaaaactcagcatgttgtattgtgacttggtgaccactttagattgatgggtcaaagactgtctgaggagatgacatctaaacccaggtttgaatgttaaagaggctggtcttttgaagatggaagcttggtgagggggagagcattttaggctaaagttgtggccaagacagagcccctaacatggtaggaaagaactgggcatgtttggggaactgaaacaggactagtgtggtctggttgtactgcatgaagagaggggcaggtagtgtgagataagatcaggttgaagagagaggcagagtgtttggggccagagtaacacatttacattttattctaatgcccgtggaaaaattaaaacagaggagtattaggtgtcatgttttataagtatcagttaggtcaaggtagttgatatgataccttctacatctcttttgattttatatctagttgttctatcaattgctgagaaaagggtgttaaaattttcaactatgattgtagaatgtctgtttcttcttttattttgtccattttctccataatttttgaagctctgctattgagtacagaaacatttttgattgttgtgtctttccatatgaaatgtgtctatctctggtaatattctttgtcttgaaattgacttcactggatattaatacagatgtagacacttcagtcttatgcttactattttcatgaggtatcttttcccatcgttctactatcaatttgtttttatatataaagtgtgtttcttttagacagatataaaagtgtcttgattatttttttccctcattctgacagcctctgctttttagtgaagtaattttagatattgtatttatcctttgtggagtttgctgagtttcttgaatctgtaaatttatatatatattttttaccaaatctgggaaaattaggggccattacttcttaaaggattatttttctacctcaatctttctttcctctccttttaagactgattatatatatatttgatatttggatattatctgtcctatatatcctggatgccctgtctgagttttcccccaatattttttctttcttttctttagattggatacttcctgtggatttgtcttcaaatttattggcattttcttttggcatctctaatctgccattccattgaatgtttttttcagatactctattttttacttctgacatttttatctggttcttttcatagttattttctgctgctatttcctatctttttattcgttacatgaatattttctgttaacatcctttctgttatgtccagttataatagctgctttaaaatccttgtctgataattctaacatttgggctatcttggattggttttcattgatggtttgtcctcttgcatatgggtcacattttctgtttcttcatctgtagaataattttagcttgtatcttgaacatgtgattgatacattgtggatactctaaactctgttatgctcctccaaggtgtatggattttttcatctgttcgttgaagaatacagttaacttggcttactcaaactctgagccctgtcctctctgcagtggtggaagatgaatcttgttcagttctttaaggctcagctaggctgcttagggtctgtcatgctcatgtgtcattatggggcccaccagggattttgactggatttatacatagaattttggagctttccttctgtggctctttattttcttacagtttctgttggatgcccttttccattctctgtgttcctttggtcactcttcagtgcttattgtctatgtgtccagaattttagttgttatctcaggaggattgttctgttaggaattaattggttctgaccagaagcagagcctgagtttgtgttatattttgaatataaagcaaacgtgatttgctgatgaattggatgtagggggtggtggtggcaggggcgtggcgaaagagtggaatcactatgattattcattttttggcttaagcaactgggaggatgattttactcatttttttgataaagaagactgggagaggagcccgtttggctggagtacagaggatgtggaagttaagggtttcatttagatgtgttaaatttgagatgctttctagatattcaactgaaaatgtcaaatagatagttagatatttagaatctggagctcaggagtcctagagatccagacttagtcatcagaatataattgatatttgaaactgtgggactacatagctttacctagggagaacttagctggtgaagaaggggtgcccccagcaccatgctctgaggcagttcaggatttggaagtcaagcagaggagaggaactaccaaaggagaccaagaaagagaagcctggagaggataggtcacagaagtcagagaagaatatttcaaagaaggcatcagtggacaactgatttgaatgctgctgagaagtcaataaggtgaaggacaaaagagagagccttggattgggccagacagagatgacttcactagaccatctcactacaatggtggtggaacaaagggtgggcgcagaagcagagactatgacacctgtggaccaaaagtgcttgctcttagggctcaggttatttaggcttccagttcacctgggagctgtgtaaccaccaaagcagaaagggactacaggtctgtgaatatttattattgatgatagtgtttctatcctgcagtagggaagacttttcaccttgaactcagacctttccctgcccaggttacctggacaaccaaacttccggggtcagagatggcatttgctatgtatatgctgcaataggatgtttgtttagagctattggtagtcgactgcatggtctttaatcagtggtcttactgattatagaaagtgaataccaaattacagccacagatgctttaggctcttattttgcataccaagagttaccttttctgttgtcaagttggagcttagaaggcacaaggctcttagtcaagacagtgttgtggttcagagcatgatttacccagaaatgatgggatttgactgttcatgggaaggagcttccacagaatgagcatttgtttaaccaggtgtcaatttgctttgcaggtttcttggaacatagacttaaatttcattacacttgttttcaaggatcatcattccatgaagtcttattatcccttgaggctgttcttatgtagaggcagaaacttttgcctttggtttagtgatagtctaccattttatcctagcattctggcattaacctttggatttgcctaaagcaaaatacaacaaaaggaatcagccaagccaaaaatctttgatttattttccgactctccttcggattttggtatctggcttctgttactttgcagctaccatattcacatctggtatggtgcttggacatgttagacttgttctcctgaattgacttagaatggttaagccctggtcttttggctatgttgacattactggactgattcttcataaagattttcctgttggatagagtatcagccttccccagtctgcctgcctttatgtcaggttttattgtcttcttcaagaagactccatgtgaatttcagccatcacagtgtaacactgatgatctttcaggacaattaagatgttcctgggaatttctcagcgtgtgaacctgctagccctcatatgactcatgggacctcagtgtttcacgtaccctttttccctcacctgcatgactgtgcccttatctttattaggagtctaataaataggatttgctggttttgatttcaaagctgtgaaagccgtactataaggtaaaaggtaacctttatttctatttagtttgtgaaaggaagtcatatgtactaatcagtcattatagtgaagatctttgtgacagtttccctccgagcttcatatttcatgtatgttttcattctcttcttgtcttttggattaaaagtatttctgtaaataaattgggaacaattctgaggtccaggaccttctgttatcaggttagagcattgggagccatttccacataaggcaaatatttctaaagcacagtttcattatttagtcatttttaacaccaaccaggttacctttgctgaatacagcaaaatacacgatttgaagtcaccagtcacctgtctgttaatacttttatagtgcagctgaggttccaacctgaaaagccaatgctttcatctgtgggttaattcctttctataatacttatttgctttagttgatttttgaaaaatctctttgcaggaattctggcagtatatttttttcctccttgtagttttggaacactgcagttgagtgagaacattccctatcctaactcctagaactgaattacagccaaattgaaatgatttgtgctttgaagaggagaattggcaaggatgcatggtctatggctcgtgtattgtaagataattgtaaccatggcagtgtgtgtttcctaatattatgtttctacatttaagtgatgagagtcatcatagggaaaaaatccacttgtatgtttctagttgaatttaaattattccaacttcattattacaacattagaagtagctgtttcctgtggaatagccggttcagtaatttgctttatctcatgtgcaagtggtttctgcctgggccagtaatatattttaataaggcaagtttccaggaagatacaacctaacaatgataactttaaaaaacctagataaaggaatatgaaaaacttgataatgaggaagaccgcctttgcagaagtcgacaaatttatgatgcctacatcatgaaggaacttctttcctgttcacatgtaagtatttcttcttactctgttactttagtactgatgaataagggaccatgttcagcgtttccagaatgaaagttaaacagtagaaaggtgtttaaaattgaaaaatgcacgcccgggatggatcctatttcttctgctttgttgtttcctggtaatattaccacgatgtgtgttgcttcgtgtaagcttagtttatttccaaaagctgatactttcactgcaaacatcaatgaaataaaattgctaatttagatcaactgaagaaaaagtctcaattcaagacattctaaaggaaattaagctttattattttaaaatgagctatactttaacaattaagctaatcagctattgataaatataaattttaaatggtctctttgaatgaataaagtggcttataatcattgtgttaattttgtccattaatagttcaatagcagttgtaatatttttttttccttgtaaatcagataaacaatctaacttggtcattaggataaactaggttattaggaaattattctatcaggagtaactggaagaacatttaccatgtaatatctctatattaggaatgttttccaaaaggtggcctgacagtcctggcctgctgtatcaacgcagcagccactagctgcatgtggcaatttacatttaactttaaattaactaaagtcaaatgggagtaaaaatttaatacctcagttcctcatgagccacatttccagtactcagtggttacatggggctagtggcttttgtattggatggcacagatacacaaccctcccattgtcacagcaagtcctattggacagcactggtcatggtattggtgtattttggtgcttctgtattcattgtttatgtacagttcttgctgacatttgcataactgtggctaaagaggacgtctctttcttgcggcatgcactgctctgttccttggacccacctggcttgatgaaggaatttctgggcctaggactaattgttgctactccatgccttgctgcctcagtagggaaggactgaacccttgaagaatgccagatgttcaatgggaaagcctccgtaaacttagtttttatgtagttcagcagtttagagggtgtttattcgtatgatggtacttttaagcctttcttcttattgtacattattaaagaagacacaatttgaagtttggagaggggaggataccattttaatttttatcagtgggagctccatttttttccccctagttcccctcgctgtggttacagtaagactttccttaactagagccttttaccactatggcttgactttgtaatcctgacattaattcttaggggtatttttgtgtattttctcttatttgatggaaattttatctttttacaaccccattatcagtttgttgatgaatgtatgcatttagggcccaaacaatcctcccatctcagcctccagagtagttaggactacaggcgcacaccaccatgcctggctcatttttatttttatttttatctttatggaaatgaggttccactgtgttgcccaggctgatcgcgaacttctgggctcaagtgatcctcctgcctcaacctcccaaagtgctgggattacaggcatgaaccagtgcacttgacctgataataggattctttacactttattatcagagtgatcttgaacccttctggaattgcataatgtcagcccctgcatggtcattcttctgggcatgtatctaagaactggatgcccagaggaacaagcatttgctgcgattgcctataaatactcaacagatttttaaagaatgtttgttaatataattaccgtaggttactgtttagtaattgctgtgttaaatttatctgttgtgatattatataacatacacagattggttacattttattatttaaaaatattatttttgactttgatagcctttctcaaagcaagctgtagaacacgtacaaagtcatttatccaagaaacaagtgacatcaactctttttcaggtaagataaaattattccaaaataaatagataatatttgcttaacacttggccttggtgacattctttttgcatgtgcaattacactagaggacttgctttgtaaagactgtgttctattctggagctttgtctgggactatttgagtttattatcgcttatcttcccattgcaaagtgtccttctaccaacgtgcttcctaaagccttttctgaaaaaggtcattagagctttgtcgtaacattatgttctagaaatcagtcaagataagacatcagagaagcaagtttttgcccatttgacattccagcacctgtgatgagcaatgactctacaagatttattttgtagtgccaggctgttgatacttgctgtgattatcctctaggggaaatacaatttattttcaagattcaggagcaaatgtttgagtgatctttgagtcatgggaaattgtattttaccttggctgttcatatcttgaacacaataccgtcatacaggtttaaatgacaagacttggaaaatcagattcccaactaataggcctatgtatttggcattccttagatgaggtggtttcacttcctcccaaaagccttttccatcctgtgttttttatagaggtggcagtggtttacaaggacagtcagattctccaatgaacaaagtgcttttcatgtttctataaattacaagaaataggaaagaatgtcattgagtaatataatggttttaataagtgaaaataatcaactcatctttttcctggataagttgggcatttaaagggaggtaagttgactttggcattttttttttttttttttttttgagacagagtctcgctctgtcgcccaggctggagtgcagtggtgctatctctgctcattgcaacctccgcctcccaggttcacgccattctcctgcctcagcctcccaagtagctgggaccacaggtgcccgccagcatgcccagctaatttttgtatttttagtagagacggggtttcattgtgttagccaggatggtcttgatctcctgatcttgtgatccgcccgcctcggcctcccaaagtgctgggattacaggcatgagccaccatgcccggccaactttggcatcttatgatggtgtttatgcaaaatgaatttgattattcagcagagcaaataccgatttggctcttagagcatatttagatagtaacaaattgggtgttacctttctgtgacaataattagatggactttcataaaatgtaatacctgtctggatagtagtgggttataagcttgggttatgaaattcattgacctgacctggctttgagtcccagggccgtagctggaggaccttgggtaagctcctccaccttcctaacttcagttttctcatctgtaaagtggaaatgacactgcgctctccctgaaagggaggtcttgattcagtgagaagggtgcacacgggttgctttgtacgaggcccgcctatcactgtgctccacaaatgttagctattatcacacatcttacagtcagaaagtacagtgtcaatatctgctttttgttgtctccatgatatttgagtgtcagaatttcagttttcatctgactttgccatggtacgtagacagccttatggtcaattacatttaacattgctaaaccatacctcataatacatgggttttacaaatctgattttagcttccactataacataaataacattgaaaaaaaattgttccagttgagatacaaagaccactaggattctttcataccttcaaaaaacattcatttagaagcaatttctttcatatatcttttaaaaaacactttattgatttgttttgttcattaaaaaaatagtcaaaattttctggctaaacagatatagaatgggtattattcttatttcagaggtgaagaaaatcttataaagtttattaaaataaggagtatattaatgcaattctatgtattatgtaccatcagagcataatgactaaagtataagtaaaaggtatatgtctgaatgtcctgtttacagaggtacattaaccagtaaagtcagttgaagttcatagtaaaacaaaactgtttttaaagtaaatacgaatgctttttattaaattctttttgttgtaagattgcctttagaggtaagtaagtgcataggtccattggtggcgggcttgggaggggccctagcttgtgcttgagtgcttctaaaatgcactgtgccctgagctcggctctcagtattctgaatcttaccgaattctcacgacagccttacaatttagatacgactgttctcttttacagattaagggaactgaggatcagagagggaaagtagtctgctcctcatctcactgttgaactctggctttcatactccttagcaagcctgttgcggttctttctgttgaaaagtggcagcatggtagattctacgtagtcttaggaattcccagtgacactcatcttttactttattagcagaaagtagggatgtttgataaaatatgaaagaaaaatattaattgacataatagcttttataaatagaaaaatctgtgatctataaatgtagccttttcttagatctttggacatttgaatctatttcgtctcttgactcttttgaacctcttgagacttgtcgaggacttggctaagatagatgttgtgtgtttcctggaatcaggatttcagagctggaaggaacttcagagagagataatttagcttcctctttcaccacaaaggggacaaagtccatatggttttcgcaactagctccagtgccttccccaggacagggatagttctgcaagttggggtagactggctcaccccccaccaccgccccctatcccgcgttgcccgccaggctagcgtcctttctgcttgcaggaagcaaggctcccagaaggactgcagctgcctcccagcccatgtttggttcctgtggcttctgcagacttcctattctcatcacttggtttgtactgttccatgatgtagtttttcttttattttgttttgtaaactttcaggatgatctatgaagacataaaaaaaaggttaaatttggatcattcaatgagctgagggtgccaaaatgtttcccaaaactatctaattgactctgggctgaactgtgaaatattgtctctttatatttttatagttcttgattttaaaagttcataacatggaaaaggaaagctgatgctgtttattcagtaatgggtaaagtggcatgaagttgaagtagatggtagttgttctccatgaggggaagagcactgtgcatgtgaaccaggagccctcgccttaaccccagtttagccatggaccttctcagagaccttgggagtgcacctgcctgcagtttggtagccttacctgtaagatgaggagtgggattggatcaactctcccctgtggttttctctatgactctaagagatagaaaatcaataaataaaatagctaattaaaaaaaatttcacttcatggacctattagctttgagtttttaaaactcagtgcagattacagatgcttttattagcttacaagttgtgccacataacttgtggggcccagtgcaacgtgaaaacgcagggctcctcatacaaaaatgattaagaatttcaaaatggcaacaacagagctttaaacccagcaccaggcttttctgagtcacacttccatgaagcgagccctgctcctgtaagaagtgtctgtgacttgccaggagtcatattaggtagtaggaatatagtggcaaacagggcagacttgtctgtgtcttcatagaatcaagtggtgtagataaatattgatgaatgcattagtgaatattagacaagcacggagaagggcaggtaccagacacaatgctatggggagtgcataattgggaacttcgcttaacctgagtctcattggtttgtgtttttttgatacattccgattcattcaccgtggaatttcttttccatctcttccagccatacatagaagaaatttgtgaaagccttcgaggtgacatttttcaaaaatttatggaaaggtatgaaactttatgcatatatatacacaattttttatcatgtacgtgtacctcatcttatgccgtaaatgctgaccttaaaatgtgtgttaatcatttagcaagtattcactgaccatgtacgatgtgccaggctttgtgttaaactgtttcctcagtactttacattataattttagggtttgtctatcttaacatctctttgaccttcaatttctcagcttcaatagagtctaaaatatacactgaggaacctcaattttaaaaagtatcttattgagagacctttgctaataatgcaaacttgactataatttatctgattcatttgcttggattttggaaacatgtctcccaaagcaggacaagcctgtacttgattcttcatgtaggagtagaatttaaggacataggtcaatgtctgtttatgatcgtgtacatcattaaatacctaataaatatgtcccttggttactcaaactatagatctactggtcaattcttcagttttttgagtatgtctctgtgacaatgcaccactgaaattggaccctctaaaacagaatctgcattgacactgactttatcagcttggctaatttctagacaatatacgtgatgataatatctcatgctagagctttctgcagctgctcagtaattgcactttaagaacaaatgctactttactgtagttttcttcaccacatattcacagaactaaagcaattaaaaagaaagttgtgttgcaattctattggagttcaagaggtaattttatcctggagcagagtcaatatgttgggaaactaatattcttacagacgattgtacttttctgagtaatagcaggaactttgccaaaaagcgccagcatcaaagggagagggtgggctgctggctcagggctgagttgcagccaagtcctgggccatctccatggctgttggtcctaaaatctgacctttcccaactcttgggtaaacctaacttttgtgtgatccttaagggagaagggagagaggggaaggtaattgaaagtggggaagaggttctcccatggatattttataactttgccatgcatcctttcacttgaaaccaggctcacagatatagtgattttcgctcattgagacagtcatttcatagcctcacagtaaatgcaaacgatgccgtttgcattttaggcaagcaggcacatgggattttctgcagccattacaattttctgtaaataaattatttttaaagttgatttgttaatttccatcaaattagaaaaaagaattcatgtcaggtgataagtttggagctttgattttgaaaagcacagggactccatcaatatggtcatgtagcctttgacctcatagggactgggcacacgaagggccccatggaaaaggtgatttttccatgaccaccctgagtctgatggtaaagagggagccatcagcaatgcagggacatgtgcgatgtcttcccaccttccctgaggtccaagcagggctgtggggctgagttccaggtgaggcagaattggagagggcagtggaggctttccctcttctagttgagagctatgcgcctcattcaggcagtgaacttcagttgctcagcaggacaacgactgagtcaggaatcagagttaaaaacacttctcctactccacccttactgcatcccaggcgtttccatgtctttaacctctgatcttctctccaagatcctttgaagtcatttgcaagggctctagctacctgaagccctatcattgtctgggctctttcctttgtcacagttcccctcctgtcaaaagtgtcccactcagtaaccaggcattgattgggaatagcactcaaataacccccgtggagacaggactgagcctagatactcagggccatctgtacttcctaaagaggaacttgttacagcaaatccattcttagtgggcaaaatatgtaggcacttctctcttccttgtttgttaaccctcctcagctagttgtaaaatgtgtcagatttccatcccctgtcaccagctctggactccagaatctgtgagaaaagacagtaagagctagcctcacaaaccaagtgcatttcaaagaccagtcatagatttataaatgggagtgcacccaaatgtggttttgccttttgcatgcaccatacttttaaaaaataggttgaaataactcttagaaagtctcaaaacataattttaattgaccaacttcattagacatgttaggaggatcagtgaaacactctttgtgagtcattttagattcattgaaaaaaagatgctattgtaattgcaactattcctctgcttttgatttttaatttgattgttagcctcagaaatatgttaaagatccttattttttaaaaggtctattggtcgggtgtggtggctcgcccctgtaatcccagcactttgggaggctgagtcagcaggatcgcttcaggctagggcttcgacaccagcctgtacaacatagcaacacccactatcttcaaaaataaaaattaaaaactaatagcttagtgcggtggtgtgtgcctgtagtcctagccacttggggggctgaggtgggaggatcacttgagcctaggaattgagggttgtatcgacctaggattgcaccactgcactccggcctgggacacagagtgagaccctgtctccaaaagaaaaaaaaaaattgtaaagctcattaaatgaagcccctagggaactgtgatatttggatgtctttaaggcattccagtatgatgctaatattacctataactcccttcctcccttcctcccttcctccctctctccctgaatcctgtgtctgtgtaaggaatcatgccaggggcaaaatgagatcgaaccatcaccagaatgttctctacgaagtattcaatctagaatgcatttcttttgaaaatagtttaaaaaacaaacacctggccgggagggtggctcacgcctgtaatcccagcactatgggaggccgaggcgggcggatcgagaccatcctggctaacatggtgaaaccccatctctactaaaaatacaaaaaaaaaaaaaaaaaaaaaaattagcctggcgtggtggcgggcccctgtagtcccagctactcgggaggccgaggcaggagaatggcatgaacccgggaggcggagtttgcagtgagctgagatcgcgccgctgcactacagtctggggacatagcaagactccatctcaaaacaaaaacaaaaaacaggccaggcgtggtggctcaggcttgtaatcccagcactttgggaggctgaggcgggcggatcacaaggtcaggagattgagaccacggtgaaaccccctctctactaaaaatacaaaaaattagtccacgtggtggcgggcgcctgtagtcccagctactccggaggctgaggcagaagaatggcgtgaacccgggaggcggagcttgcagtaagccgagatggcgccactgcacttcagcctgggcgacagagtgagactccgtctcaaagcaacaaaaacaaaaacaaaagacccaccttacagatatattgctcattaataaaaaacgtaatcaaaatgtctttgttaaatagatacaggatatatctttttcctcatggataaagaaaacactcatcaagcagttgagtgaattgtgggagcatgtcagtgtggtgaacctattgcctcttaggattctagtctgagggtttctcttctataccacctgtgtctattggtctgggttcaaattccactctcccactctgtcactgtgtgaccttggccaagcctctgaacattttgatgccttggtctcctcagctataaaatggggatcataatagtacctggctgtagagtctgtaggaggaatacatgagcaggcctggcacatggctactcttagaattatttgtaaacattaattttttgtcttagagctgtgctttaaaagccatggctgtccaatatggtagccagtagccagatacagctattgaacacttcaaatgtgatgagtctaaattaaaatgtgcttttaagtgcagaatgcacttcagatttcaaagacttaatatagtaacaagaatgtagaatatctcattaattcatattgatttcatgttgaatttttaatatattgggttacataaagtatattattaaaattacattatatatgtggttcatatcatctccgtattggactctgctgattcagataaaagtggtaccatagcttatgacaattaaagaagaaacatgaaatctttcatttgaatcatgaaataaagccatgaatacgggtgaatgctctgtgaaaaagggtttcagaaaacttaactttatttgacaagcaacccaagtaatgccgttctagtctgtcttacggtgttgttttgtaaatccagttaatttgatatttaactttttagtaattattttattctcttttagtgacaagttcactagattttgtcagtggaaaaacgttgaattaaatatccatgtgagtatcatctttttcttttttcattttttaaataaaaacttcctctggcttaacctcatgagaaaatacttgattctggaacgtactcccagagggtccactgcccaaacagatgtctgtcttacagctttaagtactaagcattcaccctcccatgcttccttataaacaatagaagctttaatcctttttcatattcatatgagaatgtgcttgtttatgtaagatattttaagaggtaattgactctttaacaaaaatagtagtaaaaatacaaatcttttacttaatataactccttcatgtccttgccttctgccattctggtagagttccttttctttttcttattattagatataataatacaaattgagtatcataatgaaaatgatgacatcttttatcagaccaaggcttcatcttcttttttatcattttgagagtgataaaagcaatcttccaatacaggccacgttctaacacgtcatctccttagtgtttcatctactttaagttttcaatttcagtcattcttattgcatcatccttattgcagtttgaaaatgcacacatttctttgcacagtctttcttacattctgttttataatctcccttctcataggcttgcaattgggcaaaacaatcaaccggaatttttttttttttttttttttgagattttttacttgaatggtattgttggaagaggggctttttttttttttgagacgagtctcgctctgtcgcccaggctggaatgtagtggcgcgatctctgctcactgcaacctccgcctcccgggttcacaccattctcctgcctcagcctcttaagtagttgggactacaggcacccgccaccatgcccggctaattttttgtattttttagtagagatggggtttcaccgtgtttgccagggtggtctctatctcctgacctcatgatcagcccgcctcggcctcccgaagtgctgggattacaggcgtgagccaccgcgcccagcaggagttttgttttttttaaaaatacttgatcttcactaaaaggccaagaaatgatctatttttttttttttcaatttctaacctccttttcccatcatatttcctggaaggatttagaagcaagaggcaataccagatactctaaaaaccccttatatctgctctgggtctttcatacgcttctgcctcgggagaccctgtgtccttgtggactctgagaatcaaacgtgaagtctgtggcccaaacgcaggtttctataggatgttttaaggttgtttgggggagcccttaaagaatcccacccttaatttgccaggatatgtaaagtagtaggtacttgctattgtcttacggcctcttacgtgaaatgtcagattcactatctgtctttgtgccacttaacattattaaatctaatgatgaagtggggcattactgagatattattgactgaaggaaagtgcttatgaatacagcctctgtatatacttcactcacatttagccttgtttcacgctcacatggccagcatgagtcctctctattcactgatgttaccaataacaaattcacatggcctgcatctgttgggtttcctgatcatatggccttgtatcatgaacacatagatgcccctgacatggactctcatttttcaactctgacagttctcggaagcattggattgttcccaaacattaggcttcggagtagctaaggctgcttttcattttgattagacatttcacattcacttgtcctcaaggtatacatattgtaatctgggatttgtgagagtggagaaacagttcggcttggttccactccatcatcttcccttgtgcctccatttggtgcctcgtttatcctggaggtggagctgagggaggctgtcaaaagtcttgccacccctggggcatctcatccttcagcttaaagactcagtcatgaaaagggtagatccctaagtcagattgctattttaattactgtctatgttttgcatgaaaaaatctttaaaacaccatagctttgtgtaatcttatgttttcattttgtgtttggatttcccagttgaccatgaatgagttcagtgtgcataggattattggacgaggaggattcggggaagtttatggttgcaggaaagcagacactggaaaaatgtaagctttcaatgctcttatgttttactggcactattaaaattttaatatttgcatgaaaagaaaattcctataaagaaatgtggaaacctatgacatttcttttgaagtactttacctccaaaagaaataagctgtaggccgggcgtggtggctcacgcctgtaaccccagcacttttggaggcagaggcgggtggatcacgaggtcaggagatcaagaccatcctggctaacagggtgaaaccccgtttctactaaaaatacaaaaaattagccgggcgcagtggcgggcgcctatagtcccagctactcaggaggctgaggcaggagaatggcgtgaacccgggaggcagagcttgcagtgagcggagtttgccactgcactctagcctgggcaacagagcaaaactctgtcttggaaaaaaaaaaagctgtattttgttaagcatggggaatgagagcaataagctggaacctccacctcttagggccaaatgggaagttcaacaataaccttgtatcctgtgcccaagatggtgcgggttgtgggtgggagccagggagccagaggtgaactagaagggatccttgacaactgtggcatgttacgttcagcctccccatcagatcacatgacaaagaattgtttgctttgcaaaagagagacattctcttttaaataaagactcaccgacgatgaagtgaagcataagccgttgtggcatttcagatgctggttcgctagatcagtagctggggtgctggagaggaggaagccctgtggacaatgatcaccgatcatgggctccatcactcaccttggttaacgtttttcctgggaggtcagcattcagaaactaactgcatctgagctgggtagaagggtcttctggagagtgaatggtggaattcttaagtgtgggggaacatttttttttttaacagaagtggcttaagacatatttctgaaagcaaaagatagtggaaaaatatgatttgatagatccagaactacaagtttggttaagtgccaggcatgttagagcagtgggcttggtggagtagtatagtgtgtgaggcttggttataaagtaattgagtccgtgggagaaggggtgtttgaggccccctaattcagtgcctgcctccggtcagcctctgctcaggcacttcctgggattgggagctgatggctttgccaagaagtcctttccgttctcagacaggtccaatggatgatatgttttttgaggactgaaatttacctttgttaatttgtacccattggttgtctttctactctgggggcctgggcagggcgagcctgatgcccggcactcaggagtttgaagtctggggtggtgcccaagcaatgtagcctagggatctggagtaagggtcctggtatcacacctgctacgtcaggttcaccctccacactttctgccttggacaaagtttgggacctctcaatgcctccatctcctggtctataaagtaggagtaataaaagtgccttgttatgagaattaaatgagattagactttgtcaggctttcggaaggctgcttgttgtgtgttaagtacaaggaaattagagtatactgaaacacagtcctctgcaaccctggtcagtttcactgaaacacagtcctctgcaaccctggtcactttcactgaaacacagtcctctgcaaccctggtcactttctcatggaaaagttctttcttattctgtacttgcacagtgcactttttcatcctaagtgatatactctacttgttgcttggcaccgttcattaatttctgctagttttgcttcataattgtatttagaatatctagtcagacacttgatgttatagaagtaaataatatcggccgggcgcggtggctcacacttgtaatcccagcactttgggaggctgaggtgggccgatcacgaggtcaggagatcgagactgtcctggctaacacagtgaaaccctgtcactactaaaaatacaaaaaattagctgggagttgtcatgggcgcctctagtcccagctactcgagaggctgaggcaggagaattgcttgaacccgggaggtggaagttgcagtgaaccaagattgcaccattgcacttcagcctgagtgacagagcgagactcagtctcaaaaaaaaaaaaaggaaataatatcaacttatctctttgtacacatttactatttcacataactctcaaaaatagccagtgggtagtaaatattcttctattctatagatcaagtgtagatacttctcaggagccatatagctagaaaggggtcaagtcttaaggcccacgaaccctcactcatgtctgttcctgtcaccaggctgccagttgcatgcacactggctctgcgagcccatcagtgaaccacaaggtgcacccctaggagcctgttaggtagctctttgataccttctaaacagaggcccaagaatgcacttgcttcccagaggcccgaggcctgtgtgctatctcctttggtctgcaatctaaaggttttattaaaaaccaccaagtgcagtggctcatgcctgtaatcccatctactcaggaggctgaaataggaggattgcttgaggacaggagttcgagaccagcctggacaacataatgagactctcatctctaaaaataatattttttaaattagatgggcctggtgacaggtgcctgtagtcccagctatgctccagctactctggaggctgaggtgggaggattgcttgagaccaggagtttgaggctgtaatgaggtacaatcatcccactggactccagcctgggcaacagaatgagaccccatatcttaaaaaaaaaaaaaaaaaaaaaaaagaaaaggaaaaaaaaagaaaagaaatcaactccacatggaagagagtggtgatagaggtagtgtaaaacattttgaaaattcttttaaataaaaataagatatttgaagaacatatcacttcatgtgtttctaacatttgatcccacatgtaagcaaattaatgtcttgccaattgatttgttgtaagaactcgtagaaaagtggataaaaacaccaaatttgaacatttatcttgtttttatataacttaaacatgataagttatgatcaacaagaaaaaggtagattttctgtgtctgctacactgagacagtgtccatgctgcagatccgggctgaaggaagtagtccatcatctgggaatttagagttatacacaagaactttcagcctgtgaaacgtgtgaaaacacttgcaagaattcccttttagccttctgttgtcctaccgaaaaagcttcctgttttctatagaatatgccatataacttgtctgcattttctaaatatgagtttgttccaggttttcaaaaatcttaagttgccaattggttcttctcaattgacttgcctcaatgatagtagaaaaatcttattgattctttgtattatttaaaacgtcataacttaaatatcaaaattaaaaataaatcaataaaatagcattttaggacatgctgttttgaattcatgccttccctttccattttgttgatcatcactgttttagattcttaacctctataaactcttataaaaattgaccactgctggccgggcacggtggctcatgcctgtaatcccagccctttgggaggctgaggtgggcggatcatgaggtcaggagatcgagaccatcctggctaacacggtgaaaccccatctctactaaaaatacaaaaaaattagccggtcatggtggcgggcgcctgtagtcccagctacttggaaggctgagacaggagaatggtgtgaacccggaaggtggagcttgaagtgagctggatcgtgccactgcactccagcctgggcaacagagtgagactctgtctcaaaaaaaaacaaaaaacaaaaaacaaacaattgaccattgctgaattcacaattcctagctgctaaatatatacatatgcccttattagtcataataaaattatttatgtccatctactttatcatttatttaactgggacttctatccatttaatgatacaaatatcttttaagtattgcttgattttgttttcacaatacatgcaaaataaaaatacttcttgcatggcgcttgggtattactctgcttcttttaaacatggcctaaatgttcagaaacttgccccagagtgacatatattgtttaaattagtctagatatatttacggcatagatttttcaataaatttatgtttctaggtatgcaatgaaatgcttagataagaagaggatcaaaatgaaacaaggagaaacattagccttaaatgaaagaatcatgttgtctcttgtcagcacaggagtaagtattcaatttccagcatttcttttaaaaatgttttgtttgtttcatagcaggatgatttattatttttccttctagctgattgcaaggccagtgagttcttgggtgggttagaatctgatagtatctctttatttgattttgcaagttagaagaacaccagccacctccattatgcacacccatggcttctccgtttagtgcctatttatttgtccttgacttccttctttgcagaatatggtagtagagatggcagaaaataatgatagccagaaaaatcactggaatatagtcaagacctgactaaacgactggcaagaaggactaacctagaggggaaaagtaagagaaaagtggcttctgtccttcagaagcgaatcgagagaagcgacttggattactcacatccgaattgtccttttgagattgtccctagtcagcgtttcactggaaggtgatcttacctgcctctcactacctgctactctgtttatcagcctttccatttctagcaccatatttctacttattggacactttctttgtatattaagctatcatttttagctcaacatgtgtgaccccacttttaccctacatcttctttacttactaaatagctgcccattccaatttctttttctgttaatggtattacccaagatcaaaacctcagcttttatgtgtctgtacagatgccagtgtatgtgaagacacatccaaaaaacccgtcctctcagtaccctgttacagcgtgtgtgcactggtatggctgtgacctggtgttcagagtgggttagggagtcaggacagagagggagaggcatggggtgagcgtggaggggccagacactaactaactgtgtaccccacatgtgaatgaaaccgtagatactccagccaggaaggtttatattcagtgagaaatgtgcgagacttctagatcccatggctggattttaagtaaggtcttcaccaaaaggatctgaaaaaaccaaattttagtgggtaatgaaagaatccctttcaactgctgagcaagtaacctgagacctagagaggttaatttccttccccaaatctctagactttttggccagtgctccttttatcatcactttataggctgtatgttttttcgtttgtcacctgtatttattgtattatggtttatattattctgtcattaaagtgtttctggaagaggtatttgctattgaagcaaaagaatagcataatgtagctaagttacaacaaatggaaaccccatagccataaataatttctaattatgtgccttgacctcccactgtatgggcattaagcatttcaaataagagttgctttgtgtgtgtgaccaagtttttaactgatgagaatggaaaccaagcatcctgcatactctgttggagtcagtgtgaatggcattggcttttaatttctattggaaatgtctgtatcctaaatttcaaacgtggatgtgagtactggatgaagattttaagtggttattaaaatattaattttcagtgagttatctcaaagccttggatatttattctcaagaaagcctatagaaaataaacgttttaatgttggaaaaacataagtatagttttcatgtaatatttttatattgatttgactcaggtgagaggagatgtggttaagtggttgtgtagtttctcactggtgtaaccctaaaagagtaaattaaaaaattagggttattttgggctatcactttgaactaatttaaaagaattatttgtattttatttagatatcaaaactgtatggtatttttaaaatttataaatgcataatttaacaaaaataattatagtaaagttatttggaattgtttttgctaatcaggggatactttctatagtttttaataaaacttagttgaaaataccctcattaagtgaagcttttgatcagactgtatcggcaggctttcccgtattgtggacatgtaactgaaatgcattcactcaccacagttttctttttactggaaggtttttttttttttttaatctcaacttgagtattcctacccatctccccaaaagacagtaggaagtactgttcccggttttcttctgtaattctcagatggcaaaaaaggaaatatgcatgttggagaaccagcataagcgtgtccacagctgtgaagagcagtcagcaattcatccagtcagtcatttaagttcctcagaagcgtgactcatttattccctgaaccacagttgaggatttaggttgaaccaggcactctgcggcaagctgggactgtggtcccagttcttagttctcatacagctgcatggaaagggaaaagatgtattattcaaatgatgacggaaatgtatggacaactgggacctgtggcaagagctatggaagacaggcacacagtgctcggaaggcctttcgcagggtggagatggggtcagcgaatgcctttctgaagttgggggttacctggagaggagccagtgcacgtggctcctctgagcccaggcacgtgaggttgggggaatcagatgaggggccagggtctgcggtggtggggggagtcgtgcaagacaaagctggagagagacatgaaggccaggccagaccgtgaagggcatcgccggccgatcttgaggagcctaaatgatctgactgcagttagaaaccaagtgttttaactagagagagaccataatcagccttgcagttcacaaagattgctccggctgcagtgtggaggattttcttcaacaacgacttcatggtcctgttttatcacagtttttttatggcgagttcctgcaaaatgtaagctattttgttgacttttagtaggaaatcaaagtagacagttccttgctcaagagttttacttaatggtctacttctaaaaatccacttttattctgacttgtaatcaaggcaggccgtcttatccataattatccttggaactgtatcccacccttcattaaattgccacttattttttcatattggtcagtattcggttgtgtcctggactccacatgaaacccattatagtgtctgttcagcaccccgagaggtgagggttgcagtaactgatttctgtagagataaccacatctgattccttcacctgcgtgtttattttacatcgagtcaaagataaatatagttggactttagttaaagcatttatttggtaattaaaacagcatttatttggtaatgactagacagtaagagaaataatggagctccattctgacttgtgcagaggtgaccggatgttttaaagggacagtggcctgtggagtgcaatgcgggctggagcagagtcaaggaagtgaagaattttacaatgcaggaaggggcatggtccatatgggacccatctgggtttgctaactgggacttatccaagttagactcctaccctcccatggaggctcggagataggggctctatctttgagtgtttgctggaacaaataaaaattctttgggaagccttgatttctctgaggcagtcattttaaggggggctgagcctcctagggatgtggtcttgagctgttagctttaacaatgcaaattctgtttacagattatgttgaaatttgaacattttctttggaatttaataattttttgtgttcgttaagaaacaagatatagacaatctaggccattttaaaaactgaatcagtttagtgacaagtatacactttatgtaaagaatctaagtggatttcatagataaaatagatctaaatagagctaatagatctagcatagcactgatgaattttcataagggaatacacgcatctccggcacccagatcaagagacggaaagttaccagtattctagaaatctctttgtgcctctcccagtcactaaccctgcacccaacttaactactacccagatttctaacagcatattttagctttgcaaattgtgtttgaactttataaatgtgcccttctgtgtttggcttctctcactccatgttgcttacaagattcatctgtggtgttgcccacggctgtaactccctcctgtagctgtgcagcagaggtcagaaagccaggtgtggctcaggccaagtctagcttgttggccttattttatagagcccattacctaagaatggtttttacatttttaaaggattgtaaagaaaataagcaaagaataatagatgacagagattatatgcggcctgcaaggcctaaaatatttactttttagccctttgcagaaaacatttgctgatccatgatctatatggcattctagtgtataaatataccatactatccattctactgttggtagacattggggttatttcctggcttgtgctattttgaatgatgctgttttgaatattcttgtccaggtatcttggtgcacataagtacagattgctattagatgtctacctgggagtgaaatcactatgtcagaaagcttgcaagtgacactcagccttggtagatatcaccaaatgggttgctaaagtggctgcaccattcgttgtacacttccagtggccatatatgaaagttctattcactgtatatcttcccagcactcagtatcgtcagtgtttttctttttagctgttctcgtgggtttagtgatggcatattgtagttttaatttgcgttaccttggagacatcgaggttgagcatctgttcattagtttgggggctatgtggtatcctcttacgtgaattgcctattttttttccccatttttctgggggttggttgacttttttaagttgattttttaaagttctttgtatattatagatatgagtcctttgtgtatttatgggttgcatatatcttctcccatcctgtggcttgtctttttactctgttaatggtatcctctgatgaatagaagttcttaattttattttagtctaattaacatttttattgttactgccttttgtggcctaagaaatctttacttaccctaagatcatgaagatattctcttttgttttcttctggaagctttattgttttatcttttacacttaaatctacatcagctggaaatggctgtagcgtatggtgtgaggcaggggtcaaggttcatattttattgtacagatattcagttgctccagcaccactgattgaatagaccttcctttccccaggccctgttgtgtcaccttaataacaaatcaagtgaccatttatgtgtgggcctattttggattcccttttccatttcattggtctacttgtctgtccttgggctaataccacactgtctgaattactgttgctttctaataagtcttgatatctggtcctgtaagttttccagctttgtttgtattcaagaatattggaactttccttgactgtttacatttacatatattttagaatccaacttgtcaattttcatttcaattaagattgcatggcatctatagcttaattaggggaacactgaaatctttacaattgagttattgagtccttggtcatgataatagttttccactttcaaaagctaatttaattccatttttattctcagtgtttcaaaacaacgccacaaataacattcctccctccctgacccgtgctgtgattccattaacttcagaagcagagattgaaatgggtatttgaatagccagaaacaaaatgttgaccagcaaaaagcctggcaagatggtgatatgtttctgtatctagccttttgaagaggatataattaggatagagacatgattgaatccaagcaagaaaggaccttcaaggtcatctgctccaattattaatgttgtgtctctatgcattttattatgtaaccagctccattttactgtgactttaaaaattaccatataggtgttggtgctcaatgcatggggtggcagcttggataaaaacccacagcatatattgtatattaaaaaatagcaagaagagagacttttgaaggttctcaccacaaagaagtgataatgtgtgaagtgatggatacactaactaccctgattagatcattatacaacatagatatgtgtcaaaacatcaaactgtacaccataaatatgtacaattgcaatgtgtcaattaaaaaataaagtaattttaaaaatatgtagcatggtgtttggtggtagatgtgctttctaggcagcttttgctcttcttataaacttttattgtttcactctaggactgtcctttcattgtatgtatgacctatgccttccataccccagataaactctgcttcatcctggatctgatgaacggtaagcaaaacttggaaaatctgaatgccttgaaagactttgccatgatgttaaatcttagcatgcattaatctaggcagactggcaatgtgggtctttcaggtaattaggttccccctgaagtttgaggaaaccttttaccctttaatcttcactgaaaattcatttttcaatgttgactgcaacgtccttctgggcctcccagtctcttcccaagaaaagattctagaaaagattatcatgaaatacttacagtgaaacttgattttctggaatgcagctggcctagatctttaattagcttatttcctggccctcaacttttaggaatgaaatacctcataagaatataggccaaagatagaaatgtatttaaaaaccaactttgaaggactgactttgggccaagtacagattttagcccaatcttctgcaccttctaaatctgcactactgtacattgatcttttaaactgtggatgatgactttgaaaatgctggaaaacgttcagctagaaaaggagctttctgatactagaaggtgtcatggtatatatctaaagtatttttagtaacaagaactgaaataaagcatacaattcacaactcacatgcctagttttttttttttttttttaagttcacttgaagttttatcatgttctgagtgtttgatttaaaaccagatctagccgggcacggtggctcacgcctgtaatcccagcactttgggagaccgaggcgggcggatcaatgaggtcaggagatcgagaccatcctggctaacactgtgaaaccccgtccctactaaaaatacaaaaaaattagccgggggtggtggtgggcgcctatagtcccagctactcgggaggctgaggcaggagaatggtgtgaactcaggaggcggagcttgcagtgagccaagattacgccactgcactccagtctgggtgacagagcgagactccgtctcaaaaaaaaaaaacaaaaaacagatctaccccgaaacaggaaggaatttcacagcgtaataatgagcaaaagaagccaaacaccaaacacagcagcatctaccctaggtaaccctgcttatgtgactgccaaaacaggcaaaactaatggatggggagagaggccttaaaagtggcctttgtgtgagtggggcttgggggtaaggtcttgactgaaagggcatagtggtaggggagcttttgggatgctgggcatcttttccatcttgatgtggtggtggttttacaggaatatgtgtatggagagagaaatatgcttgcgaaagcaagggtaataaagttggacacacattcatttttataaatcaatagaggcttttcccttgtattttataaaatcattcccttaccctgttgacagcattctctgtctgtgtaatttgaggccatctgataatttcctttctccagcgttttattatgaaaaatttcaagcagatagcaacattgaaagaattttcctggggacacccaccacctggattttttatcagtgaaaattttactgtatgtgctttgtcaaatatctgtctgtatgatcagtttgttgttgttgtcttttgagacggagtctctgttgcccaggctggagtgcagtggcgtgatcttggctcactgcaatctccacctttcaggttcaagagattctcctgcatcagactcccgagtagctgggattacaggcatgtgccaccacgcctggctaatttttgtatttttaatagagacggagtttcaccatgttgaccaggctggtctcgaactcctgacctcaagtgatccacccacctcagcctcccaaagtgctgggattataggcatgagccactgtgcccagcctagtttttttttttgtttgtttttttgtttttttttgtctatccatagagccagttgctaagctgtctgttggatcactccatgggttgattcacttactaggatttaggtaatcaaagcaggttagctagtcccaccttgtgagagcagaactagaagctgagctgtcagcctgagaatggtggcttggttttgctgtcttgtccttcctgtcattgtatttaaatcttctcaatgtttaagttttctctataacatttaagctgttgctaaactacaggaatgaaacataggtatatagaccaagcagaagcatagtttccctttttctgctgagtcctgactatttaggatgacaatgatatttgtttcctttaaattaacatgctttgaattaaattctgaatctgattccagggggcgatttgcactaccacctttcacaacacggtgtgttctctgagaaggagatgcggttttatgccactgaaatcattctgggtctggaacacatgcacaatcggtttgttgtctacagagatttgaaggtgaggacgattgacagactcattctgcatagtaggtattgtgtgaatggtcctctagaagtccccttctatttcatagagtcctgtcattttcctcatagccctcatctcagccctgatgaagtcattagctatatgacattttatctcctctagaccagactctgcggggacggagcgcatgtctgtccctgtcattattataaccctggtgcctactacagtgcctgctgcagcacgtatactaagccaaatatttagttgattagttaatgaaaagcaatttaggccaggtgcggtggctcatgcctgtaatcccagcactttgggaggccaaggagggcggatcacaaggtcaggagatcaaggccatcctggctaacacggtgaaaccccgtctctactaaaaatacaaaaaattagccgggcgtggtggcaggtgcctgtagtcccagctactcaggaggctgaggaaggagaacggagtgaacctgggaggcagagcttgcagtgagctgagattgcaccactgcactccagcctggacaacagagcaagactctgtctcaaaaaaaaaaaaaaaaaaaaagcagtttaggagcccttttggtgtcacccatttcatagttaattataattcagctaatgttcactaagcaactgatttggtcgtggctctgtaaagggctggaaatgtacaatgatggataagcaaagaacatatattttatggggcttagaagctggtgagctaagacatagaatggccgagtcataactcctccaaggcaaggtctatcagtgaatagtggatgccaaccagcctgcggaatttctctcaaaggccaccctcacagctttacattgttttgagattgccttaaaaatcactgatagagttttagatccttgcactgtgtaacctccaactgctgtgcccgagtttctgttcttgtcctctgtgagagctcactcaccttgaaagcaatgatataggagtattctgagtttttccattccagaacgcggtgcttggtcctgggttttacatgtgggaaggaggtagaagctggctcagggtgtccatggtgacactcacctagttgtatggccaacagcctgcaggcaggcatggagaaaaagggaccttgatgaattaatgattgcgcaaacatagaaatgcgtaaattgtaataagaaaaatgatgggactgacaatttgccaataggcgagaagattccaggagaatgtgtttgcctctcatttcagatgccttcttgaatgaacccacagtggccaactgaaatgtacagattatgttccttcctctagggagctgagatgctgtgattggcttttgaagattactttctaagatattataaaaattgtattttatttccaagaatttttttttttttttacaaaatactttgtgaattttaaacctttctgtaaggttacagaattattattattctcttagttttcctataagcataaagaagaaaaatgtatttttattgaattagaaataactagacaatagttggcccttgacattttatttccttatgcgagctttgcaaaagaacaaaacacatgctgacggcccatgaagcgctattgtaatacattctaatttaaatcagtaactggtttctaatcatctttatgctttatttttattttctaagctatttggaaggcagtggtattatttaatttctattcaaacttaattctagtcactcatgattattcatgcttcagttttctaatagcatgccatttatttttatttcaagcaaaacaatagttgatcgccagcagaaaaatattaagatgactataattcaatgtatatccgagagactaggtttgtttttcatgattatgatgactaaatctaatcttcatggatacatttcatcagagttgtggtcaaaattatatttggtcatttggtagggccctatgttaatgatgtactaataagcagaaatgacacttattgggattagtgtggcactatggaatattttgattgcttaggtcagtgttgatacattcttagaaacttcctgtctgtcctgtgcttcatggctttactcttagaaatccttgtggttctcagaagcccagaagctggtggactcacctcctgcccttgagaggcatgctgttgtggctgcgcaacagtccttggtacagtgaaaaggaaatgcttttaatgctgatgaactgttcccaacattcctgtgttacctgccccatgtttcattttctaatgagtagaatccttcgcctctgtcattaccactttgctgctgaagttaacatgaaagatattattctcagtatcatgccccactttgatgtgatgggctaaagctataatttgtgtttaggaacaaactatgataaaatagtgagatatcaggtgtctgcactcaaagttctcaaagcctgcatggcatttggggcactcttattaaagattattctctttctgtttagccagcaaatattctcttggatgaacatggacacgcaagaatatcagatcttggtcttgcctgcgatttttccaaaaagaagcctcatgcgagtgtgtaagtagtgcgtcaacttcagttcaccaccatttctctcctgccctttcaaaggcgtggccatttgtcaccccatttctcttaccagtggtgattttcaatatgtcaggaagatccaacatcacaggtcgtgggaaaggagataagaacaggatgccttcctcactgtctgcggagagcaggaattaacccacagtggagttgaacctgctcagggaccagggtggcctctcagaaacagtcaggacctcagcaaaaaatcagaatccatgctacctgtgtgaccctaaaagtcagtcagttacttagtctgttagtaatggtagtaataaacccctcaaagttgtcctaaggataagtgaaagagactgtgcctagaaaggcaccggggcagctgcgtggatgtggtcaagggaggtcctcggggccaagtttctgtcttcatctacttttccttctttttcaaaaaggcttttcttcttttttttttccctgaagagaaattaggaatatttctttctttcttttttaattaaagaaacaaatcatctgcttgcagtttaggctttcactgcaggccatattgttagacttgggtcttgcaccaggtcctctacgtgatcacccagagggaactcttgaggccacagctctcagccagcacctgacacctcggggacaccagactgcttctgggtgtggccctgcttgatcagtgcaagttggccctgacctgaggacttctctctgtactcggggttgttaaaaagacagcaggactagggcagttcccccggggctctgcagaaacaccatggaacgtgcactggttttcatttctgtttctttggtaggtgatgatctgggtggaaagtatgaacacatgtacagtttgtggaaaagcagacaacttttgctttattttgtctttttagatgtctcctccttagcactgaatcttttaaaattacattttattgacatcttaagctaacattcatctctgtgttgactggtcttgaaaaaaaactcccagtggtctcatttcatgcatctgtgcagaaaataaaccacagatccttctctttgtgtaactagaagtaaagtggttctgaactgcaatactttatgaaggactgcattaaatcaaaattgccttttaaagctctgatcaaatgttaatagtgaatagcaccgtttctgtaaacatatttctctttttctacagaatctgggatatggtgataaaagcattagcattttgctagcactttacaattattaggccagaacctgtggtcgtataagcgtctctcagggagttcatcagattcttttaagagagtcatttgaatttttaatgccacagttatttggtatgctaattttttcagtttagtatagtcataactaaatatgaatccaagagttcataagaaataatcttccagaggaattaactttcagatatggggttatttatttcctagcaggacctagtccactttttgctataattcacatgtcagctctgaacggtgggctgttcttttgcctgctctggatagtacaatatttgaacagcatctgtaaagaggtaggactgagaaggttggtttccatgtttaaataatgatcaggaggctactactttaaaaaggtaaacatacaacaaaattttatattttttatttttttgagacagggtcttgctctgtctccaaggctggagtacagtggtgtgatcacggctcactgcagcctccccctcccgggcccaagtgatcctcccacctcagcttcccaggtagctgggaccacagtcatgtgccccaacattcagctaatgtaaaaagaaatattttttaaagacggggtctcccaatgttacccaatctggtctctaactcccggactcaagcaaccctcccactttggcctcccaaagtgctgggattacaggtgtgagtcactgtgtcctgtcaaaatcctgtatttttaaataaaggaggcattttgtggctaggaataaaggctctggagccaacagatctgggtttgggttcttcttcctagttgtgtcagcctcattgtcccttctgtgaggaggagaggacaatgatatttatctcctgtgatagttgtgaggattaagttaactaaataattcagcaagtctttatttaacatttgctgtgtgccagctgctggcgatgccacggtaagacagagctgacctcagacctcctcgaacgagcagccctgagaactgtgtcccctaagtgaccagcatatggagtagtggcggtaccagcagcattcactgtgtcactcactgaatatccagctgttccaggcttgcatatgtcatcttcacggaaagcccatgtatttataggtgtcactatccaatttttgtggtatggaaattgaggttcagagaaagtaagtaacttgaaccaggtcacatggctggtatgccatggggctagaattataatccagttctgtctgattccaaagcctgtactctttacgctgtgtggatgaactccctgaggctttggcatgatctatttagtacaagacggaagatttttagccacaatttcaccctgaacttggtttctcagatcttttcaaagctgtagatgtgattcttagatttcttccagcggctggcccatctccaaagtagtattgtagttgaggtttttgatttgagcttagacttagtccatttaacgaaagaatcgcaaattattgtaaactagaagttaactgtgaagtagccatgaaaaaatcgcaggaaaacttttggagctgagcagattgtcagtgactaatttgagtactagcttattttatctaagaacacaaagctgtgtctcatgtcacagtgtcttaaaacgtccaagtgttcgttcagtattaatagtagtacagatctttagcagaatgcgtcaggaagcattagcagctgccttaggcagaatcagaaaacctcagcagcaggcagtccaaggttgagttttccttgtatgtggtaaaagcatggggggctggtctgcattcatttatcttatttatcctgtagatatctattgtagatatctttccattccagaactgtgacttgatcctgataagtacaggttacaaagtcacggaaaaggactttccaggcaaccctgaaattaaaccttcccggaaaatggcttggatgtccctcatagaaatctccaacgctctcacagcgtggcctgatgaccttaccctgtcaaactttaggttcgggctgattgagctttccagaatgctggatttgccctgatggaccaacgcccattttcactgttggataaaactctcaaatacacctcttagacagagagtaccagacccatgatgacccaggcttattagtgatccaggatcatttattctgagtagattctcactgttgctgagcataagcaagttaaaaattcttttttttttttttttttttttgagatggagtttcactcttgtcgcccaggctggagtgcaatggcaccatctcagctcaccataacctctgcctctgcctctgcctcccaagttcaagtgattctcctgcctcagcctcccgagtaactgggattacaggcatgcgccaccacgcctggctaattttgtatttttagtagagacggggtttctccacgttggtcaggctggtctcaaactcctgacctcaggtgatctgcctgccttggcctcccaaactgctgggattacaggcatgagtcagtgcacacggcctaaaaattcttacactaagataagcacagagatgcaaatccccaacacgaatccagtggctgctgtatgtggccccatgacgtttgtgcagtgctcacagcaaccctgagaggtagagatgtcatctgattacccattttactgatgaagaaaattaatcgtggatgaaaaggttgtagggcatacaaccttttgccagagccctgtcaggctgcatcttggaaagttccccaccggctgcctcgcatgcttcctgctgcagccgggcaagctcagcccttcaaggaggggtggagagtgctagagtgggaagggctttcgaattgcagatggtgcagattatatataaaatggttgtcctcctaagtgatttttctcaacttcctgaaaatcatcttcacatttgcttagtgctgagtccttttgaccttctgcagcttttgaaacctgacacgtgatttctccatcttatgtacaactgggctcatgttcctccttctttcccatccccctggggtctgttggtgaccatgaccaagccgatgcccctgtgagctcaggtcctcagcacaattggtggcaccacacaggggtggacgtctccatgccttcaaggtccacagcgccgcagcgtggtcgcctgttcatcatccgttcactcctccctttccctgcctcccctgaccccatgcacctccacatgagagctcctgaaacggcaggagaacctttgctcttcatagctggagtagagaaggactaatgagatcccgaacttgcattttacatatttatttcatacgcttatttatgttaattcatacatgagtgaaggcagaaaagatcgttttcccattggatgttcagtgcatcacgtttgcggtgaagcacaactgtcccctctcctttgtttacagtcgctgccatctaatgaaggacacccggaccttggggcgctgttagtgttttctaaagtgggcatgctctgataactgtgtatactttcttctccctagtggcacccatgggtacatggctcccgaggtgctgcagaaggggacggcctatgacagcagtgccgactggttctccctgggctgcatgcttttcaaacttctgagagggtgagttgaaatgcatccttctagtgctgtcctcatggcagcaggagcttggatgaaaactgagaatatgtagaaatgactagacgctaatgttattttaaatcacacagtgatctttaagccatgtgctaatctggaagactctgtcttagaagagtgaaagctgcttcccaataagctgctagataaaagcttatggcttcgtatttttattctgtaccatgtaggaatcagaattcttttaaacctaaaattagactgcttcgaatttttttctttgataagccacattgtaggaataagtattgttttgaaatgtaggtaatttaaaaaggtagaatgattttttccctagaaattaattattcatcatcttgagggtttacagattttgagagttacaaaaaaaggatgaaaacccaaagtaaacctattttattttattttgttttgtttttagacaagttctctctctgttgcctggctgcagtgtagtcacacagacatcacacacacaggctcactgtagcctcgacctcctgggctcaagcaatccttccacctcaacctcagtctcctgagtagctgggactacaggcacacaccatcacacccggctaattttttttttttttttttttgagacgtctcgctctgtctcccaggctggagtgcagtggcacatctctgctcactgcaagctccgcctcccgggttcacgccattctcctgcctcagcctcctgcgtagctgggactacaggcgcctgccaccacgccaggctaattttttgtattttttcagtagagacggggtttcatgatgttagccaggatggtctcgatctcctgactgggtgatccgcctgccttggcctcccaaagtgctgggattacaggtatgagccaccgcgtccggcctacacccagctaattttttaatgtttttagaggtgaggtcttgccatgttgcccaggctggtctcgaactcctggcctcaagccatcctcccacctcagcctcccaaagtgctgggattaaacgcctaagccaccacacctagccggtaaacccattttaaaaagcttgcgtttgttggggaaaatgctgaaattaatttgtcttttaaagctagtagtatacttggcccttgttctgaactaccaaagatgatgaaatagagtagaaaagattatgagaggaaagtactctcaaaatatgttctcatattaaacacttaacaattatgttaatgttgccattaattctaagacttttagccaattttaatggaaaacttcagttaaatttttttattattcagactcataaatcattttacattaaaatttcctagttaagattttccttttaatattttcatatgaacacagtcccgatagtttgctaaatgttgcacctttccatcggagagcctaactgagcaccactgcatcttactacatttagcacattctggagagaggctgaattctacattcccccaaaactaggttctgagcaccctctgtttcgtcaggactctgataatccagttgctctctactttgcattcacttgtgatctaaaattgtattattgcttagaaagtcgggttctgttattccttaattgaattattgtatttgtggagcctggatggctttaattcatgtcatcagactagctgacctaattagagagtttatctaagcaaaccagagaaagccatttcccctatgagatgctgttctccccagtggagtcgcttctatgcatatggagtgcatgaagacacccaggagatctttattttggatctctgctggagatgtggttggagacagacagtccctacctacagaatttggagatgataaaaagaaaactgtgcaacagctgaactgttgaatgtaaaaatcagcagtaaaatctgacaatcccagaagccttgtatttagggctttgtgtacttctttgttttgttactctagctgttaaaatggccatgcatataggctggggaggatttgctgtaacactgcttcattttttaaaagactagagggttttgttcaataactctgtctgctccaacagtgtggtttgtggctaataaaatgaattcagtcttatttggctgtaattcagctttggcatactgaactggaagatattaattcctttgtgaagtccttgattggccttgatggaagcattatgttcagtggggctcctgccgaaaagagtcttgacagacaggaagacatcctgaggatggccgtgaggctgggagggatggatgagataagtggagagtggtgaaatagctagaaatgatggcctccgtgggaagactgaaagagctgagtgcagaacttaggggagcgcatggttggctccagctgctggaaggccgtcttgttgaagggatcatatgcatgctgtgtaactccagagggatgcattttgaggagaaaaaagatttcagtttaatacaagaatgtccagtcatttgagctacccagtgaaggagggttctgcctcatggatagcaggctccttgtcactgtctggtgaccatcgattgagcctgaaatggaaggaatctttccagtgcttgatagataggattagatgaatctcccccactaggatttattatctcatgccattccttctattgtttgttcagaagtcactcacagataggatatagcactggagccaaagagcaggaaacatttttgacttaagtgatttaaattaaatgtgataagcatttactgcgtacctgcaatgtacaagagactgcttgatgctgtgggggaaggaaaggagtaaggaaggaaaaaaggagagggagggaggaagggaggaaggagagggagggaggagggaaggaagaaaggaggaaggagagggaggaaggaaggaaggaagaagggagagaggaagagagggagggagaaagaaagggaaggaggaagggagggaaggaaggaggaaggaagaagagggaagaaagggagaaaagggaaggaaggaagggagagaaagaaggaaggaaggaaggaagccaaccagccagccaggaagggagccacacaaaatctttgagggataggcagtctaggagagtagctattgatatacacaccggatcaggagctggctgagctgtgctaactttgacagtagcgatgtgctgcgagcacagacatggcagaaccaattctaacctggaagtgtagggttgacatcatgtgggagatggtctgtcgggtaggctttgaagataggtaggatgacaatacaaagcctgggagcaggggaaataccagctttctatgtttcttaagagggaaggagtgctgagggagaagtctcagatggttgggtcagcactgggaggacctcggatgcagtgctgggaagtttgacctttatcctccaggccccgaggctgaaagcttttcagcggagcagtggcagggttgggtggcttttcagtaagatgattctggaagcagcctggagcaatggaggaaccgagacaggaggcaggcagaagaatgtgagcaaaaggcagtgagtttgcgcagcagccctggaacctgacaggagcaaatgacatggcggcattgcagagttagcttctgtaacgcttcagtgttttcgtggagtgtgttttgtttttgtttttttatagatggttggatatggaaggatagaagttaaacatgctgcaatttagattcaagatgattgggagaataacgatgtcattactaaaatcagcgtctgtaaaatttcagtggttcacatgaaactgaagtgtacggagggcctttcaggagcaaaaccctgtggcgaggcgggcaggaggtgggactgtgtgcaggagccctcactgcctcagctgtgaacaaggggataatgccacctgttctacttcctcacaaagttgcatgtgggagaacctcaaaaatatgcctgtcagcctcctgtgcatttttcctgtgttgtatagaagggagcccctggcagctgtcttttctcaggcacacggggcctaagaaatcaactgagtggaggaggagattgactaggcagggtctctgaggcacaggcttgggcacagtcccctctgcatcctgacactcctggggcgcctgtcctcaaccctgggggacactgggcaatggctggaggcattcttggtcatcataacttgggaagtggctgctactggcatcccctaagtagaggccaaggatgctgctcaacatcctatgaggcacaggacagctcccgcaacaccccaacaaagaatcctttagccctaaatgtcaacagtgccgagggtgaggaccactgccccagagcaaatgcccctccctcctcccacagctgtgcagtgaggtggaatcaatggccaccaaggaagggtctttctattttcttttcttttcttttcttttctttttttttttttttttgagacgaagtctcgctctgtcgcccaggctggagtgcagtggtgcaatctcggctcactgcaacctctgcctcacggattcacgccattctcctgcctcagccttccaagtagctgggactacaggcgcccgccaccacgcccagctaattttttgtatttttagtagagacggggcatcactgtgttagccaggatggtcccgatctcctgatcccgtgatctgcccgcctcggcctcccaaagtgctgggattacaggcgtgagcccccgcgcccggccgctctgttttctgttttaatcctccttgctgtgaccagcgtgcccccttgcttctgctgaaacacctttctgcacacttcattttgtctttatcccctacaagaatactgcaaggcacttggagaaggagtctggatgggagaaagatgtcaaggcttcagaaggtgttttgcatccctggactcacagtgattgactgagccgctcatatgtgctatctttgagtgctggtcactacttctatttcagatgactttgtcagatacttaagagcgtctgtgtaggaagatgcatccatgttgcaaatctgtggagctgccatcatgatcttcacctagatttaagatgtctgttaaggaaatcaattgatgtgacagtggcctcgatcttaagcttgtcaccgttgattgtctccccgtggagttgtcagacatgagggagagcctgggcagtggcctagggagaactgagtgctgctggcgctattgagtttgttccaggaggggaaaaaggaaagtttataaatattttggcaactactggcttaggtttgaaatgcacatttaatataacatgccatcttttgggtattttattttattttatttgagacggcgtctcgctctattgcccaggctggagtgcagtagtgtgatcttggctcactgcaagctctgcctcacaggttcacaccattctcctgcctcagcctcccgagtagctgggactacaggctcccgccaccactcccggctaatttttgtatttttagtagagacgggtttcaccttgttagccgggatggtcttgatctcctgaccttgtgatccacctgcctcggcctcccaaagtgtgggattacaggcgtgacccaccgcgcccggcctcttttgggtattttgaaattaacttttgatgtgagagtttttaatcacataattttttgaacccattgtttgcccatgaaaatgatgtagagctaacttgggcaggatgtgtgttttcccatcatttataatgtcctgaacaattttccaactcatttaggggaaacgtgcagctgttccattctatctgtagttcagaaagctgcacttgaccacaggacatgtgaattcttttcccacaacgctccctgatgcagccagcatgttgcatgggaagagcttggccgtgccttgtaagctgttgacaggcctgttactgtctcctatttaaagcggctgcatcagggagcagctgcgatcacacaggatctgtgcacaccacgtgcctcactcagaatggagattattactatcataggttttctttaacgtttttcaaaatagaaaccaagtctttggctttgttcacaaagaataatcaagaatatattggaaacagatgtgcatcaagatttcaacttgaaagaccaaactgtctgaacatggcagcatagacttgaatagctgaagagcattttctgataatttctcattgagccggacatggaatcgctatatttataaatggaatttgtagcaatggggcccatgtgctggaaatggttttggcaccactaactttaactccaagtcccctcgcaagcctccctgtggtctcatgaaagactttttaaatttagcacagagcgcttgtgtcagaacacagcaggctgcaagtacatcgggaccagatgcaggagtggggtcctctggctttgcacgcaggagccaggtccgagggatttgtcaaaacaccaggagatcttcacttaatccctttttatacattaaggaacatcgtcgggtggaaacagctaagtgtcaagcagggagactaaggttttcataagatttgataaactttcattccttttctctgcaacctcaaacatgttaatatttctgtgcattttgtataaaagaatgatacaagtatgtttttaaaaattataaataacagatattgtttgcttttatatctgctttttaaatgtggtaattgtacattttttccttggaaataaggcaaaaagaatatttccaatcaaaatctgttttaaaagttaacaaatgcttgctgggtgctaatttaccttgttttgatcttttttttttttcccaaattaatgcttttaagagatggcaattagtttgtgtttcactgcatgatatggaaggaaataaaggactagagtgccctctcttgtacaaaaagaaaattaaagtgtttcagacaataaatggcctgaaatgtaataatctcaaaagatagttcaatgtataacctaattaattcagtaggatgaccagctcagtagcagtaagtagcagtgcaagataagtggcattttaattcttttttagaatctctgatttatgtgttcaacattctaatccattttatggagttaatattaaaatattttgcataatatcctgcctgcctcagattatgtcatatatgccttataaataaatttataagatgactactttgtaggcacatcttgttataagaaaagtcaatcatatgtgtccctttaattttcaaaatgaaaaataaaccatggtaatttagtttgcatatttaatagtgtcttttaatgataagatttcctttgaaagccagcttctccaaagtttttaaaacatgagagtgagaataatctgttttacatagttcaccaagtagacattcatttcataaagtaagagttatctttattaatttcaccagtggttactgtattaggtacctaccgtgtactgccattgtcttggctacttgcatagatgtcactttagtttttcccttcactgcttctgtgaagtatgcggcttgatccccgctttacagatgaagaattgatactgaaggtttctatgtggctgacagtcactaaaccaacaagtcacaacttgaacccagcttttctgactctggagtcgggttctgcacagggaaaacaggaagcgctcagagctgtggagaatctgctggtgcacggttagtttctgttttcatcaaagggatgtattacttaaaatgactggtttctaggggtgaatcatttcatctccttcatgttttggttcaactgctgttccttgggctgtttgagggaccaatatccatttttctgaaaaatgtacatgaaagttattgtttagctcgaactctcatatgacaaatgttatataaatgacttttattctcatgattacctgttggctagttatatattcttttctaatgatgtttccattggaacagcgtattttagggccacaagttcactgaagtgagattcaggcagttcaagtaagatacaagtcttgctatttcaggacctagcatttattcaccagttcttccatggaaatgataaatgtttacggcttttgcatttctccagttttgaatgaatagtgataggacatcatactttacccaaatattagtcagtgatatgttctatatcacctgatgccatattttgatagaacaattctttatttctacagtcacagccctttcagacaacataaaaccaaagacaagcatgaaattgaccgaatgacactcaccgtggtaaggggattcaaaactgtattcttgtctgtatggtaattgtcatgcttcattccgtcaataataaaaaaatgctattacataaaatgttataggaaatataaaattatgtatagacataataaaaatttgctttcttgaaacaaataaatgcagatacaatttctaaaagaatttctaggggaaacattaatggaaatagatgccaaggcaaaaatcaggatttactaacgaacagtatgaggaagctaaagaaaatcgagaacagaagtaaagaaatcaaagaaaaggagaaattactgagatgccaacgaatgagaatgccttccggttcttctgatctgcccccagcctcattgattttgcaactgattagttatcttttcatgtttctatagagtaaatattaattcataatgaggctgcaatttttaatactatgcttatcccagtaatagtctttaagtctggttgagtgttaggatgctgtttcatgaacggatttttgaaatcttactcgtcttttccccagaatgtggaacttccagacaccttctctcctgaactgaagtcccttttggagggcttgcttcagcgagacgttagcaagcggctgggctgtcacggaggcgggtaggccattgttcctgcctttcggtatctttaccagaagagcaaaatagtgattttaaatactgtctatcaaaagtcatccctagtcattaaaatcttccattttgacttgaaaggggaaaaaaataaatcacatgggaaatatacaaatattgtcctatgtgttttataattaagaagttgaagaagtcactcacttttttactttatttatttttgagatggagtcttgccctgtcacccaggctgtagtgcagtggcgtgatctcagctcactgcaacctccacctcctagggttcaagcaattctcctgcctcagcctcctgagtagctaggaccactggggtgtgctaccacgcctggctaatttttgcatttttagtagagacggggttttcctatgttggccaggctggtctcaaactcctgacctcaggtgatccacctgccttggcctctcaaagtgctgggattataggcgtgagccactgcggccagcccactttttaacttttaaagattgaccttgtagatgacagaagtgaattctgatattttgtagtccatttgttttttagtgatggttgtatttgtgattgtggcagtttaacattctgatcagtttctcacatatttctctcatgcataactgagtaactgcgatctaacacatgctcactattctcctgccccaaaacactctgaacagtaatatctggaaagcttatagagagggacttcagacagacctttttcctgtatctcttctcccccaggcttgcttggcataagaaataacttttaactgtatattacctatatgtatatcatacatatgtgtatgtatttttagtgtgcatattatacatataagcattttatgtagatagctaaataatgtacatatatatgagtatgtccttatcaatttgcaaaattacctattcctgctataatagatgaagatttagctcactcattactgtctctgtagccttcccttcctccacctctcaaaagttgaaacgctattttgagctcctcttttgctttcctctgtagctttaaattccatgcttaacccggtcttgcctttttccaactataaacagtatctgagttgaggattttgacattcctatctttcattgacttctgtctcatgttctttcatgttaatttttatttttacattatcaagatgatactgctttctattctgtgatcataatcaatcataatcaatctttgtgctttgcatataggttaatttcaaaagttgcaaatgaagaaggggtatttacactgttaaggaatcaaaaatgttgttcattacaaggcttttacttagcctggtaataaaccttaagttagtcatatatatacatatatagtatgatctctctctctctctctcaaaaaagaatatgatagttgtggactttgtttttccatgatgtttctttcgggaaggactcagcctgcagctgcaatgaaaaagaggtgctctatttctgctgattggcatcatctcacccaacacttccctttccagtcttctggactgaatctgccattcacttgattccctgcctcctgctatatttaggctagatatagaattctaaggaagtaataattttcccccagagctttgaaactcttactttattgtgtacaagcaagcagtcaatgcaggtcatggagctaggttaccactcgcgatggcagacaggtagcatcccttgtgctcggagactcgtgttcttcagcttggagaccaccctttatttatttgacatttatcctcctctgtttctcatagaactcttattagctggatgctgggattcctttctagatttgggcctctgcacttctgatcttgtatattacctgcatctttgctttaattctttgttttacttgccgatagcacaaattttcaaccctttcgttgatttctttctaaaaatctttagcaggtttaatttcttaaaagtagaacctttcaggggttttaccccatgttaaacaccttgctgcaggtgttctggagttgggtgtcagggaagaagtacggcgggtatgggtgtgcatttgtgtgcaagtgtgcagctcaatgcccaggcctgtgtctcatcccccagccacacacactgtggtgagctggagctcagcatgctggctccgtccccagggcagtagctctgccctgctttgctgtcagtcactgcccctgtgtcagcaccccctcttgtctgctgatggccctctctctctcgtggtggatttatttttttaatatttatttttactttttattttttatttttttgagattgagtctcgctctgttacccaggttggagtgcagtggcacaatcttggctcactgcaaactctgtctcccaggttcaagtgattctcctgcctcagcttcccgagtagctggggctacaggtgtgcaccaccacgcccagctaatgtttagtagagatggggtttccccatgttggccaggctggtctcgaactcctgatctcaagtgatctatgtgccttggcctcccaaagtgctgggattacaggcgtgagccaccatgtctggcctatttttgttttttaaaagtgatagtatctcactctgtcacccagactggagtgcaatggcatgatcatagctcactccagctccaaactcccggcccaagtaattctttggccccagcctcccaagtagctgagaccacaggcccacattaccatgcctggctaactttttttttttttatagagaaggggtcttgctatgctgcccagacaggtcttgaactcctggcctcaagtgatcttctcctcttagcccccaaagacctaggattacaggcatgggctaccatgcctgtctcctgtggtgggtttatatctctgtgttcctttcctgccattttagtggttattgagactgtgtgaagttgcatgctttcatgcaatcactggcttgaacaagaaaccttttttctggggcatttctaattgcttggatatatgcaagtaaacttcttatttagcttatcacatttaatgtgttgacaatgatgggtacaaaatggaacccaataagaaaatcaccgaagtgtttccagtaaaaatgcacaaggatatgctctgacttggatcccattctttcattcaatgtctgtttactgggcacacactgatgctaccccgtgaagtggctgaggcagtgcacatggtaggcatggcccctgccttcctgaagctcatgctatgggaaagccatggtgtagaattatcaagtaagacaggtccagatagtgagaagtacctgtgtggaggacgaggtgccaccttatgaagaggcctggggaggaacactccagctggaggagtcagcgagggaggacttccaggtagaatcagtgctcccgtgatccagcaaagccaggtctcctgggcactgggtttggttataaatgcgaagcaagactggagagttttgagcagaggagtggtgagttcattgaagaagatgacttgggcgctgtatgaagtgggatggggctgcaggtgggcaggactagaggtcagaggaggagacattagagtagttcaggcaagaggtaccaggaccctggtgcctcggtgtttctggcagtacgtctatcatcccttccctgcccacaaatgccagtagcatcctgagcaggaatcaccaccccggccaggcgcagtggctcacgcctgtaatcccagtactttgggaggccgaggtgggtggatcacaaggtcaggagtttgcgaccagcctgaccaacatggtgaaaccccatctctactaaatatacaataataataataataattagccgggtgtggtggcacgcacctgtattcccagctactcagaggctgaggcaggagaatcgcttgaacccaggaggcggaggttgcagtgagccgagatggcgccactgcactccagcctgggtgacaaaaaaaaagaaacaccacccctaagcgagagtctcgtgaggatgggaggtggtaggaagtagtcaggtctgggtctggccaaggggtggctgtgaagcctgagggaagacaggcatccaggaccatcctggctgggcctgtgcaggagcagtgcggagagggctgtgttagccctgcctgcatcctctgagtgggctggggagtaggagtgtcctggaacacagggcacaggttggtgcttgggctacagatttaggagtcctataagggcactcaagctctgggctgggcgagatgccccagggactgactacaggaggaccccaagaagcagccctgagctgtgtgacaggatgtggagagatagaaagtcagtggcatgtgctgggagtgctcctcccccatgcgggcttttccttggagtgtgcaattttttttttttttttcctggcaacagattctcactctgtcactcaggctggagtgcaatggcacaatctcggctcactgcaacctccacctcccgggttcaagcaaatctcctgcctcagcctcccgagtagctgagactacaggcgcctgccaccatgcccagctaattttttgtattttagtcgagacagggtttcattgtgttgcccagactggtctcgatctcctgaactcagacaatccacccaccttggcctcccaaagtgctaagattacaggtatgagccaccatgcctgaccaacttttgctctgggtactccaagttttaatcatgaccttcaagaaaacttgtttcttcaatttattttttatttttatttttattttttttttgagatggagtctcgctctgtcgcccaggctggagtccagtggcgcaatctcggttcactgcaagctccacctcccgggttcacgccgttctcctgcttcagccttccgagtagctgggattacaggcgcccgtcaccatgcccggctaattttttgtattttcggtagagaaggggtttcaccgtgttagccaggatggtcttgatctcctgacctcgtgatctgcccgcctcagcctcccaaagtgctgggattacaggcgtgagccaccacacccggctaatttttttgtatttttagtagagacgggatttcaccgtgttagccaggatgggtttcttcaatttataaagggttttggtatacattatattattagatctcttgtttgcttctgagtaaatgtggtgcttcacattcctgtcattttcctattacattatctattgcgatgtgtaaatatttgctgtaaatttctttaatgtgtagatatccaatttaattcttattttcagttatgttctcctgactatagaattattgtgtgtgtgtgtgtgtgcgtgtgtatatatatatctgtgaaaatttctaggttatcttaaactgtaataactatcccaaataaatgatcatatgggataatattcccaggcgctgcatgcagtattctaaacatcgtagcattcctcctgttgttttgaaggaagcatatttgtttgctttcttaaaggaaaaagtggaaatacttgctcccctgtattgttaacaggagacagttttgcacaatatttattacgtttccaaatgcatactcagcactgttatgactctttctcctccagctcacaggaagtaaaagagcacagctttttcaaaggtgttgactggcagcatgtctacttacaaaaggtactcactccctcttgactctacttacggtactgccgccccgcccttacccgctcatctctgtctcagtttctgtctctgtctctctatgcactgctggcttcctggctgtgtctccccagcatccccaccacccacctcccccagcatcctgtgtccacactctcttgttacccgagagttaccatgtagccagttccctttggggcatcctctcactcttcatttctctaatagaaacattttgaaaatatctcctatatcaactaataaaaggtaaaatggagctattatctagttaattcaaatgcacatataattgagccttttttagtttttgctcttcttcttgaattcttatctcaatgtgactgtatttttacatagatctctataaaatgtacgtgaaacttctgccataaacgtatgtatattttctagcccaatactacataatttaagaattagcatgattttatatcagcatgatttcctttccttattttaagcttcattatatttgcgttgatacaggaaacaccccaaattcaatttttagaaaaatgttgattatcagctttaaacttgctttgcgtgaactcaagctgcagagaaatgacgattttctgtagtaaagaaagactgatctgtcagtcctactgaattagagtccgacctctgggtcagttaacacataccttggagcgtttgcagatgtgccctgctccctccaggccccattgtctgttgtggctccggcaacccaaaggtggtgttgcgtcctctcagagaatgtgctttcttaagctgagctggacggatatgcagtcctgagattttgttatatttgaaaattattgaaggctttggacatgaatcctatttttctttaatttgtctaaaatatagggccttcctttggggctattgagtgcagtggcttttctacaaaatatgaaatgtgatttgttacaagtttgaatgacatgctgcgcagtggagcatgcggatatctcgcactgtgctgtctttgtagaatgttaggttgggacagggccatacgatcatctgaaaactgtaccatgcttgtttggatcttccagtacccaccacccttgattcctccccggggagaagtcaatgctgctgatgcctttgatattggctcatttgatgaagaggataccaaagggattaaggtacacatgtgatcatttatttctttatttttatttttggatgggatgatttctgttggaaatcaaacttagtggttgttttaatattgggctgtttatagtatttaacttacaaatgagtatcaacatatttgaagaatgtgtaagttaaggatctaaattaaaggctttgaaagctttcttcagactaataattttatttttgaggaactacatggtaaaatattattgatttggaatatttgtgattgaaataaaacttgaattatacctgaagcaggaaaaacagctgtgtgatatcaaacatacttccctagtgcaaaagagccagctgtctcaattcttctaagtttttagatctccccgtgttaggatgaaagagcaaacagcatgaatcattttgcatttgtcaatcaaaggtgaaataatcactgttttttttaatacaatcctctgcatttttcgaacttttgttcatatcgttattcccccaagtagagacaagacataattagagatggtgagtcatgagagaagatcattctgtttaagatgctgggtcaaagtgtatcactacatcaagctctcacctacccccatgctggcagcttgccccaggctctaccccctgcccccgggccttccctgtttcttctcagctgcccccatttacacccttctgacacaaacccgcgttgccttccccaccaagtagcttccttctccagaaggctgcagcactattaaaacacacacctgtgaggtgtaaataaaagagtgacaagtaaaatgcaagggcctagcaggagctataactggagacacgtaggactgggaccagctagactgtgggacagaaaagccagtaaatggctggaggaagatgggaggattgtggggaaggagagcagcatgtacacgccaagtgcacctggggaacccagtggcagctggtcagagctaggggccccaggagatgaggggctgggccatgatggtgattggggtgttcatgggaccagcttttctggtgttggaggttaggtgaaggcaaagtgcagagggcccaggtcacagggctgtgaggattgctgaccaactgagggacacccttctgtggtctggagcagtggctggggtcagcattgagaccgatgcctagacctgtgcacaaccaggcatcgtctgtagccggaaccattgatacctgtcaggtatatgagtatacagcagtgctttggggaacaatccatttacaaaggtatttaaaaaatttactgctgtcacaatagaattttttcacctgctgtataccactatctgtccgtcagagtactaaaaataaaacactattacgtgggtgcccacaaacattttttaatgttaaaaagagatgatcatacttaaaaatgttgtaaaccaagatctaggctttggagtcagacagactgggctgggatctgccactgagctgagtgaatgtgggccattctgcaacctctcgagtcttggctttctcacctgtaaagtgggtggtttcattgccaagctttctctgaggataaatgaggtggcctgctgaaggctacaggcatatagtcaatgcttgacaaactagtagcttctattattatgttttggttcttcctgagcaagagctgagaaagagcacacttagaacaagaagtcctgtctggtagggattcagctgtaaacaagaagcccaggtcctgctcccgtgagagctgagtccagcagggagggcaggggactgcattttaagaaactgtcttttaaaaacagcctaaataatacattttctttaaaagggtgggggaaaactcacctcatgtaaacataagttcttttttaaaaaaattcattttcagcaaggtgggctcagtcataaagatcaagtctttctgaaattataggcggtagaacagtgtctattaaacagagttggccatttcagaataactgcctgggcaaggagcatgctttgactctttgccagaccgttcagagcctgtccctgtgtgcctgatctcaggtgctcatcggaccttgaggttttcaacaccccatcactcacacacacactcacacacgcacctccagtcccattcagagcaactgaggggctcagctatgggcttagatagaatgtctgaagaaaacagaaagaggaaaaactctacaggtcaaagcgacctcagaatcaacagattattataatagatcaatgagactggatggagtaggccccatattggcatgtgggatgcagcttcttctggtgttctgttgatttgctaagggagtgtgtgcaagtgccttagcctccttggtctttcttgcccttctcagtattttgcctgttatgatacctacccctgcttatctttcaaggagtaagcaaatcaagtttctaaggaggtctgtgcttctaagacaagcatgtatttaccagcaggcttgctagtatttctgctataaaaatgtagttcacatgcagaaaaccattttctttgctcatattcaaaatgcagccttacctagagggcagaaagaagaattttgaataatcgtttagaagaaaaatgctaccattaagtataatttttgttccagcagctcttaaaggctccattgcctgaactccccatatgtcttgagatttcttatacatatgattatgatgtcaaactgtaaatagttggaaggttcatggaattaataggaagctcagcttcatttaccttttgtttttctaacttttcagattaattgagggtaggttcaaaagccctcttggcttctcccttataactgtttctgaaactatagaaacagttttcctacctatataaacaaaatatccttaccataattgaaattttactttgttgtcagaatctcagtacttcaagtaaaattctgtatatgtgagttttcgttggcaaaacatgtcatgaagatagtatacaagattgggttgattgtagctgatccaggactgaaagtgaagtgctcatcagttctgtttgtggatgatgattgcttgagttgtcattagcagagatttatgataactaagaacctgcctcgaaatgattactgctgccatctagtcatcttcctatatagagttatgatagagtcaccatggatgtggcgccgcggactcttacctttgtaagtatgttaaatcataaatatcttgatttcttaaaataatcagctacttgattgcgaccaagaactctacaagaacttccctttggtcatctctgaacgctggcagcaagaagtaacggaaacagtttatgaagcagtaaatgcagacacagataaaatcgaggccaggaagagagctaaaaataagcaacttggccacgaagaaggtaaaatagctcacgtgtctcaaaacatttctaatgcagtaaattttcaaaatttcttgtaaagctgaaaaagtatttgggtcgtaaggtattttgcagtcgagaagaaagcaatgccataaatcgctttagtttgctctggcttggaagagctcagtctaatatttcaaagtcttcaggcagcacacaaataagtctatggagacaggtggccgggtttctttagtatgcccttttatcttggagtgcttggggactggtttggacgttttttccttccagattgagtatgacagtgtctggagtggggttggtgtcattggtgtgtgccctgtgcggtcatctgggcacctgactcagtttagtcctctgttgtcatcaccttgagactcttagtcatttttgaacaaggggcctgccttttcattttgcactggggcccgagaagtatgtagctggtcctggcgaggaacttagcacgacatgtcacttgtcaagagaggtaaatgtctcccattcaagtactaaccaggcccaaccctgcttagcttccaagatcagatgacatcgggtgtgttaagggttgtatggccatagacaaaagagttaaatatataaagacatttatattacaaacagcattttaaaaattgccaaatcaggccaggtgcagtggctcatgtctgtaatcccagcacctcgggaggccgaggcaggaggatcacttgagtccagaagtccaagaccagcctgggcaacatggtgaaaccccatctctacaaaaaataagaattagccaggtgtggtggcatgcacctgtagtcccagggactggggggccgagacaggaagatcacttgagaccaggaggtcgtctgcagtgagctgagattgtgccactgcactctagcctgggtgacacagcgagaagctgtctcaaaaaaaaaaaaattgccaaactgtatttttatgtaaataattcaatgccctactaaacataacatcaagtaggaaacataagttttaaataaatcagtcattctcatttcactgaatatggttactcttgatttttctaagatttcatgaattgtggataattaaatttattgtagtcgatgattatgttaagatgtaatttcatcttccctctgagcaaagacccttgcaaggttaaccttatgtaacaagaatggccagaaactctttcactctattaataggttactttggtagcagcatcttggtataggattccttggtcttatctgatgattttcctgtggcatttaaagtgtcttcaattctggatgacttactctttatataaacgttgccagaatacaccaagggaatcctgcattcttttaactctgtttacctcaattctgcagggacacatagcctttatttgtaagctcttctttttttttctagatggagtctcacactgtcacccaggttggagtgcagtggcgcgatctcggctcactgcaacctccgcctcccaggttcaagtgattctcctgcctcagcctcccaagcagctgggattacaggcgcccaccaccacgcctggctatttttttttgtatttttagtagagatgggatttcactatgttggccaggctggtcttgaactcctgacctcatgatccgcctgccttggcctcccaaagtgctgggattacaggcgtgagccactgcgcccggccataagctcttctttagagaaccggtccattgtgatcacactggggtgtgtttgccacagcagattttacacaggaaattgaatcaatgtcgacttgctcaagggggggtcatggtgtcactagaatcctgattaattggatccacaactatatatagatcttcataagcatgttcaagtgtatccttctagttagagctgtaattagaaagtttagcaaatcaatgaatttatcttcctgtgttagtaagtaattcgtgcataagtaggtcttggctgacaatctcagaggtcacctttatagaaaaatatagtctaggcttagattcctgaaaaaaaaaaattataataaagttggtcctccacatctcaggttctgcatctgtggattcgaccaaccatgatcaaaaatatctggagaaaaccaataagaataacaatacaacaataaaaaataatgcaaataaaagccatacagcaggggttcccaacccccagtggggaggccagttaggaaccgggctgcacagcaggagatcagtgctgggcgagtgagcatcaccacctgagctccgcctcctgtcagatcagcagtggcctgagattctcgtaggattgcaaaccctatcatgaactgcgcacgtgagggatctaggttacgtgctccttatgagaatcgaatgcttgatctgaagtagcacagtttgaacccaaaaccattcccccatccccgtctgtggaaaaattgtcttccactaaactggtccccggtgccaagaaggttcgggaccactgctacacagtgtaacaactatttatgtagcatttacactgtattaggtattataggtaaactagaggtgatttaaagtttgtaggaggatatatgtaggttctatgcaaacaccatgccattttatattgatgacttgaacatctactgatttcggtgtctgctggggtcctggaacctaccccttgtggctaccaagggatgactgtgctcgtattttaaacagatttcggaaatgcaagcacttctcagtgaaaaggacgactccatccttccccatcaccactgaccctccctggccctccctctcctttgttctttacctgcttgtctccagatgacttgacatgggttttacgtgtttacttatggtctgaaacactcactagattgtaagctctctgaagcaggggtttttgtctcttgttctctgctgaacccagaatatctggaacatgcccagcacctgggcattcacgtgccacttgttgaagaaatgagtgtgtgactgaatgactttaggacaatcaccaaagcctttaatacagactttaaaattaaccttttctttttttaaggacacagtccttcactgtaaaaatgtaatcaggactcaacaatgtctgtgaattatctctatacataaccatatatttgaggaataaacctaacattaagctgaggaaggaaccatttttgatccttatgttaccttaaattacttagacaagaaaattcccactattattatttttaagataaaagggagattaaagggggaatcccaaccccacgtaaaggcgaaggtactttggggatagcttgactttaaataccgtctattctccggttctcattacacataatgaaaagagtttggaaactaacttttgccctcccagagcaataaatgaacatcatggatttatcagcatattgagaagcaatcatttactgtgtgagcagagagagctgcagaaccctctgatctttagatccccagtacacatgcacttaaaactaaaatcgtgacttctgtaatgcgttctatttatagaaacctgctttttccaaaaagcatgtctgttcttttttcagagaataatgctgctaagacattttgtttcagagcctatttaactcctagtgattttgtattcctcagattacgctctggggaaggactgtattatgcacgggtacatgctgaaactgggaaacccatttctgactcagtggcagcgtcgctatttttacctctttccaaatagacttgaatggagaggagagggagagtcccgggtaagtctaaggcagcctcaccgagcatgtttcccagtacgtacaatggcatatggttatttcatgttgctgacatgttttatacactatcctccgaaactctgtgattctattttactgctctacatgagattgtaatgtgcaaactttaacttgtttttaaacttccaagtcaaggaacaacttggtaatacctgaaaatagaacatgctttttagtgaggtcagaagcaccacatcatcagatggatttgaagaaggctggagagcagttagacagatctaaaaagaaaagacaagctggactttgaagtcagacagaggtgttcagctccactgctgagtgtctctgggactttgaacacgtcacattgactctctcagcctccgttttctcatctgtgaaatgagggaaatagaaatcataacaactgcagtcagccctccatatccacagatccccatcctgggattcaaacaaccaaggagagaaaatatgcgggaaaaagaaatttaaaataacaacaaaacaataaaaactaatacagaaaaaaaacaacacagtctaacgactgtttacatagcatttacgttagaggtgatttagagtatacaggaggatgtgtgaaggttatatgcaaatacgataccattttatatcagcaacttgagcatctgtggattttgtataatttggacctgggcagattatacatttattatgctactcaggggttcctggaaccagtcccctgtggatactaagggatgactgtactgtaatttttgcatgtttatctgaggtcaagtgctgttaaaaaaaaaaaaaactccatgtgtttgggaacctttgagggtccaactctcattttataaagaggaaagcaggcttagaagaggaaagtctgccacccaaaaacacaactggacagttaggaggtggaagggtgactcagaccaggtcatcctgtgccctcagtctctccattgtacggcctctcctagttgggtcaaataaaatgtcccaggccatgacacttggcacagagatgaggtcaccaaaagatgcttccttgtgtctccaccttgttgagaatttgtaggtggatcatacaacagacagcaagatgtagctgccctctaagatcctttcgagagctaatgtttgtgaacaagataaaaagaaatttctgatccgcactacctttcagcaaatcaggcagcatttattaagtgcctactgggtgaagagcccagggcttgtcaacaaggaaggagccaaccctggtggaaggcatcttttcttttcttggtggggtggggggggggcctggtgagtcatcgtaagcaggacgatggtcccaaacactcaaaacattgtttatgtgttggatatgttggaataccacccatctgttctccagagatcagaagtgtggaaaacagggcacctaaatctcatgtatttgactttggactgtatttttagtttactgttagcaaagttttcattcaattatgaatgattacaattgcatatcactccatttctttgaaaagaaagaagatcttcccaaccatcactcctgccatcgaagttatttttgaaaaattagaatctaggatctaagttccaattaataagatccttttggggacctgaagtgtaactcagggctgggaagcatcagagtagctccccaaagctcactgtatttccaggtaatgagcggacctgggcagattatacatttattatgctacccactggcatgttaaaaggaaatcaccccacttttcaggctgtttgaaaacttaaaaaaacaaaacttttacctttgtttaacattggatgcaataaatgagcttggttttaaaaggttcaacatttagtgttctatttaagaagctacataatatgcatgagcagatttgtaagtctaagtaaggaaaaagaaaacctgagtgtttatcagagtgccatttctcattcaggattcctgaagtatttatttaaaacaaaaaccgtaagacgctaaggaactcatgacactatagcattcactttaaggaataatactatagactttttttttttttttttttttttttttgagacagagtcttgctctgtcgcccaggctggagtgcagtggcgcgatcttggctcactgcaacctccacctcctgcgttcaagcgattctcctgcctcagcctcccgagtagctgggactacaggagcccgctaccacgcccggctaatttttgtatttttagtagagacggggtttcaccatcttggccaggttggtctcgagctcttgacctcgtgatgcacccgcctcggcctcccaaagtgctgggattacaggcatgagccaccgcgcccagcctatagaccttttaatcttttaatgaaaccacctctatttatgacatcattgggatactatcaaaatattgttagcttacaagctgacatcagtaaacatttactgagttgctgccttaaaactgaaccacacacctttggctcacataaatcatatgtggctctgttgcttcctcacaatgttattgacagaatgtatatgagtgtgccatacagcaagtaggcttgcgattcatcatcattcaaaatcagttctgtgttgagggaacagctttgccgtttttccctagcaaaacattgctttctctgcagttttccttgaaacattataatttgaacttttgtttgtgttcctttatagccattttccccttacttctagaataccatcaaagaaagaaaaccgaatgtgttttctttttttacttgttctaacttggtagtttttggtattactacttaagaaatcacaaaataatttgaattttaaatttctgtttttatggttagcaaaatttactgacaatggaacagattctctctgtggaagaaactcaaattaaagacaaaaaatgcattttgttcagaataaaaggagggaaacaatttgtcttgcaatgtgaggtgagtttttattttttcttaggtgaatgttagaataattaaatattcagcaaagttgactgcctgtctataaaacattttcttatgccatgttttatcacttacaaacttagtaagaaagccccaaggtacaaggttttcagcaaattcatcgtgattttttaaaaaggcaaatattagaaaatggcaggaggatgcaggtgaaataatgtcattactctatctggaaaatctgctcagtatttaatagggctggaattttatttgttctataactttgaagatttttcggcatgttcgatgttaaggtttatatatttagataaatataagacggcaaactgaaatgccatcttctctaaacgaaaatgccatcttttcctcaaagttacattgtaacacaaatttcattcctggacactttgtgactggttcactagtgtgtgtgttttaagagagcatatttagagaaataaacacgtattagatgcaaaaaaatcatttttactaacatcagtactacattacatacatgaatatatatttaaaacattttttaatttgtcaaaactccttcccctatattattatagatttcagttgttttagaaatcaaaagtaatctctaaacaaattaaaggcagtgattctcagagtgggattgtactggaatcatctgaagggttttaatgtggcctttccctgctcttttcaagagattctggagaaggtggcagcgtgacccatcagctagtaatgccactgggggtggacacgtagggtgtgcttccttcaggggttccagggacgctggtaatcaataggggcagcctccgctgttggcaaaatgggtgagcctgtcacaacggctgcctttgtattccccctcagagtgatccagagtttgtgcagtggaagaaagagttgaacgaaaccttcaaggaggcccagcggctattgcgtcgtgccccgaagttcctcaacaaacctcggtcaggtactgtggagctcccaaagccatccctctgtcacagaaacagcaacggcctctagcacccagaaacagggagggtcctcgaggaggacacaccagggtctcagccttttggggtgaacgaggatgaggcatctgatctattcgctaccgggactcctccaggctcccgagaggagtcgggacccttcggcttggggtcagctcagctccctgccttgtcacatttgtctgcattagaaactactgaagaaataaaagttctttttctttgctacacactttggtacctatgaacctagaacttgaagtgactcctacttatcacgtaaatttttatgtctgatatcaaacacatcttagactccccagaatggaatttaaagatgttcagtgttgggtaacagattgccctaagcattgccacatattctgtctagtcactgctgattttctatgtctttgctccatactgctgggggatgggagagccacagtgtgtttcttttgtgcacttcgcaactgacttcttgtcctggggttaaaagttgaagatattttctgatgatattaaaagttgaagatatttctgcacttgggccctcctctgggagccgcacccacatgactgccctgcctctgaccagtctgttccggggccccctcagccaggtgggaatgacggacacgtactatccaagtgtatgggattaactaatcattgaaggcattcatccgtccatcattggaaagatttacagtgattctgaaggacaggccgtggagttttaggtttcaggggcaagagcagttttcaaaagtctttgagtccagtgtgcacgagtcgacaagcagtacctggcatgcaggagcactcatgggtgagtccgtctcaggtctcgacaattagcagttgtgtgacagtcattctggttccttctgcctgaccctgggagacatatcagtaatggatgtacaaaagcaggtctgttttatgtcttagtataatttcagatgaattgtattgaaaaaatgctgaggaatgaatgtgtcaaaatgggttaactgtgtatattgactttcatgtcgtcatgcatctgtcatgaatgaatgatactttgcactgggctgtacgacagtgaggaccttagggcatgaagcctttttcctggtcccagcagcatctgccctgtgaagtttgttttctcccactgcctccaggccccactgatacccccaaatagatgctgggttatgagaaccagcgaaatcccccatgtcatcagtcttaaaaaaaaaattttacaaatccacgtatttgtcccattcttggagtagttttagtgtatgtctttacattaactactaacagtataaataacttgacatcgtaattgtctgcatcctgtccttgatatttttagcagttccaaatctttgtttttgtatttgtttgctgtgttcatgggcaaagtaagtactttttaatgcagttattttgagagtttggaagataattaccaaaagggtccattatttcataagagttactttgcaaaaaaaaaaatgtgggtttttttttttgtctatctcaactactagttggggtttaaattaacatacattttctactatctgttatttccagtgtgggaggagggatgtactacttacatgcattctccttatttaaaaaggaagaatagtattcaaattctgttgaaacacacacacacacacacacacacacacacacacactccagaagcagaaaagccattgttcttaaagagtgaatgtcttcccagccctggttaattatagctgtgactgatgccgttcccgtctgcatctcaagctcataggttctcagcatgtgcagttgaggatgcgctgggcctcatgcctgttctagatctccaggataaagggcctgctgttgactccaccagggtctgggcttagcgtctaatatctcgtacctagggcgtgagctgcacaaacgtgttcagaaagattattcaactttcccatacttgttctaaaattgagctgatccgcatctctttcaaaaactagaatttctgctctaagaatagaacataaggctccactcccttttagaaaagatatatgaattggaaaatgctctgaaagtccttttgcttcaaacaaaagtgtaaacttttacacttccccaactcacatttgatttgtaatgatatggttgagaagtacatctagatgtcatttattaaaagtgctttgtaagactagattgagctgtttctgagggcggtcaccagttgtgttggggtctggtttgagtgccttctgccaaaatgttgtgatggaggtgtttctgcgaccagacacaggataccgctgtgtctgcacccggttgcctgcatggccagaggaaaagtcagttggattaaacatcatggtatacttggctgttgtttttttttaattttttaattttttgggatagggcctcgctctgtcacccaggctggagaacagtgggatgatcatggctcactgcagccttgaattcctaggttcaagcaatcctcccacgtcagcctcctgagtagctaggactacaggtgcatgccacctttcctggctaatttattttttgggtagagatggggtcttgaactcttaggctcaagtgatcctccttccttggcctcccaaaatgctggaattagagatgtaagccaccatgcccagccatagtacttggatgttttagaaggttttccaagtattacataattcctagatgttcacccttattacactccaactattaaaaaggtcaaaattcagcctattttttttcattattttagattcctgtggttgggatattttaacattgatgagaaaaataattgaggttgatatttttacaaaatcatgcggtaataagtcttgatttcatgattcaaaagaatcaataaagcctaaaaataatagattactttaagctgctatgtaagatatatatggaataaattaaaaacctttgtgaattcaggtttattatttttaacctaaaacattctctttggttcattcatcccctcatgtcatgggggctcattggttttccttctttgtcatatttaagtatgatttttcaacaaaacttctagaagtcagcttattatgtcaccattcatgcaaagtgctcatgcctctgattggtccattcactgacgtgacaatttcaggtcctatgtttaaaaagaaggggctggccgggcacgatggctcacgcctataatcccagcactttgggaggccgagaggggcggttcacgaggtcaggagattgagaccatcctggttagcagagtgaaaccccgtctctactaaaaatacaaataaaaattagccgggcgtggtggcgggcgcctgtagtcccagctacttgggaggctgaggcaggagaatggcatgaacccgggaggcagagcttgcagtgagccgagattgcgccactgcactccagcctgggcgacagagcgagactctgtctca

SEQ ID NO: 16516 - DNA, 31199 bp, Human
atctgctcggggcaccttccacggtgtgggaggtttgttctttcgctttttgggaccacgtcgtctttatgagctgtaacactcaccgcaaaggtctgcagctttactcctgaagccagcgagaccacgagcccgccgggaggaaggaacaactccagatgcgtcgccttaagagctgtaacactcactgcccgaaggtctgcagcttcgcttctgagccagcgaggccataaaccaccagaaggaagaaactccaaacacatcttaacatcagaaggaacagactccggatgcgctgcttttaagaactgtaacactcaccgcgaggctccgcagcttcattcttgaagtcagtgagaccaagaacccaccaattccggacacaacatcacctctgtcagcttcattttccatatctataaaatggagataatcacaatacctatcttttagggctggtctggaaactacaggagatggagcatctaaagcgcttagcatagggtgatgctcaaaagagctattattaccatcatcgtctagactagaggttctcagtcttggctgcatcttagaatcacctggggagcttttaaaaaatattaatttcctcttttctagcccaggcgtactaaatcagaatctctaagggtgcagtgtaaacatcacagtttttaaaaagctgcccaggattccaaatgatctacagccttggtacttaactctggttcacggcccagcaacctctgctgggaatttggtagaaatgtggatttttaggcccatcgtagacctactgaatctgcattttataaaaagataccccagatcctaaacctccttaagaaggtcaaggcacgcagaccacactgagtagtgaaggagagaatccagggtagctacataacctcacgaaatcccttccttgtgatctgtcttttccttcacttccttcttcagatgctcctaaaagtaggggttgggaggaaacaaccaactgaaatatttggagtgggcgtgtgtgagtaataagaatcccttaacatttctacagacagttctattagtaagagtagttcacgtatgatttcacttgaccctaattaggaacagccctggcatcattttccccaccatgcagcaggaaactgaggcccaaagagccccgaggtgggctcagggtaccccagtgggcaaacagggagaggccagggcgggaaacccgcggccgacctcgccttgttcggaggcagcgttagagcagcttctcggaggttggccttggacgtgaattggaagcaatcagaatcttttagatgtttatacatgataaatgcaataattaattcacaagagaaaacagctagctaccttgcactagccctagttgcggattgattgactgatttgagatggagtttcgctcttgttgtccagactggagtgcaatggcatggtctcggctcactgcaacctccacctcctgggttcaagcgattctcctgccttagcctcccaagcagctgggattacaggcacccgccaccatgcccggctaatttttgtatttttagtactgacggggggacgggggggcgggggggcggggggacggggggcggggggggcggggggggcggggggacgggggcggggggcgggggggggcggcgcgggggggcggggggggcggggggcggggcggttcacgatgttggccagacttgtcttgaactcctgaccccaggtgatcagcccgcctcggcctcccaaagtgctgggattacaggcgtgagccaccgcgcctggccagttgcggatttataaaagcagtcgcttagtaacttgcagcggctacatcaactttggaccaattcgcaaactgctggtgtaaagcgtttttgcgcatgtgctgtcgccttgcgggaaaaggagcctttttcttcgacgatttccgggcgacgcaggaagtggctccagggcgcacgcgcgttgtttccgcggtagtcagggcagtttctaccgcaggcttaaggaggcttcgggctcctgggatttctgtccgcgctcctggccctcgtccttcgcgccagagcaggttcgcaaactcctcagacccttctgctcccggccgccgctttccgccggggcgagacccccaggtaggccccgtgccgcgcgcgtcccgtcgttaaccgccgccatggctcccgcagaggccgagttgcctcccgggagcgcgcttctgcgggatgctggggcgcgagcgggactgttgactaagcttcgttactgggccctggaagcgaggtcagagctggaaatggccttaggggtcacctagggcctaatccatcgtttctcttgtgggggaactgagcctctgggaagggtcacattgcgttaatgcagtgtgtgtcgcctctgtccctcccccttacacgtctggcgtctcgtcagatacatgtcagctcctgggagaagctttccctggccgctttgcagaagggcgtccccttttagcctcttccacgtcaacctgctccatttctttcgtagcagttaccagtctctgaaactaagtctgtttctgtcttagcccgccaagtatttattgtatacgtatataggtgccaccgtacaggcagtacttctccaggcaagtagtattaaacaccagccgccctgggccaggcattgtactgtgggacccagtatgcattaagggaagaatccaggcaagtggctgccctcttggagccagcattctgggggggaagagattttgagtgtaaacaagaaattccaggggatgtgatggaagattagatatgttaaagttggcaaagaagcgtctgaggaggtgactttaaaaaagaatacgtgtgacagctttattgaagtataacttaaataacattaatttcaaccattgaaagtgtatattgtgagtttggaaattttatgcagttgcgtaaacatggcaagttcaaatttgggacattttcatcaccccaagaagttcggaggaggcaacttttgaactgggatatgaagattcaaacggaggtagctgtggggagggagaagcaaatcatcccaagctgaaggaacagcactaggtttgctccaaggcagggatgagcttgttgtgttcaggggagaaaggaagccagcagagctaggagggctggggtgcagcaaggcgggagagagcgggaagagattaggtgggtcccacagatgactgtgccttctgaactttggaagcttcccagtgctcagcataaggtgtggtccacactgactaacacgaacgattctcacctaccatgttctttttcctaagttcatccctaatggcagaaatgttctctcccaacttgaaggttgaggtagaggaatagagtgaaagtaatatttattaagaacctgtagtgctttaggcagtgtgtgtgtgtggcttcatttagttctcataactctgtgaagtagatattagtgtctctgttttacagatgagaaaatcaaggttaagtgacccgtccaaagccgtgtaaccagcacctggactgattgcagaagccttgtcatgcctttgttcgttcatacagccaactggtgtttcaagtacctctgcatttgagggcagaagtgtggccggcaaggaccacatcccctcacgttcactaaaatgtacatgtgcttgtagctgttgctctgaccttttgttctgcacttatttttcatgaagctgaggaaactcaaatgccttccccaaattccttgcagtttctccgttctgtgttgtcttgttagcaaggatgtcactcagccatttggctccctttggagaggtgactggtatggaggacttttcagcgtaacaggtagtaggattgaaatgtggtttcagtgtacgtaactcctcggggagttggaaggaaaaaagaagggaaaagtcgtttattgtacccactatgaactagatactgcattttctacataatctgatttgatccccagagcagccctggagaatgtgttaatgttctctatgtttgcagagcaggaaaatgaagactggtgagattagagtcccaactcctgagtggcaagaggccctgaccaaaccctggtgggcctgttagattatgatattcaagaaaaaacccagggtgggagaggttcttgctgggtaaatgtccaaaacacgatgcccgacctttttaaaacttttacgaagaaattgctgattcgcttcccggactggttgttctaggtagtttcatgcggatgctgacctaaactagaatgtagaaattagtaggaaagtgaatgcccactaggtggaaacctgaaagcacggggacctgcgatcttgtttactgttatattcctgctgcgcagctcagggtctctatgtaaaaaatgagtgaatttattttctagctggtgcctacaaaataatctgcaatgtatccatactggtttattaatggtaacaaatgaaccgtactaatatgagataataggggaaactagatatggagtgtatgggaattctatctttactatttctggaaacctaaaactactctaaaatagaaggtttatgttttgaaagcactctgctcattgcgctcttgtctgaaaagtgaagcctggcctcaagccactttgagtatttctcttctgccagttaattatcttaccattgcctctcagtgatattaagagaaaacccatccttaacatttttcattactttttaggttcaaaatgagcctgtttggaacaacctcaggttttggaaccagtgggaccagcatgtttggcagtgcaactacagacaatcacaatcccatgaaggtaccacgaaaagcttcctggggcttgtaggaagagtttgggcagagtttctcccatcaaggacagaacccgagatgacttgggagcctcctttaggctgaaagctttgaaactttgtctaactcatgtttctgaaacactggagcacagaaaatgtgtccccgtacttgtgtcctgttcttcctggcctgccaggtctccagaatcacccaaggtgcagattccggtgcagattcccagggcctggcccagccaggactgttgactcagaattcccatggttggagagaggggatggcaggtgaaaactgtgatctagcactgtggggccagagtgaactggtcatttagaaaacaagaccatgggcatttcattagcagctgctactgctagtcctggtggtgctggtactttctctagcttattttttactcctgtctttgatcaaagtaaggaaaggtctaattcagttagttcttgtacacaaggaaaggccaccgtgaggtaattagtgagaaagaaaacaatttggaatgaagttgtgagcgtgcatacattttaacattgacttttttcccgcaggatattgaagtaacatcatctcctgatgatagcattggttgtctgtcttttagcccaccaaccttgccggggaactttcttattgcaggatcatgggctaatgatgtaagtgctccttaaatacgtgttctagaaatcatctctctttgtatggccaaggttagctttagctccgttgtttcccaagtaaatgaatcagttggacttatttatggccttttttgagaaatcaatttagggggtgtgaacccttctgaatggcagacattattcttacacccgtttttgttaggaaagcacaatcatatgtgttgctcgaaattttctactttagttcagtctcttgaagtttattcccaaatcaaatatcatattcatccagagtgaacattatacccagtggcacacaccaacaaattccctttcttggcatcctgacagtgttcctcaggcatgtatgaaactttttcaacattaaataatagcacagatttgcctagatacttactcatcatgtacaaaaagaaagacaaaaaaattacagtttactaaaagaaagaaaactctggtagaaaaataagcaaagggtgtaaagagggacttcacaaaagaaagaataaacctgaaccattcatccatgcttgtaatcagataaatgcaaatttaagacttttttttattaaattaacaaaattaaaagtttaaaagaataatagtgccagcaaggataagctgaaaccctgcatgtatggctggtaggtatgtaagttggcttttccacaggataattggcaatagttatcaaaaatccttcagcttataccctttatctcactgatacccttctgggacttgagtaggaaatctgataatgtacttcatctgcattatctaaattaacctttataacagccaaagcactgtgaacttgtgaaaattttgaaaattttaatatccagtagtaatggcaatgtatagtatgtttgtatgatggaataccattgtaagtttttggaaaagcttttgaactgtagcctacagcacaggggcagcaggggttaggagaacaggagggaggatggtagtcaaggttgagcaagcttgctttctacatgtaatttttagaaagatttcagattatttgctgcttaaaaaaaggatgtttcaagttgaacaggctagtgatgcaggtgaggaaagctgtagctgcaaaagtgaagacactgtataatctagtgtcttccagaaaatatgcgtacatggaaagaagactaagagcacacagaaccattagctgtggttgtctgtggtgtgattagggtgatttttatttttttgccatatttacaaaatctctaaaatgtattacttttttaacggaggggagattatataaagtattcagaaaagaggtaagtttctactttggtcttgattctctgaatggtaatgggtaagtgatattctactttaaaagacatatctcatagatgcattgagaaaattatctgcaattttatgtgtaagcaatagaatttgtttattttaatagcttaggcgaagaaaacagttgctttcatagatattttaattcctttgttcttgaagttagataattaggttgctatgagaagtctatgtatggttaaggtgtaccccattagtttttaggtgttaaatgcaagcaatacatcgtaattgctttgtttgcattgaatttttttgttactacaggttcgctgctgggaagttcaagacagtggacagaccattccaaaagcccagcagatgcacactgggcctgtgcttgatgtctgctggagtgacgtacgttcccttccatttctcgtgttccattttacttaaagtacagaatgatttagaatatttaataatccaaacacaaatagcatatatgtgttcatattgtaggaattctaagtttctgaacataaatatagtcatttattgatgttcttaatgttggctttagttagccactttctttgaaagcttttcttgtattaaattttgtgtgtgtgattgaggagagtttaatgattaagggataatttatgaagaagccagcagggaaggtgaaacaccggtgccaagctgcagtgggcgggcctcctggagcacagcatgagctgcagctgtagaggggcttccacctggcgcgggagagccaggggatgaacagctgtagacgggcctcggcctggcgaggggagccaggggttgaacaccccagcctctctcctcccttctcctgccattgctgctggtggctgaacccaacagtagtgagaatgttaaggggcctggtgacaggcagacacactgcagtgctgaagaagctaagccttgaggccccttccgaggccttgtacctgttcctttagtcaggtttattgagtctgatttgcctgctgtaaaactgaacctttttggtatacagctctgtgagtgttaagaaatgcatagagttgtgttctagatatagaacagatccatcggcctccaaattctcttccttccttttgtcgtcaaatccttcccagctcgcagcccctggaaactactcatctgttttttttgtccctatagttttgcttttacaagagtatcatctaaataaatcctatagggtgcaacctttgcgctcagcatgttgcattaacgtatggtgattgttttgtcagatatatttcctatgtttggggtgggatgctggaaattaggacaagcattgagatatagcatctgcaaaatgctaatgtaagtggtaggagttttctcataaaagatgtacgagttggtcttagcggtattggggttatgccattcgaatttgtaagaagagagtggtttagaagggtcttggtaattaaatttgtggtatagagttctggtaaatatacagtgtgtagtgctcctaggaaaatagtagtagttagggcatttattatgataatattcatgtattctgctataaagaagggggcaaatgagcctgcggcatattcgatgttgaagcctgagactaactctgactctccttttgttagatcaaaagaggctcagttagtttctgctagtgtggggataaatcatattatggctaggggccatgatgataggagcagtcagaggaattcttgtgatgagtatgtgtaagttaaatgagctgcttatcagtagaactgatagctggataatagctagggtgacttcatatgaaatcgtgtgggccacagctcatagtgcgctgattagtgcatattttgaattagatgctcatcctgatcatagaatagatagacggctaggcttgatgtggctagtttaaataggaggcctacattaaaattagaggatctggtatagggaggggggttcataagaggagagcgatagagagggctaggattggagcaataatataaagggtgatagtagatgttaagggccgcgagggttctttggtgaaaagttttattgcatcaaaaaatggttcaagcagtctgtaaggacctacaatgttgagtcctttgcatagttgtatatagcctaagatttttcattcgatgagtgtaaggaacgctatcgcgataagagtggggataatgagcaggaggaggttaattacaggcatgttgttaagaagaggagttgaacctctgattataaagtgttaagttttatgcaatcgctgggctctgccatcttaacaaaccctgttcttgggtaggatgtgtgatgatttaagagactgggatggcatcatctatggagtgagggcactttatgaagtgggccctatttctcttgtcctttcgtagtaggaggaatgttaagtaggtagaaaccgacctggattactctggtctgaactgagatcacataggactttaatcattgaacaaacaaactcttaatagcggctacaccattaggatgtcctgatccaacatcgaggtcgtaaactctattgtcgatatggactctagtataggattgcgctgttatccctagggtaacttactccgtttatcaaattattgggtcgatgtgtaataactcacttagacttgtgtggtcttaggttgttaggaggttgaattatgctccgaggtcaccccaaccaaaatttttaatgcagggataggaggctagggcctgtaggcttgttggagtttttatttgcattgatgaattaaagctccataaggttttctcgtcttatttgtttatatccgcctcttcacggatagatcaatttcactggttgaaagtaagagacagctgaaccttcgtgtggccattcattcaagtccctatttagagaacaagtgattatgctaccttcgcacggtcaggataccacagctgttgaatatatgtcactgggcagatagtgcctctaatactggtaatgctagaggtgatgtttttggtaaacaggcggggtaagatttgctgagttccttttatttttttgtaatgtttccttagagcatgcctgtgttgggttaacagtgcaaataatacggtgtttattatatcatttattaatattgggatgttaactgtcagtgggttactcccgtctgatgtaagcttatgcaatggagaatgtcttcatcttacttacattaacattactgcttctattaagtaatagattagtccaatgtgatgttaggagttcagtagactggttagaatttaagatagttagatattgagcttaaatgctttcttaattagtggctgcttttgggccaactgtggtggtaatgttttttactctctgtaggaagggtctaaagagctgtctgtctctctagactaacagttaaacttacagggagtttaagtaattctgtgggtaagttgaaagttgaactaagccagccagctatcaccaggctcggtaggcgtgtcaccgctactcatgaatcttcccactgttttgccacataggtgagtgtgctctttcagctattcttgggtagctcgtctggtttcgggggacttggccatagttctatgtaaagttatttctagttaatgcattatgcagaaggtataagggcttgtctttgctttttagtcctcaatacagttctttcatccttcccttacagtactgtgtctattgccagaaatatctaccagggtagaaatttctatcgcctatacttttgtttaaggtaaatggtttgattaagatagtttgataatatttttagcgaggtttggggctagagttgtctgagtggtcaggtcatgatgaaatcttctggatgtaagccggatgctttgggttaagctacactttggtttatccaagcgcactttccagtatgcttaccatgttacaatttatctcctctatacctgtgtagaaaattatcagtaatagtgatttctagagtagtattcgaggaaggtgatgggctgtgtgtgcgtgcttcatggccttattcaaccaagcactctgctcttggtttactgctaaatcctccttaagcccttagatttcataaggctgtcatgagattttctggacatagaaaatgttgcccatttcttgccacctcatgggctacaccttgacctaacgtttttatgtgtatacttgtgcttactctataacctttttagggtttgctgcagatgggcatataggccaggggcaagaggtggtgagacgtatcggggtttattgattatagaacaggctcctctagagggatataaagcaccaccaagtcctttgagttttaaattgttgcttgtagtactctggcgaatggttttgttaatgtaactgttagggtttagggctaagcatagaggggtatctaatcccagttcttgtcttagctactgtgtcttcagggtattaaagctactttcgtagtatgttttatttcaactggagttttttacaacttagatggagcttagcactctttacgccaagttctattagcttgggttaactgtatggccatggtggcgggcacgaaattaaccaaccctaaatattagtatagcttagttaaacttctgtttattactagatttaacactgctgtttcctgtgggggtgtggttgagcaaagtgttttgagctgcatttgtgcatgcttgatacctgctccttttgatccgggtgatctagaggacattttcactggggtaggggtgtttgcatgtgtaatcttacaaagaactaataaaaaggtcaggaccaaacctatctataaggttttgtggacccatctagacattttcagtgtcttgctttgagtggttaagctacattaactgtgtagaatacttaagtggaaaattaaagtatgagaaagaaagaaagaaagaaagaaagaaatagaaatagttgcttacagttctggaaattcagggtctttaaagttggattggcagaggtttggctgagagggttattcataattagagtatggttgatttagggttatggtgtactggggcagcactttcagagggttatgctcaaggtatcatatcagtattagggcagaagtttagttaatctattatacatagtggaggatttattgggtaggaggagccttaagattttttagaaaattacatcaatcgaggggtagctgttggggtgttcgtggttaaaatatgtctgggctctgactgggttgcattttagtttcttgtgtttggggtttggcaaaggtatgtttacctaggttgatggtaaagtcagattaggaggggggagtttgcggatttattcggaaatagttcttgaaattgagcatacgtgcatgcgtgagcatctattgattaattgttaagtccttcaaccatgaattaacaccttatggttgttatgtcagtccggaatattcagtataagttcagctacaatggatttggcaggagtcaggctgttgccatgctgagtcacagcatcccaaagttaaaaaataccaaatgcatgacagtgctcccgtgactggctaatagggtggtagtgattaatccatcaagatgtcttatttaaagggaacctatgggcaatcttaattttatggccatacgttaatgcaggggtccccaacccccaggctgtggaccagaacaggtccatggcctgttaggaactaagctgcacagcaggaggtgaatggtgggccagtgagccttactgcctgagctccgcctcctgtcagatcagcggcggcattagattgtcacaggagctcgaaccctgttgtgaagtgcacacgtgagggatctaggttgtgtcttccttatgagaatctaatgcctgatgatctgagatggaacagctttatcctgaaaccataccctcacttcaccccagtctggaaaaattgtcttccatgaaactggtccctggtgccacaaaggttggggaccgctgctttaatgtgatcttatttagcttatatataagaaataattctgtgtataaacattttgacatagtttaggggccacagttgctcccattttattcagtagcaaggatcagcttctctgaggcatttttatcatctgtaaaatgtcttcctgacatacctgattaagttattgtgacactacattaatagatatatgaaaagtttgaaaagtgaagcattcatttcatatgcaacttatttttagtttacacacagaaaagtagcagcatgagtagatttgaaacatttctaatgtattttgtctgtctttactgatcgggcaacgggtcagaattagaaagtttcttataaagtacggcaagaaatagaattaactaatgcaggaatccttttgctcaaatgttatctaatggctattggaatttataaaacggaatctaagtttcatagcatctagtgggaggatcagacacaggaatgagagttgtacgttctgacggggaggcaggatgaactggtgctgggtgggaaaaacaatacagaaagcagctgtaaagtttggaaaggcttctgtgaatgctttacagaagacaagaatagaggtaaatttttgtttgtttgtttgtttttgagtgttgctctgtagcccaggagtgcagtggtgcgatctcagctcactgcaacctccacctcctgggttctaagtgattctcctgcctcagcctcccaagtagctggggttacaggcgcccaccaccacacccagctaatttttgtatttttagtagagatggggtttcgccatgttgccgagactgatcacaaactgctgagctcaaagtgatccacccgccttggcctccccaagttctgggattataggcatgagccaccacgcctggccagcagagctgattcttgaaaagtaaaccatttgcctatagctttttaagcattgtctcatccaattgaggcctgggttcaaatttcagctctgtctcttccaggcttttgactttgccaagttgtttaatctttctaaatttgttttcttgtttagaaaatgaaggtaggctgggtgcagtggcactttgggaggcttgggatgaaggatagcttgaggtcaggagtttgagaccagcctgggcaacgtaaggagacccggtctctacaaaaaatagaaaaattagccgggtttggtggcgcacacctgtagtcccagctacttgggagactgaggcaggaggatcacttgatcccaggagactgaggctgcagtgatccatgatgacaccactgcattccagcctggcaacaaccctgtctcaaaaaataaaaaaaattatctgagtgtgatggcacatccctatagtcctagctactcaggagactgaggtgggaagaatccttgagtccaggaactggagagtacagtgagctatgattgcaccattgcactccaagctgagcaatagagcaagaccgtgtctctaaaaaaataataaataacaataataaagtaaataataaaatgaaggtaataacacataataacattattaattcagcaaataattgtcaggcacctattgtatgctaaatcctggagataaagtggaaatcaaagtaggcaaaacctacacttctgaaactcatgatctcttaggacaaacaagaagaacaaatacaacttctcgatagtggaaaattgtgatgactagattaaacctacacggaaggattagcacagtgctgtcacaaagtggttaaggagcttgcctgtgagaacaaaagtgactggctgagcctaggcccagaccttcctggtgatggagcccatgtgcttagcagcctccctcatggagctttacaggaagagtcggagctacccgggagagaaagacatgtaggtaaaggcacaggggcgctaaagacccaaagttaccttggaggcataaaagccaaacttggtaaagttgaatcttcagtactttaaggacatggttcaaactctgcagttgaagcaggtagacttagagcagctggtggagcattcacacatactctttctctccccagtgttttgctggattctcctttatgtctgcacgtgtccactgaggttggcatgctctgctccacaatgctgatgacgtggtggggctggcattatgagattgagaggccagtgttcacttggactcagggcagccctctccatacactcatacctttcctttgctgtgttttcaaggatttgtagaattacaacctcattaaaagcatgaggagcaagttttatctcttctttcaaatgaagtcacttcaatggaacaagtttttgctagaggagaatggtggtcaatttttgagctctggaaccaaaaatgaaatatagactaggccaaggttcagcaaactatggcccatgagtcaaacctgacccattgtctatttttgtaaataaagttttattgaaatgcagccacactcattgacataatatgtctgggtgctttcaagctgcagtgacagagaagacctactttgagttctctgtgtgaatattgtgaaaccatcacacagtgaccactaatttttaaatctatttgacaagttagataggaccaatgactgttgtaaattggcatagctttattgcatgtacttggaagtgttattagatagggaccgaataaaagtaattaagattatagttatgtgttttgtatatagagagaaagataaatgtgacagaatgtttacaattgatgaatctatgtgaagtgcttatgggtattttttgtatttttgcaacttttctgaaggcttaaattttatcaaaataagaaaaaaattttaaagtggtccatggttgctgctgagaggagacctgggatcagggacaagagaaagagtttgttttcactagtttgtgatttctgatttttaaaatcctgtttatatgttctcgcttagaaaagtaagtcaatcatgaaatagatgaaaatgaattttttgtatgatgctgtagtttgcagtacactggtccccaaacaattggaaaaataaagattgccaaagtttgcctcaatatgttcaacgtagtatctaaatatatatatagttaaagatttaatttttcttaaaatgcaaaattttctccattttattttaggatgggagcaaagtgtttacggcatcgtgtgataaaactgccaaaatgtgggacctcagcagtaaccaagcgatacagatcgcacaggtaacagaagcctctgcagaaaggctaggcacaactggtacccaggactgtgatggctctttaagtgaaataattattataattataataagaaaacgtgcagttagactctgtcaaatcaattagacaatataacagaaacctctttagcacaaaaataacaattttataaccattctcattcttaactagtgttcacagattgtcttgtcatggatcttcatatatgtatggatggagtcataaggagttagtgacattaaaatctatgaaagacaggtcataggtggtccttgccattcacaggttggacgttgtgacctcgtgcatggctggtcttctaccaactgcatttggtcacttactcattcagcaagtgttctgtctatgggccagtaatagagcagcgagtaagaggggcacttccccacacgtgtggaacttttaccgttactcagggaccactggcaggtactgtgtgaagaatgccaagggcagaagtaatgaagataagagaacttagaaccagagggtccagcctgctaagggggcttcaggaagagcacagtgctgaaacattttcaggaaggcactgcatactcaggtcacagtgctgtgtgctagaaacatctcattgatctcttaattcccatcacctcagtgagtaaaactgtggtggaatcccctgcttgttatttctgaatatctccctaaggaggagcttactttcactcgcacatatgtcttaattatgagtaaaaaaattaaagtttgctagaatggaaggtagatatatgtttttgtgttaaattgactgttttgattatgggtgtattagtcccttcctgcattgctataaagaaatacctgagactgggtaatttatagagaaaagaaatttagtttgctcatgttctgcaggttgtatgagtatggtgccggcatctgctcggcttctggggaatcccaagggagcaggagatggagcaggcacatcacatggcaaaagcaggaaagagagctatgggagagaggaggtgccatactttacaacagccagatctcagagaactcactattgtgaggactgtgctaacacaggagggatccgcccccatgacccagacatctcccaccaggccccaccttcaacactggggattacatctcaacatgggatttggtggggacatgcaaactctgtcagtgaggaaggattggtaaaatgctaagtatgttttggtttttgtttggtatggccccagtatttaaattagtttcttccctttgaattgccacaactaaagctgttcagcacattcttacatttaccttgatctgttttgtttttgtcttgttgaaagcatgatgctcctgttaaaaccatccattggatcaaagctccaaactacagctgtgtgatgactgggagctgggataagactttaaaggtataatgtgcagttgaggcattgtttggccccatcaggattgtcatttatttttgcaccatttcgacttctgctctgaatggtcacatactggcttctcttttttgcttttagttttgggatactcgatcgtcaaatcctatgatggttttgcaactccctgaaaggtgttactgtgctgacgtggtaagggatttcaacttaatatgtatttactttaaaaaaaaaacaaaataagtattctcaccttgtggcgtcctgcagttagtgagtggataatataaaaatcctgctagctttagtaatagatataaaggatcgagttgagattgcctcagtcgtctccaattgggagatttttgtgctgcgtttcttttagaagtactaaatgctggatgtcaagttttcctgccactcgtttgaacatatgcagctagctacatgccatctctagtgtgacatctatcatgtcctttccatggcagtaggaaaacttgcagtaagtttgtgaggtggtaccaggtctttggggactgtttctgagtgggatagaaattgaactttctcggccaggcatggtagctcacgcctataatcctagcactttgggaggcaaaggtgggtggattgcttgaggtcaggagttcgagaccaccctggccaacatggtgaaaccccatctctaaaaatacaaaaattagctgggcatggtggcgcacgtctgtaatcctagctattcgggaggctgacgcatgagaattgcttgaacccagcaagtagaggttgaagtgagctgagatcacgctgttgcacttcagccttggtgatagagtgagatactatctcaaaaaaaaaaaaaaaaaaggaaagaaaaagaaatggaactttctccatttgtttagtcacatcttaaagttttgtaccaacaatcccgtaattccacttttaggaatttatcacaagaaaataatcatagatacagatggtctttgttttttttgtttgtttggtttttgagatggagtcttgctctgtcgccaggctggagtgcagtggcatgatctcagctcactgcaacctctgccttccgggttcaagcgattctcctgcttcagcctcccgttaactgggactacaggtgtgtgccaccaggcccagctaatttttatacttttagtagagacggggtttcacatgtaggccaggatggtctcgatcttttgacctcatgatccacctgcctcggcctcccaaagtgctgggattacaggcgtgagccaccatgcccggctggtctttgttttatgtaatatagtgaaacattggaagtggcctaaggggccaccaagacacagataaataaaccctgtggtaggttcatttgaggggacgttagaagccactgctagtacttgaaaaagtgtgtgacgtggaccttatgaaacatgttttgagtaaaggatatgaactgtacagaaatatgctacataccaagtataacgctgagaacaaaggctggaatagtgacagcaactgaaggagtggtgtaggggatttttatttattcttagttcctgagtatattttctaaatatccacatattttatagttagttttaaaacacgagactttttaaaatatatgaatgttctactttcaaatactatttctctaggttttagtgaaatataatcccaggattattaaaatccagacttaatgttgtaaccaaaaattgatcaaatacattagtataaaaacagcacactccttcacctgaagcgcatctctgttttcttccattccctagatataccccatggctgtggtggcaactgcagagaggggcctgattgtctatcagctagagaatcaaccttctgaattcaggaggatagaatctccactgaaacatcaggtgcgtcattagtcaaatcaagaagtatgtatttagcacctgttgtatgcaagattgtgctcacatctggaatacagttgtactttgtaaaacctgtaagtatgttcaaagaggggtgaattgaaggatataaacacaaatacttagtgagtgaatattaagtaatactaaggtatccctggatgaactgaatttatgtcttctccaaacatgcccctggatggctgagtgctactgaattgtaggggccaagggaaaacttctcctttgccctctgaaggggttcactgaaaagtagctggtaaaagacagattaataggagaaatggcatacaaatgtattgatgtgcacagcgtcttacaacgatcttaaaggcaatatggttgatgctttcataccatcttgaggtcacagaaagaagggggctcagggcatggcccaaaacaggctttcatggtaaattgggttctcgtggcaagacaggttatgggaagaagagaagaagaggtctgtgtagcaaaggtggtcttgttaatgtggaggaaaccccacaggtagcaccctcggagagaactgagacctttaacggcatcagactgcagttaatcttccctaatcaggacaagggaagggccttggagaaagcctggctgcatcaatgccgattttctctgcagatgcagatctccccaccaaagatagcttttcagctattatttccagcccttctgtatagccatcttgaaatatgtcagagaagtctattttggggcaaaatattttggtttccttgagaataaaattacacatctggatgggttggttccattgtaaattcctagcttccaacttcaactctgtctgcatcatgcctagatgcttgctagctttttcaccttagctcaatcctccacttgccacagggctgctgggcctgcactcttgtcagcttctccttcctttagtctttgtctcagccaatcagatcagctcttgctcagagaaaaaagaagctaatgggaacttcctcctctttctcctgccagatctagaaatctgcccgtgcttgcctcctcccctgccttttcccccatgaggtggaagccgtcctgctaaggccagttttgtggtgggacccatgccctccagccttctcaggaaccgtatgcagagtatcacctctttcccatacacccgtctctcctgccgcgtagtacttctcccttagcactgacactagctcaagtctagttgatcctagaaaacacacctcccttgatccccacatcctcctccagtactgcccgcgtccctattccttccgcagtggggcatcttggatgaaatgtcctttattccctcacctcccactcatttctaactcagtgagacctttgccccccattgttccaccagaactgtttttggcgtgactaccagtggcatcctcattggtaattccaggggaccctggacacccatcctcttactggaacagagcttcattcactgttcttacaagaaacatttcccctggctgctgtcttgccagcctcttacccgctacctctgtggctcttctatccttgctggctcttggctgaatgtggaggttccacagacatctccctaagccgctgcctcctccacccaagcacaactgatctcccatccactgtcgctcagccacgccctgtggactggagactcgtacctcattcctgtgctcctgacatggacacccagtcggacagctccttggtgtgtctcccaggcgtctgaagctacggtatcccacaccaaacccaagactacattctgtagctctttattcacatgttacccttgcctcaggattctcccttgctactgccaccagtaccatctactttatacgtatgtatggatgtcatatacatactaaatatttcccttcttttgcctactagaatgtaaactccatgagagcagagatttttgtttgtatttgttgctgcctcccagcacttggaggagggccttaagtgtaaaaggtgctctgtgaatatttgcagagtgaacatttgatctgaacctgcccctctcggccaccaccagcctgttgctcctgatgtgcttcacagcccattcaatgggacctccatctcctttgttatagccagaaatcttgaggtcacccctgattggaactttccctctcctgtctcactaatcctcagtctcctcccctctaccctgaaattatttgggaatctgttcatttttctccctccctcctgccaccacatctaattcaaatcttggaaagcacttagatcagaactctatgacattggtcttggcagtaatttcttggatatgacaccaaaaagcacaggcaacaaaagcaaaaatggccaagtggaactgtgttaaactaacagctcttgcacagcagagggaaccatggaaaagagtgaaaaggcagcctgtggaatgggagaaaacatctggaggctatttctgacaagggattgatttccaaaatacgtaaggaacccctgcaactcaatagtgagaaaactggtgacgtgaaaaatggaccaaagacttgaatagacatgtctccaaagaagacatacaaatacccagcaggtgtatggaaatgtgcttaacatcctaactatcaaggaaaggcaaacaaaaaccacagtgagataccatctcctagctgatgggaccactgttaccagaaagcccaaagataacaagcgctggggagggtgtggggaacatggaacccttgtgcactgttggggggatgcaaaatgccacaaccgttacagaaaactggaggcctcaaaacatgaaaaacagaatcaccatacgatctagcagttccacttacaggtcttgattcaaaagaatcaaaatgggtattttgaagagagacctgtactgctagtgttccttgcagcactgttcacaatagccaagtgaacagataaagaaaatgaagtgtatacctgcagtaggatgctgtgcgtgcagcctgaaagaaggaaatcctgccattcgtgacaacgtgggtgaccatgaaggagattatgcaaaatgaaataagccagacacagaaagaaactgcatggttccacttaaatgtgatatccagcatagactcacagaagtaaagggtggaatggcggtcatcaggggattgggggagagggaaatggggagctacttaatcaatgggatgaaatttcattaaacaagatgagaatgttctagagatatgccgtactacatggtacctgtagtcaacaataatgtagacttagaaatgtgttaagcggtggctctcatgttcactcttcttaccacagtaaaatcagcacttagaccttggccctggttcaaggcgtcctccggagctgaggcaggggctcttgtaagcggcaccactggccttgccggaccccagcctaagcccttccctgcctccccatttccttttggttgaatccaaaaaaaacctggtcccatctggcttcacttcctgccacccggtgctagcgccctggcctctccgttgttgagaactgattgccatcggcctttgcacagggccagtgcatgtggctcttggtgcaagtgacacccctggcattgtgcagttcctggtgtgccgcacagtagaccctgtgctgatgaccagccatggccttttctgtcatctaagaacttacagatgtttgtcagtttgctttactttttttcttcgtactcacaaaagtaatggtctggcagtttttaaaaaggcaggggagcaaacagtacaggaatgaaagaggaggccgttttccttcgtacttaggaaacgtgcatcaccagcagctgtcacgatgccagaggctgcttctcccttcgtcttgcctggcccctgcctgggtcctgccaggcttcccctgaactcacacggaagctcagatgaccagcttaggcagggtggatggccctccaagctttggccaggttgccacgactggaaggaggaagtggtaactccaaagttggcttctcctcggggtggtcggcttttctgcccaggaggctgggtagtggaatttctgggttcttctgtagaatagagacctgcccttgggccctcacactcaacactgggcgaagtgcagcgtgttgcttgtctgtagcatggccactgcacccaccgtccccttcaccctgttaccctgtgagacgggtgcggcagagcctgcatccctcctccagctggggaggcagaagcgcagaagcttcgggtgacctcctgaggggtgtctgcctagccagggacgtctccattccccacaggcagggccgctgtctgcctcgcagcccatggggctctgctggcgtgaacgcggccttgcagggtggcagagggagagcgagcagcgggggcgggggaggagcacagggtgtgcagttgggtcataaactcactgcttagatggagttactaaggagttagaaagcaatgcttactgctgtatcatatttgagtgattttttctggttcttctaaaacctaaacatggggtaaaaatgacttaccttcacgttagtcatgaaatcttatattatgctgtgattatgtctcttttttattttaactgtagcatcggtgtgtggctatttttaaagacaaacagaacaagcctactggttttgccctgggaagtatcgaggggagagttgctattcactatatcaaccccccgaacccgtaagtgtgactctgtcagcttgcagatttcactggactttttttaacaaaggaagacttacatgaacctttgtctttcagcgccaaagataacttcacctttaaatgtcatcgatctaatggaaccaacacttcagctcctcaggacatttatgcggtacgtttttagacactttaaccgtggtaatacatctggaaaccagacttggaggtggctgaggaattgtgggatcagaaaagactcatcactgaagagcttgtgtgttcatgtccggagataagtggcttatgctgtaggcttcaggtttctgtggatttttgttgttgtttttgagacggagtcgctctgtcgcccaggctggagtgcagtggcgtgatatcacctcactgcaacctccgcctcctgggttcaagcgattctcctgcctcagcctcccaagtagttgggactacaggcgcccagctaatttttgtatttttagtagagacggcgtttcaccatattggccaggctggtctcgaactcctgaccttgtgatttgcccgcctcggcctcccaaagtgctgggattacaggcgtgagccaccgcacttggccttgttttctgtgttaacgtgccgcctaactagcagtgttgtgtatttgtttctgaacataagcttaggatgttttgccgagagtcttctccctccctcaggagcgctggtagacagttcacacccacagctcagactgagaaatctgtttgctcaaaagaaacattttcctgaggtctgctccttgtttcttgctgtccacatgctcactttctctggtgtgcagccctcacaggaggcaagattgggttctgggctggcatttgatggaggaagcctggatagtttctcttgctatcagcgggcagcagctggaaggaaatgtacctgtgcgctttgtttcctaactcaagcaggaagtgtgcgtgggtggaaccttctctgcgcccctctgcctggcttctcattgtgcatgtcaatccttgcaggtaaatggaatcgcgttccatcctgttcatggcacccttgcaactgtgggatctgatggtagattcagcttctgggacaaagatgccagaacaaaactaaaaacttcggaacagttagatcagcccatctcagcttgctgtttcaatcacaatggaaacatatttgcatacgcttccagctacgactggtcaaaggtgagaactcccgggcctgctctgggtgctccaaggcagcagagccaggctctgggttcagaaggcctaggcctgagttgtgactcttctcaggactcacgtgtgtccttgggcaggtcaccgtcccctccctgtaaggggaaattgcaggacttcctcaaatggttgtggggattcagtacagcctttggccagaacccagcacacaggaagtgctcggccagtgtgagccattacgggctgctctgttcctgggcacagaagcacaggcaagccgggggctgcactttatgaagggggtggcagggcgggtcatggagctttcgcctgggtgctgttggttgcttggttggctggtggtttgggcagggggagttaggagctggcaggagtggggctgcatttttgaggcctttgggcatgatggtgaaatgtgtagactcgggtactctgcccaaccccatgggaagtgtgttggctttcaaccagcctgcgtgtttctccactgctcagctcttctggagaggttgtcatcattgtatttgtggttttcatcattctcctcccaccccactctgccctttgcccacaacagccttctagacttttccctaccctgccctggcttccgatggggaggtcacctgcttcacataggaggggcttccagtggcctgcagtgtctttcccgctcacctcatgtctgcctgcgctgaccccgtctccttccaccctcatggctcttttctgggccttctcccactgtcttctgtccccgtccaccagctcctcccctctgtctaagcatggaaggctcgaggaaccatttccatgtatattaaggctatcgagagagtggtgtcagcacctaccctcttggttccctgtgctctggcccctcctcagtccactgccaggtactttctggcctcttgcagctgtactcagagtccctgtggccacgtcctcctcatccagtccagaagcttcctttctgtctgtgccggtcactcacccgtcccttcctgttccatacagctctcctccctgcttcttggccatgtcctggtttattctgctttgggctgtggttcctgtcctcctgccagctcctgtctcctgcccctcttgccttgctggccccccgctatctcagcctggggggccaccacagggctctaaacagcgctttgcattcccaagacacctgctgccacacaagccagtgactggagacgtcccttggttcgggccctgcccgctccacctttagtatttcccagtctcaggagcgtggctgcacctgagtctccctgaggccccgaacttagacacagaagtccagctgattgccttccatccctctgacccctccaggcctgctgctgcttctgtgtttccctgtttgagggtttgctgtgtgagccatgaagctgtgttctttttttaaagcaactttattgaggtacaattgaaatacagtcattgtttaaagtgtacaatttgatcagtttcaacatctgtaaatacccatgaaactatcaccatagtcatctccccgaaaggtttttgtgtatattactgtaatcttcccttacgcacacacaaaaccatgggtctgttttctggcattatggactagtctgaattttctagaattttatataagtggagccctacgctacattttcccctcgccccagcttctttccctcagcataaggattttgaaattcacccatgctgttgagtgaatcacttgtccgttacttttcagtgctgggtagtattcccgggtggggtgtgccatttgtttatccattcacctgtgtaagccatgcactcagttttgtgacaagagtgtacttttttggttctgcctggctgggggtggacaggctgtggcgtgcgtggagcccgaggcctcagctcccacatcgggctcttcattgaatctcctctttgcatactcatcccagcagctgcatcaaaattctgcattttaacttaaatgacgcgggactctatacgttatacgcgttaaaaaatgtagtaaattgaaagcagtgagaaaggtaattgctttgagtgctgtttaaaaattgaagtaaaatctcattcatttaagcagttaatgtcagcttattgtgggggttacataaattagcatctttttagtttaaaagagaaatttgcttcaggggtttttcattgttcttagttcaaggacagttatctccagtgcaaagtcatgatcacatatgattgatgttattagcttgctgcttgagttactgttcagaaaaactacactttgtatattatgagaattagtggtcactgttgagcaaaacttctagagctttcttggcatgcctgttgggaagagaataaaaatgtgtcatcagagtacaggtgacagagtgcacccagcgccatgccccacctccctcttccagtcctttggcccacctgcggctcctgcctgctgtctttcttccggatcatctgcctggcccaccccactcacctctcttcttaaaacttaaatgtgatcacatcactgacctgcctacagcctccttttccctggggaataacgttcaaaggcctccctctgccattcacagccctgtagtctggcctcatcctgatttcgggggtctttcgatgctgtatagccctgcatcccctccggtgtgggcccgggcagacgtgcacacctccgcacacgcctctggctcactcaccaccgttcatgcctctgctgtgctccgtgtctgttgctccttccatgtggggcggggtgtcctccttcatccccatgataccccgcaggtcagatgtcctcctttctgtgaagcattctcaggtcagaactaattctgaccaagggacccaaggcagttatcctggcgttaaagtcctggggtgttaaaagggggctcagtgttgaaaaggaactcacaggttcctactcacagactctctcagtaggacattgatgacacactggtaccaaccacatccttaggcctttctctgaggactgaagttctgcttcgcatttgactttatctttgttgttttatttctctgagagattatatgtttccagtattgtagcacaggacttcacctagaaaaagcacctacaaatgctaactttcttttgaataataagatcattggtgttttttgctctctttagggacatgaattttataatccccagaaaaaaaattacattttcctgcgtaatgcagccgaagagctaaagcccaggaataagaagtagtggctggagactctggctcagccagagttgtttctctccactctgcctcatctctgtacgaatttgggtcccagccttgttgggttgtcagccatggacatggatttcaacccctggagaaaacgatgtcattgttcagcagctgagagcccaggcgtccgcggcgacttgccgtctctccattccactgcctgttgcagagtttttctgtaactaagggggttgaggttattgtagacgttagattgcgggcaccgccagggattttgcagcgcttcagtgtacgtgttagagaatattggaaaagcgtctgtgagccccgtgctgtattttgtaataaagtcttttgcagattgcttcccgagcttcctttgtccttttctccccttgcccaccccgtaacctcaggaacatgcgtcctgcccagcatcagcgtggggttttgagttgagatttcagacaccctctgggaaatgcggcaaccttaggggaaagggagtccccagctgcgctcacttctgctgcgcggaacggcagcctctgtgagccctggtgggcagagtttgaatgtgtttttccttgcttccctcattcccatcttcaaaatccccagtgctttctggccttgctgctcagatttccgagtgactcaaatggggactgttacttgtgctgggtgacaggccatttgtgggtaacctcctaaggcccaagtgggtgacacttgcgtgactttcaagttagaacccaagccccctgcatgggaattgccctgaactcttacccaccccggtcccctgcatgggaattgccctgaaccctcagtagtggttgtttggctgttcttttgtattttgtgtaatttaaaattcctggttggtaagtattcaaaatgaaattcagctgggctgagaaaaagtgtgacttttgggtctgtcactgtatttctcacctgtgatctcaaatgcttcttaggcctttctgtttggactaatgtgtgaagtctgacttgctgagtgtaaaattctagtatcgatagtgttgtaagatgtgtttgcctactcataaaaaacaatgaaaataaaattttctactggaagagaccacctgcactcagtggtttaaattctttggtaggtcacaatgaattcagacccacccactctccagccctgtttttttagcccgaaaacttattttttagagataaaaaagcaggtgcactagaaaaatatctgaattttcaggttaacggtttccagctcattttcctcttcactttatgaatcaagcctgtggtcttatcaacgtggggaagatctagctagcataagactgctgtgaggggagattgaagcttgattatctcagcagccaactttcatattcagctttagcttagccagagtttcattgtttttaccacccctagtgacgggctagggtggaaaatgagtctaaattgcaggccttttagagtgcgctttcccaggatgggaccttgccacctccccaaggggatagtttttgtaattggcaaatttaaaacatttgcataaatccaagattggactgggctgtcagaacctgggagggagctctgctgccaccaggatgtgaaccctagatgaggcccaggctcatttctctgctgcccaggacctaaagcataaaagcacactacatgtttgctaatgaggatctaggaagtattcactgagatcgttaagcttcttcaaatatttatgttcatgtttcctaaaatgcatatgaagtcttagaggaactcttcatcttaaacttcagcatctttgcaggcacctgtaagttgcatgcagtaggtgctcattaagtattcataagtttgatggcatcttctacttcaaagagatactagtgtaatcttggctctttgtttcactaaatgtcaagccgtcctgccattaaatattgactgcacaccctgttaagagctgctttcgttgaaagtaaagtatataaacctcatggagaagacaaattgtgttctttcacttaattttttccaacatatgaaaattttaaaacatccacaaaagtggaaagggttttggcagtgaacatacacctgccatctgcctgccaccaggatgccaccatgaacactcacctttcccttgattttctgcttggttttgcctggctttcctcccagtctttgttgtaacatcgcttccttggttcctcactgtgggaacagggcctcatgggaagaactttgtgtaaagatgctgctgcaacaaggtggcagggatttagggtgggcacaggaaggtgcactcggttcctgtcatgtttggttggaagcaggatggag

SEQ ID NO: 16517 - DNA, 18227 bp, Human
agctactcaggaggctgaggcaggagaattacttgaacccaggaggcggagattgcagtgagccgagattgtgccactgcactccagcctgggaaacaagagcgaaactccatctcaaaaaaaaaaaaaaagttcacctgattgcctttagttctcccctccttttaggctccgagctccctaagaggaaggggtttacctgccttgttcacagctgtgtcctcggtaataaaccttgcccggtgcaaggtaggcagtgaggaagtatttgtgataacagcaatgtaaagccatcaacacagtgcttggtacatgcagaacagccatcaacacaggcaaccatccctgtgaacagagggagtgcattatttatgatgggaaactagttttagttggaaaattatcaaattaccaggaacggaaagaacaaaacagttctcccaagtagctcttctggggccaagccccagcaccccacccatgcaggaccaggcccccaaaggccttggaaccaccttgttccagggtctcgctccactgtcctctcctccttcccaaagtcaggactcctttccttgggcttcagaattcctatcttctgctctagaaggcttggagcaagtgggggaaaggcaccactcaccaagtctgtcaggggatgacatggtatagagggagaggagctacataaaatacaagatgccagttaagtttgaatttcacataaacaatgaaataacattcctttctctgccatcgtggtgtgtgcttgactccacttctcgccatgtctttcccacaagacttttgggattaagcaattcctggccaagaaacaaaagcaaaatcgtccccagtggattcggatgaaaactgataataaaatcaggtacaactccaaaaggagacattgaagaagaaccgagctgggcctataaggaattgcacatgagagggcacacatatttatgctgtctgaaggtcacagtcatgttaccacatcaagctgaaaatgtcaccgctctctggagagttgtacatgttttattgagaatatattttttctctctgaatctgtgatgaatgcgttggttggctgggttcagtaataaatatgtgagacctttcacttaaaaaaaaaaagaactatttttttttttttgagaagggatcgccctgtgttgcccagcctggagtacagtggctattcacaggcacaatcctagcgcacagcagccttcaactcctggagcctctaaatccatcctcctgcctcagcctccctagtagctgggactacgggtgagtaccactgtgcaaggctacaaaataactttttagtaaaagtatatcccaaactttatacgagacgtagttactctaaaaaaaaaaaaggatttgctgtttatctgaaattctaatttaactggttgtcctggattttctttgccaaattggtctgccctacggagtgcgagggctgggattttaacccaggcctgcctgctctgagctgacctttcctggcacctgcaaaattaggatgacacgttaggaacttcctggggttcttaagggaattagaagagggacctgagtgcaaagggctttggaggcattcaactgctatgaaacgttagtaaggacagggattgcgttcacctcaatcacagctgaacccattgccgagaactgttatcccacacagctggatcttcatcattatgtgttttaatgaaaaatcgctgatattgctgtccctaaatagccaacccccaaaataattaaatcacctcaagggactctaggtccaatatccgcagcacgccacacaaacatctctcagctcagccacgcagggccgatgcctgcgcgacccacactcagggaggcgcccgcctcagggcctcacaggtgggaccgcgcctgagagccctgcgcttgcgcactccacgccgtgctctacgcatacgcctgtccagccccgcctctgggtgtgtggcgtgggcacgccggccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtacaggagctggtgccgaggcgcgacgcagccactctgtagaaaagtcgggcgctcttcctggccccgggctgcctcctagtgttgaggctgaggaggcaccccttggcgggccagccaggaacccccaaaaagatccttcctgagtacccgtgacctgctttgaacccttattttgaactcaaaaaagaaagccaggtggcagccccccttctgtggcttctaggatgttccccttctagaacgttccagaggctccctgcagctgggttggaaggtttcctaagatccttataggttggggagtttggggtacagttagctttgtattttttaaacgttttttgggataaaatttttggttaaactttaagggttttttttggtttttattttttggtttttttttagaaagaaaatgagtgttgtatgtcttctctcagtaagcgaatggttttctcagaattaacaaggacatcaacacattttaagtggtttataataagacaacatgtttaattgttttgcaagtggagagaatgtacatattttaaatgatttatttaaaatcaattacaggaaccctccagctatccatgttagaattaaccacagaaaacatgactacgttattgaccattttcacttaaaaatactttattttgtttcctcgacttgctttcttggttgagcaaagtttttcagccttttatttttaagcccaaaccaaccaccaaaaaatctgaaaaacctacaaacaaaccaatttttacaaaagaatttattttgagggagaacttgggagagtgagggaaaaggagagtggcaagtcccttgttaatatcgcagatgtagacgaatctgattgtatcttaaagttggttacagtattatcctgcaacactttttttctccaaactaggaaaaatgagtatttgggtcagtttttacctcccaatattagaatagattaaatgttttaaaattcattttctgaaacacaagttttcagtaaaaattctgaagttcctgtggaaattaaaactctcaacattttgcccgttttctagagtgcatttgatttctcttcctagacaataagctcatggtgtttataacagaacaacattttttgcagctgatggcttgtgaaattaacagtcagctgacagaaaactgggcttagtcttcgcattttgctgtagagtggcgtaatagctgccaagtcaaccgtttgttgcagaactcacaatttattctttccagggtagtgattaaacgttttcctttttgtatcgctaaatttcaaaagagccgattttaaggcatgagatcaactagggtaatgtgcgaccacaaaaggtgtttcttttgaaatttttgcattgcatttttgggaaagaaattcaaagccaatattgtatcactttttaattaaaacatatatcagtagtatgtcaagtctagtttgtattcaagttcagctagattacagtaggttaatatgataaaattacagttgtaaatttagtcattaatgtaaaagggagaccttccattggtaattgcttgagaagtaaaattacaagcaaatgaaatttatttgtaaatacagttgttttaatgcagtagtaaaggtttaatgggagagataattattgacatggattacctagtctttttttttgtctttttttaaaaccccaccccaattacctagtcttaaaaaagaataaaataaaaagttactttagtattgatctgggaaaatcttacatattaaaaagtcaaaatttatgattaagatggaatcatgctctgtttattgtttcagttctgaggttcttgcatctatagaaaatattatccaagacataatcacaagcttggcaagaaatgaagcacctgcattcacgatagacaacagatcaagctgggaaaacataaagtgggcattttgcatttttattttttaaatgcaatatctatgtcattattaaaattatttgaattagagttctggtcatatttttttcattttattgcctttaccttgccaaaaaaaaggatttaggaagtttacgaaatacataccatacagagaggttatgtaaactagaagtaggtgtgaaagatgaggcaaaggaaaacaatgctagcaccaacagaatggagcaccagaagaggttagaattccaaatgcatgtgataaagtctcataattttgctaagaataggcaccatacttggagctaagctttctagcagtcagagggggagatgtcatgggtgcaattctcacatatgccacaaaagcaaaccacttgctcaggggaaatataaccaatcctgataccagaccaaaataaaagtatcctgaacatagagcacatttaaggctttctcctgacagatcttctgcccctgctaaatcatgtgtccaaaaagggtaaaatcagcaaacagctttatcagaattcttgaacctagttataccggttttttccagcctctcatattttttaagagatacagaaacaaaatgaaaggaattttgagtctccttcatcactgttgttttatgatctatataagtaatataagctgtatacttttcagtcatgttttgaaagatggattttatctagctttgaagcagcttacacctgacatatccacctggtgccttctgccacctttaggggaagcttggcagttcaacttaacctaataaaattgttattttatgtaatgtaattttgcaggtaaatcagaaatgaaacatttcaaagcttattaaattgagtaaaattattaaatgagtaggttattaaaatgagtaaagtactaattgtgaaatatttgaaaacattttacatacactaaaaatgtcttcccagtaaaaaagtatgcacacacacaaacacactcccacaccccctaatcaaaggtgttagctcatttatgttaaatggtttatcttagtgcctctgtatgtcacaaacctaatttcctagttatcacctggaatgatctatgctctcaaaccagttgatcctaaagcttcagtgcttaaattgagaagaaatgtgggttttaaatgatgtgcagaagaccataagtatatattgtttggtgtttagaagttgtctttttcacttttttcctttgctttaaacaaaatgacaggtttgaagattctgtgggtcttcagatggtatcccattgcaccaccagaaagatcaaaagtgattcaccaaaatcagctcaaaaattttgtaagttaattgttcttagcttttggtaataaaggataaataaattttgttatcttctcaattttatttgttgctagttaaataattttacctgtttttaatagatcactttcatacataaaataaatttctataatttttcattgtcaataactatggaagtaggttatcaacataaacatttttcaaggtatatggttcagtgcataattatcctctcagttttgctatccatagagcaattaattttaactgattctgcaggtaattgttctgtacttaaccctcccattttggaaagataattttttaaatgttaactaaaattaagttaaaatccttgatagcagtatcttttgaatcagtaagagaaatgatgagtaacttgtttgttgaattttattttccagctctaatccttaaaatattgtccatgatttataaattagtacagagcaacacttatgcaaccaaaaggtaaatatattgttctagtaaattactcttcaaaatgtaatgtgagaaatagttggattaacttttattatatgctttgaaaagttacataagactaaactatagctcataatttactttctttatatgttgtgttttcatccagttaaagctttcttcaattaacactgtaatacttgtcatattcaaaaagaatatagttaattaaaaatatgtattttaaattttcatagggacatatattacactgacagtcaactctttggtaaccagactgtcgtcgacaatattatcaatgacatttcttgcatgttaaaagtgtcaaggaggagtctacatatagtaagtagtacctaatacaaaacattttattttaaaacaaaatgtttgtataaaacataatttttttttttttttttgagacggagtcttgctctgtcgcctaggctggagtgcagtggcgcgatctcaactcactgcaagctctgcctcctgggttcatgccattctcctgcctcagcctcccgagtagctgggactacaggcgcctgccaccacgcccggctaattttttgtattgttagtagggactaggtttcactgtgttagccaggatggtctcgatctcctgacctcgtgatccacctgcctcggcctcccaaagttctaggattacaggcgtaagccaccgcgcccagacaaaacataattttaaaacataatatagtcttcttttgctattatttgatgcttgcatttttctcactataaatttaagtaatagattctcaatatattcctttgggtgaatggaccaaactgatgaattaccaaatatttttaattcctaaatcccttacatattttctctttcatctctgaaatttcaatccaagtgaaaatgccagtaattcagcagatgaacacaaggagtgacttaatagcataaaacatattcgtgaagcaggtttcaaatatgtctattattttttgcagttatctacatcaaaaggtttaattgctggcaacttaagatacatcgaggaagatggcaccaaagtgaattgtacctgtggtgcaacggtaagaagcatcattgaagttttcacagctttaactcttctagctccttcagttttgaagcataattttatttcttgctttattatgtaacctagagcttaagatttcaaaataaaactgaaagatggataggaatatgctttacagaactgtacattacatagtttcaaattatgctaattgtcaaatgtcagattgaaataaacatacaaatataactcttaaaaatgcactattattttcagataaagtgtggcttggtcattttagcatgttatttagtaatgttcataaaattttctggttctgaaagtaatatttttaatactaaactatttgctgggctttgatacaaagagagcccacagtactaaacttagtacccctgttgggagaattgctgtgagtcatgtgccggttttcttactgaggggtaaagctgttttctactattttttaacagaggaagaagtctctgatgactggtatggtcaaagaaaaataaaaacagagggctttgtgataaactaaaaatgtggttattttgctttttatgtaagataaaaactttttttttaaaaggctgttgctgtgccatcgaatattcaaggaattcggagtatcctttaagtgggaaaactatttaaacttttggaatgttcattcattcattaattcctttggtaagccaagccttcataatgtgtaaggaacaagttaggccctgtagcagtcaagatgaacacaccatggtcccttctttagtactcttttaggagctcaccatctagtggaagagacagatatctgaatatatgaatagatgtgtttatatgtttgaaggtacaaactaaaatgttgtatctatagctgcttttgaattatctatatggcaccttaatttagttggtgattaaattgaaatactcttgctttcaatttatcagccttaacttcacagatttagttacagatgcaaagtttgtattaattgtagaaaaagatgcaacatttcagcggctcctagatgacaacttttgcaacaaattgtctccttgcatcatgattacggtatattatctaactttactacaattccaagactaatgtatactgttatggtgattggtaagaggatttacaatattatctacacaatgtcctgttttcaatataatgcatcctttgggatcatagaacgggaatttccaatgtgtttatttaaacatcctcaaagctggctatcacctcaagttcttttttttttaatagagacagggtctcgctctgttgcccaggccgaagtaccatggcatgatcatagagcactgtaaccttgataagttcatgtttctaaaaccacactcaaaagctttcttccttgaaaagctgagtgttcctgccacttgtcctgtggctatcagtgcagacactgcaatgaggtccacacgtcagagtcagtttgacttactcctcacatcccatggtcaccaagtccttttgaattggccttgggaatctctttcatttcagccctttctccttaatccttcccctttcattcttacacaagacaaccacctggtagcctccagacaggcccctgacttcaattatctctcatccctgccacaccagacttgtcatttccctccttgccagttcaaaaacttttggttttgtctgatacttctactccaaatctggatgcctctgtggaactggtcagcccttctaagactccattccgcctcctctccagggcagcgctcctcactgcctccataaacatctctcgcaaatgcctctcaagaagaggctgggactcgagggccatattaggaagagccatttttcaccaggtcctttaaccctgtttgactcctctactgtgttcatgtgctattatttttcccaaagaacattatgaaaatacactaaatactcacgatgagctaggacccctgctaagcacttgacatagtaagagttcacatttactggtgtttatcacatgtcaacttgtataggctctcaatggccttaggaggtaggtactaacatcatcgtcactttaataatggggtactggaatgcaggaaggtattttaccacgtctctatggctattcaaaaccaggactggatttgaatagttgaaatccatgttgctataatgccatcacttggtgtgataggcatatttatgctgattttatagataaagccatggcctaaagagactaagaaacttgcccaacatcacaccactgatgatgggcagagagggaattcaaactcggagctgtgacccgaagcccattctgaatctctagggctactctgcgctcttcctctgctctctgtttcatttggttttctgcttttctctaacattgttgtaacactcttcaatttacttttctacataattattattttaatgacttcataatattatcccaccatttaagttttattaaaccctaaatttaagccaggtactcttctaagtgctttatgattattaaataatttaattcctataataatctcatatgttgttacagagcatcaaaccacagagtggttttgttactcattcaagttcatgctgctaagaagtagcagagctgagatgcgagctcaggctgcctagccccgcaactgctgcagatcaccgctgtactatgctgcctctccacatccctgttgttagatattttggctatttatattagtttgcgccattttaaataacacttcagtgagcatctttaaatatgtaggatgtttattatttctgtttttgctgaaatatttccttaggaccatttcctaggactggcataattcccagtccttcagtctgtttgtatataatgtacatttttttttcacagtcaacaccagtctttcagcacctgaaatccaaggtaggaagatgtaacccttttttttggtgctgtgactcagatatgaaccagggttgctgtggccacatgcagagtactaaccgttgtatgagcataacctataatttattattactattattattatgattttgaggtggagtttcactctttttgcccaggctggagtgcaatggcgtgatttcggctcattgcaacttctgcctcctaggttcaagtgattctcctgcctcagcctcccgagtacctgggattacaggcgtgtaccaccacacctggctaattttgtatttttagtagagacggggtttcaccacgttggccagactggtctcaaattcctgacctcaggtgatcgatccccctaccttggcctcccaacgtgctgggattacaggcgtgaaccactgcgtccagcctaacttttaaattattaataagagtataattgtaaccattttattctactgaagttaaaattcttaattttcatcttccttttagggaaagggagttcctgatctaaacacaagacttttagtcaagaaactgtgggatacatttcatgttcctgttttcactcttgtagatgctgatccacatggtaatttatcactggactatttacaacaatagtcataactaaatcatatttgttgttgtgttttcttcctctttttttttttttctttttgagattgagtcctgctctgtcacccaggagtgcaatggcgcgatcttggctcactgcaacctccacctcctgggttcaagtgattctcctgcctcagcctcctgagtagctggaactataggcacatgccaccatgcctggctaattttttatatttttagtagagacggggttttaccatgttggccaggctggtctcgaactcctgacctcaggtaatctgcccacctcggcatcccaaagtgctgggattacaggcaggaaccaccgtgcccagcctgtagttgtgttttctactctcgggacacttatgaaacattttaaaagaaaatgattacattaaaatttggtctataattatttgacacaatttatcgttactttgtcatattaaactgagaatgataaatttttcactggtgatgtccacaaaattaaaattatagatagataaaatttgagagtgcaaattaacctgtaatatgtaaggagactaattttatagttaactttcttttaacaggcatagaaataatgtgcatctataagtatggatctatggtaagtatagaaaagcagttttccttttttattatttagacattttatattcattgaggtgatttctgcatttattaatcacccccaagcaggctgagagtgcccaaagtgtacctgagggcctagtatcctattctaggagcaatctgtgtgtcggtggctgtgactccagctcccagtatgaccagtgcaaacacagatgacagagtgggattagctgtgggcaagcagcattattatcctgcactctcttggcatactgaaggaactgtggggctctggggtgacaacaacgctgtctgatcaccaaatatactcgaaatattatatagagccttgaattctgacttttctaatcccttttctcccaccataaggagaaatggaaacaataaatgtcaccaccagtgtctacaattaccatataccagtggtctcacagtgtggtcctaagccaggagcatcagcatcatctggaagattcttagaaatgcaaatctcagtccccatccagaactactgagccaaaatctctaggggtgggatcctccaagcattctgatgcatggtgaaatttatagcagatgaaaaggatggtggagcagggtgtaagatggggaatcatgaacaataagaaatgtaggtcagagggcttcatttatagtttgctttagaaaattaatacagaaacactatatagaagttgtggttgttgttttgttgctgttttgagacagggtctcactctgtcatccaggctggagtgcggtggtgcagtgacagctcactgcaaccttggacttttgagctcaagccatcctcccgccttggtctcccaaagtactgggattacaagcatgagccaccgcacttaacccagagaagttttaacaccttcactaaaagcccagcttagcatagcccctgatggttttcttacttctgtgggctctgggcatgtgaagccagctttagtacttgtccttcttaataagtgaaaaatttgactgaaaaacaagaatgctagttttctacaatttagcctcacctaatatacttttgttctttattttagtctatgtcttttgaagctcatcatctcacagttccagctattagatggcttggtcttctcccttctgatcttaaaaggttagatagtatagcagaactaggatatttaaaatgacagttcattatcatatgtaacaataagcctaaaaagtcactacaagggaaagctcttaatgttttttatttatattgtccacgatgacttatgattatgtaattatgaattaaattcattaatgtttctgtttcaactactaaaatatttaacacatgaatttggttaatgtgttacactttcagctagctaaaactttctgttttacttttatggttaagacattttatacactttttatacttaaaagtacaatacattgtaggccgggcacatggtggctgacgcctgtaatcccagcactttgggaggccaaggtgggcggatcacttgaggccaggagtttgagaccagccagggcaacgtgacaaaaccctgtctctactaaaaatgcaaacattagctgggtgtggtggtggtgtatgcctgtaatcccagctaccgggaaggctgaggcccaagaattgcttgaacctgggagacggcagttgcagtgagccacgatcgcaccactgcactccagcctgggtgacagagcttgactctgtctccaaaaaaaaaaaagtacaatatagtaaatccaattaaattgtaaccattgacaacatcatttgccatatgaatcaatttttgtcatagatttaaatttttaacttcaaaagaaaaatatcattttaagagtattaaaatttgggaacttcaagtttggcaagtttattatatatgttcattatagaaaaaaatattaagcaacaagttaaatatcacctacagatcagcagccttacctttgtagattttttttctgtgcatagccataactttttcacaaaactgagatcatactctgttattttataatctgctttttttaaaacacaacaaaataatgtgatcacttttccatgtcaataaagtacatttcttattttagcatcttttgttgctgagttttaactctagatgtgctagtgtttattcagccattccctcatagccatttaagtggtttccaaatctctattctgataggtcgtgctttgatgcagtctcttgtaactaaatctctatgcacatccttagttagtcccttaggctgaattcccagaagaactggtgggtcaaagaggatccccataatcagggtttgactgttgtctggatagattaagtttcttgctttctctgaagagtaagagtccacctgtccctcagcttatggcattaacattttttttcacctctgctaatgtgatattttaaaatgttttattgttgtaattggtcagtaagaatgaatttaaacatgtttattggatttctttaagtggtgagcaatccttgataacagttgcttgtttcctaaatatggaatgtgaacaggttttgggtgatcagccacttcctataaaatgagggtccaagaggaaacatttcattctttatttttgaatattcacactccactggattaacgtgttcaatttagtgtatgtgtgtcatggtcagaatcccttgggggtgatctgtttgtataaaaacaattttaacacaaattcaagacatatgatctgataattagtaaggtgaatagcttcaagaaactctagctgcatctcataaattctatcagtgcactaaaaagccactccaaatgaatatacgatcaaaggaaaaacactatggtagctacagaagccaggctgcaagggaaatcctccaggcctccctttcaatcaaattgtcacccctatccaagaactgcccctggcaaatggtcataattatggacacattgaaaaagactctcctgggaaatctaggatttgtgacttcaaaaggtagtccacaccataaatccaggacctctcatgttctatttttaaaacacataccatgataaagttatattccacgtttttcaaatttaaaactagataggtaagaatgtgtttgtgtgtgtgtaaagtgataaaagtgtgtgtgtgtgtgtgtaaaatgataaaagtgagacactaacttccatggcccagaatcttcaaatgaattatgaagaattaaatactcaatggaacctaaagtccctcagtgaatctcagccgttggccatgcatattggagctcactgccagaagagtgtgaagctctgagaggcttaatgtacattattaagctgccctggtatctgtatacctgatggtagtgctattggcatttgtttaataaccaatatcagtcttcctgtcatcctgtcatcatcccacgagtgtgacatgaaggaaaacaaaaactttagaatcttactgtggaaacacaaacttccactatgaacttgaaaacttgctggtctaagacatgacagatcccttcaatcctggatgtaagaggtagatctgtactaattttcttatttctgagtttcttgaagtagtaccataaatacaggcaaaatacaggacattcaagttacagaaacacttttttactgatttttttcacctacttttttccagattaaatgtacctaaagatagtttgattccactgacaaaaagggaccaaatgaaacttgacagtatcctgaggagaccttatgttacctgccaaccattttggagaaaagaagtatgtttccttttacaactcaagtgttgcatgtttaattgtcttttactttagtagtggctattcacatcgtattttgaaaatatccctcttgaaattttatatgacacgactaacataagtgttgtttggcagtaaatagttgttgaaattgagtcatatgaatgctaatagatgagatcagtgaatggagctggcctgtttgtatccttatcatggttatatacacattcttgatggctgtatcatagtttgtgggattaaaaaaaggaagaagaaatcataaagatttcagactatccctaattattgaagacagcatacagagtactctcactccagatatttttagctgtagcagctctggaatattctggctgacccttaagactattgtccctggttttggagaataaagcaattctagattactagtttgttgaattgacagaaatgcaactaagaactctggtatgagtacattttacttttattgacagatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtagtcttcagtgttttgctttattttgtattgagcctattttttattgataatattatttatttgaaaagtttctcgaaggtcttgaatgcttctctagtctgtctatagaacaaaaaacttcttcagttttaagatctacagaagcctcagattttaataaggtacttctccaacagtaaatatgtgaccttttccctccataaacctatcttaattttgccagaggtcagttttatgattttattctgtactttcagtaaacctttaactgcactgaaagtttcttgtgcttgcaagcaagaataagaatttatagaagcacggtaatattaggttagctattttataaagagaaatggtaacaataataataatatataccatttctgagaacttacatgtgccaatcactgctgattcagtatctcatttaattcccccaaggaccttgtaattactgggtaactacaccatagttttcaggtgagaacactgaggatgctatttgtccaaagccacaataataccaggggacaataatactacctacctcaagaaaatgtgggtctcaatgcaaaatgtaaatgtgggatccctttttattaagaatttcaagatgatagcagcagagaattaaaccaagcacaggcccttcttagcctggggtcctgggtgactgcacgggtggtacacctgtgaggctgggcctgcccaagaggttgtatgtagtaaggattgaagaaggtaatataataataaaggaaaatacatacatagcacttactatgtgctaggtatttttgtaggtgctttgtaaacaataactcattgcatcttcacagaaaccttatgagctaggtacttttaaaaaatcacccccattttacaggtgagaaaacaaaggtacagaaaggttaaataattttcccaaggtcacataactaataagcagtggagctgggacttcaaaccagaaagtgtgggtaccatggcgctagtacaggtaaagtacttcacgtgtggtctgtgtcctcactgcatggaaaggtctgcaagtcttattgttggctagtgtcaaatcaagatcccccgataccatacctacaattaacaaatatgttatattccctggtcacataggaaccacacatttcattttgggaacattctggtatgctgttaattttacttactcgtgagactatcaaaaattctaaaaacatttttataaataagaaaaaatttcctctgaatttataccatacttactcctttaacatgtaacagtgtcacttaactttggtatgctttgtaaaggaagaaattactaacttaaaaatatgtttaacccacgacacatctggcttaggatatactatcaaaatgggaaggagtgacaaatctacgatagtcattcaaatttaaaaataaatttgaaaaagacagatacctccagtttggataattaagtcatctcaagtttattattgcaaatttacttaaaataattttcaattatttgggaaatgaaaatggaaagagagcaaaatacactatagtttgacgttactacctatctttattagatgaaaatgaaaaattaatgctagtagctatttgggaaccatctagaattctaattctaaagatttctttctaaaaaggattaccataatacttagcatttaaaatggtaactgataacaataatctcatctaccatcatctaactgtatctaatttggatatttccataattttaatcaagaaaacattagattggaatctttaaaattaaaatgtataaaaactaatacaacaaggctgggcacggtggctcacacctgtaatcccagagctttgggagactgaggaggaggattgcttgaacccaggagttcaagaccagcctgagcaaaataatgggactcccatctcaatttttaaaaattagttggttatggtggcacatgtccataggctcatctacta

SEQ ID NO: 16518 - DNA, 99749 bp, Human
tgggtagaggcccctccctggcatggggctcaagacctgttccatcccacagcctggggcctgtgtgtaaatggccaggacctgcaggctggcatttttctgctccttgcctggcctctggcctcccctttctccacccatgtggcccctcaggctgccatctagtccaaaagtccccaagggagacccagagggccacttggccaaactacttctgctccagaaaactgtagaagaccataattctcttccccagctctcctgctccaggaaggacagccccaaagtgaggcttagccagagcccctcccagacaagcgcccccgcttccccaacctcagcccttcccagttcatcccaaaggccctctggggacccactctctcacccagccccaggaggggaaggagacaggatgaacttttaccccgctgccctcactgccactctgggtgcagtaattcccttgagatcccacaccggcagagggaccggtgggttctgagtggtctggggactccctgtgacagcgtgcatggctcggtattgattgagggatgaatggatgaggagagacaggagaggaggccgatggggaggtctcaggcacagacccttggaggggaagaggatgtgaagaccagcggctggctccccaggcactgccacgaggagggctgatgggaagccctagtggtggggctggggtgtctggtctcaggctgaggggtggctggaaagatacagggccccgaagaggaggaggtgggaagaacccccccagctcacacgcagttcacttattcactcaacaaatcgtgactgcgcagctacagtggctaccaggcgctgggttcaaggcactgcgggtaccagaggtgcggagaagatcgctgatccgggccccagtgctctgggtgtctagcgggggtaagaaggcaataaagaaggcacggagtaactcaaacagcaattccagacagcaagagaaactacaggaaagaaaacaaacgtgcgaggggcgaggcgaggaaacaacctcagcttggcaggtcttggaggtctctgggaggagaaagcagcgtctgatgggggcgggaggtggtgagtggggagaggtccaggcggagggaatggcgagcgcagagacaggctggcaacggcttcagggaggcgcggaggggtcagcgtggctggcttaaaaggatacagggactgaggggcaagaccggctcaagggtcaccgcttccaggaagccttctatttccgcgccacctccgcgctcccccaacttttcccaccgcggtccgcagcccacccgtcctgctcgggccgccttcctggtccggaccgcgagtgccgagagggcagggccggctccgattcctccagccgcatccccgcgacgtcccgccaggctctaggcaccccgtgggcactcagtaaacatttgtcgagcgctctagagggaatgaatgaacccactgggcacagctggggggagggcggggccgagggcaggtgggaggccgccggcgcgggaggggcccctcgaagcccgtcctcctcctcctcctcctccgcccaggccccagcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcggtgagtaagggcaggcgagggtacgcgtctcctttcgggggcactttgagactgggagggagggagccgcttcttctatgcagcccgcccagctttccgctcctggctgaaatcgcagtgcctgcccgagggtctcccacccacagccctatgactcccaagctgtgtgcgcccccaggtcgggcgcgctgggttcggtgagcctgtaggggttactgggaaggagggatcctccgaagtcccctccatgttacgccgccggccgcatctctggggctggaggcaagggccgttcaaagcgcggggctcggtcatgtgagctgtcccgggccggcgcggctcgcgctacctggatgtaaagggcccttcccggcgaggctgccttgccgcccttcctgggcccctctcagccctgcctggctctggcatcgcggccgtcgcacccccttaccctccctgtcaagccctacctgtcccctcgtggtgcgcccgccttagcgtaccgcgcgctccgagcgccttggggcccctctccgggccgccggatgccccattctctcttggctggagctggggaagaaacggtgccattgctaattttctttgttttctttctttgtttatttttttcttttttctttttttttcttttcttttctttttttttttttttgagacggagtttcactcttgtcgcccagtctggagtgcaatggcgcgatctctgctcaccgcaacctctgcctcccgggttcaagcgattctcgtgcctcagcctcccgagtagctgggattacaggcatgcgccaccatgcctggctaattttgtatttttagtagagacagggtttctccatgttaggcaggctggtctcgaactcccgatctcaggtgatcctcccgcctcagcctcccaaagtggtgctgggattacaggcgtgagccactgtgccctgccgctagtcttctattttaagtatttagtggtaggtcccgggccggcagaatctattttcagcatttaccacgtgtggcgcgcaaaccacaggttttggcgattgggttgcgcgggatctcagagctgacgccgcgggggcggctgggggtcccggtttccgactggagccgcgacgaccccggcgacgcgagcctggggctgcagcgagggccggggagctccccctccatatgtgcgcgcacattctccagacttgctcaaactaaccccccggcagcgccagcgcgctgcgggactgatgatcaaatatttggtttccgagataacacaccccgatagcgctgtttcctgagccgctttcattctacttgtgtaacttgctgcgaaaacccgaaccaagtcaagacagcaaactcacgcccacgggcgctgtgtcaacatggaaataatgatactgaagccccacgctgggcacctggggcgtggactgggggcgcgggggaagcgcagatccgccttcatgcttccccctcctgataaggtccctggagttcccgggaggccattgtctgtacttaataataactaaatccaactagtgaaccaagcttcagcgagcaaggggtgggaggtttagatgccaaaataccttcaaaaaagtttaaattatactaagcagccagttaagaaggaagcagcaacatatgacctgatttagaaccatctccaagatgtatgaggtggaaagaagcaaggtgcagatgagtgggctgcatgtgtgcttgtatatcatcgtgtcctcctggaggaagacaccaggaactggagagagattttactggaggggtagagaggcgggggcatagctggggcttacggagtgggaggtggggtctgatttttcgtcgtctgcacttctgtatttgtgatttttttaaaacaatgtgtatttattaactataccaaaaactaaaggaaaattccaaatacatacatataaataatgaacgcagagctctgtcgccctcctgaagcctggggttagccagggccctttctctggtgggggatttatagcatcttcccttctgttgggtaccccggactcccactgaatgtgcaggtcccagtggctgccttcagagcctggctggaatcattaaaaaggtatttgtaatctctggcttctgcagaaggccctgcaaaccaagagcaaaaaagcccccagtgcttatgggccggcagtgtgggctaggccccggggctccctgtccccaagagaaagaccaggttgctcggagggtgcctctgggaactttggtgcgggctatttgctccccccatggcggcaggagcaagctgggacttgtttgggaaggccacagctgggtggttttcctcctctggctgtacatacacctttcaatccatttctttcatcttgaaaggacaaagaccggcttgtctgagcctcttaatcagtcaggctggctttgggctttgtgggaccctgactttctcaggtctagctttctgggacatcactccaaattagatggcagagtggcttttaacagagcgcactgaccttgttttctttctctctctgtccctaaactcgaggtcattagttaggtgaagacctgggctgcagtttggcgagacacttcctgtagatgcttctaatgttggcctttaatttctgctaagcagcagcacacaaataaatggcctgtcccttctatcctgttgtagcttggaatttctccataggagggacttgggggtggcagtagggttggagagggttggggggaggtgtaggagacttgtctggccactgagtttgctgagaaagtactgctatagtgtttttccttggattgcaaatcatgttgatctgtagtattcgaagttttctaaaggcaagtttattctcacaatttacataagagtgagaaaatatcacttgcacatatcaaactattacttcttattatggtgggagtttggcggggggggcatgggtgaggatcttggcagcctctgctgccccttcgccctgcactgcagagctctgctgtcttgcaggcaggcggcctgcgtgcgcgggaggggggacccttgcctgaattctgaaggcttttgcagacctggtgcatttattcttccttctgtctgccgccaaactggtttttgttcctataagtcgttcttggaattcaagttttttgccaggctgagcgggatctaaactagaggggaaactagaggggaatttacgacaaaaccaggtggtgggaatgaggactaaaggccgcaccttatgacaaagcccagcctgtaccataaagccccaggcaatgtgaactgagctgcctgagtgagactcccatcttcccagcctgggccccttaagttcaatggcaagatttgtaaactggtttggattaacaaccccgactcctctttgtagacttaattttggaattcaaaacagctaccctctcttaaataatccccaggcaatggcgactccgcacactgcatctagccatagcccgttaccattctttctctgggaagatccagcagctctgttaggaatcttgtaaagtagccggctggcactaggggagtggaagtcatcatgtttatctctggtccaggtaatgaaggcatgaaatttgtgtaatctttgaaggaaaagaagagaaagttggaaacctatcattattggagtcagcctataaaagtggcttttgttaatgtagctgaagagtagggagaaggccgtgcagtttgatttttgctttatgccatctggctgtcctttttgttgacaagtgtttggcattaagacctctcccactgcccgtcaagagcaggccctaccactgtagagtattagaaaaagattctgttacagtttaaaaatttccttcagggagtgcttcgcaaaggggagcgtggactgcaggcatttgcagctgtaacctggcttgtgttaaaatttggaaggggctgctccacattccagcactcggagcgccggccctcactggtgagcagccaaaggttaatatagatgtcacacagctccccccttctttctttctgcagagcgcctttgctataggagtgcaccaacagctgtgtttttcgtaaccctttcaaaatcacttcttttaaacctcattttcctgcttatataaatcaaagattttcctccacttttcccaagcatgtatgtgacccagctttgaacttttttcattttctatgtattttccttctggaatcaaggcagggtaaggctgagccctggatgccaacttgggtggctgtttttggttttggttccagggttgtcattcggttgtggagcggtccccatggaaggggtaacagagatggcccacttgcaaatcagtttcagggcagcaagggggatgattgtctgaatgcacagacagacgaaaccgcttttgagatgcagccctctcaagctacggtttggggctttaccatggcgtagtaggctctcaagcctttgccgagataaacacagctggtgcgcgatcccctcaccaccggaatgcctgcgatgtgagtgaatatcacgtgtccgctgaactcagagacaactggtgacttcattccagggagagtcccatctaagttgattgatcactcctatcactttaatatctctccctcatttggtaaggtcatatttggcccattgcaagaatcagcgtgccctaagtctcccccgtctccacccttccccatctgcccatccgtgtaacagcctgaatattttgaatggggagccctttgcaccatgcttctggccacattaattctttcacgctcactcttcagtcttagcgggggggctgttggcacactggtttcttggcaagccactgcaaggcttcgccttaatgcactctggcactgtcaccggggttagggcacaggcagggatgtgtgggacctgtcatgttattgtcagaaggaatgtgcggattagcctttacagcgtagtggtgggagagcactgcagctgtgtacacttattataaaagatttaagtcccactggtaaaatcaatatattgaattgcacaaccctctgcttttaattagtttaaatcaaatgcgccggtgccattttgccttctctcgccttcatggggtgaggaactaccaatatttacatagaaactgttaatttgtggtgaaaatgataacacatttagctttacacactcaaattgctccaacttgatggatcccagatcaacgtggagttgagctgaggagatgacgtcaccaggagcggggaggagacacccgtgatgtctgttgcttggaccctggattccagatgcaggtggacatgtgtgtagaggcagtgactggggatgctggtccttcaagaagcgagctggttctttctattgcaggtcaaaaacaatgagatttacctacatcatctaaaatcctttctcggaagcattcttacaaaattgcgaagtgggcacttgctcttgggtcattttgagcctgttctcacagcatgcaagggtcatgtactgggcagctcaaggcacggtgctttatttattccagagcttcacatgcttttctttccaatccctgaaacagtttatagaggaagggcgtttgttcactgcaaatgatcccatgtacgaccgcggctattagtgagccgtttggtattagctgtgtgttcaagctgggattgaattccgggttttgcagcaaatggcatctgacaaataataattgacaaaaaatgtgacttggtatttcttaatatggaacagatagttcatttaagcttccccggcaaaaaaaaaattgctcaaactcaaactgaaatagcaatgccagggaatactaggactgctgctgtgtatttttttccgctccaaagtagagtgtttatgatttggggggatattagagtgcatgaagtttgacacttacttatgcgaaactcaggcaagcatgtgcaataccgccttttcaacatttgtgtcggaaggcattgtggggagccgcgcaaagcctgtgctgatccgcgtggagtggattgaattaatgacaactccgagagcaccagctttagggtaattgctttattgttttggagccagggtgcatataatccggttcctgtgcaaacatgttgaacgtgtgttaatgcatttccaaaccagagcctctcacacaaccctgcttttcattaattgatgtcggtagcatggtacagtatttcaaagggctggccaagtataaactgtgtttccaatttccttcctttcctgtgtttggaatgccaatgttaatttgttcccatgcaggagcgggggctgccaaccgcggctttctataaagggcttcacagtgaaggcttccagccctcgctgatgcttggggctgcctggccaagtctcctgacactttgcagctaattctgggtgatatatggggtgggggattgggggcttcactgccgtgtaacggaagttctcggtgacagcagtgggtgtgacttggcaagggagattggaacggcatccacagtgattctctttagacacagcctaaacctatgtgtctgtttccactatgacagcacattagctgtgtgaccttgggcaagttacttaacatctctgcatttgtgtcctcattttataaaggctacaagagaatctcttcctcaacagattctaaagaaatagaaatcatatcacccatgcgcagaggctgtcacctagtaggtgtaaaacaaatggtagctcttgtttttattgtgttggccagatgaagatttacgttggtatattagtccaaatttcagtttttaagtacttaatcttaaaatactgagattaaactgcccatgttattttaaatgtcaagaaaatggtccccagagtgtgaatatgtgtgcgcctccctctttcagagatcaatggaatttgaatgaatgcaccaaacttatttgaggatgaatagagtctaaggctgaatcttttccccaattttagcatctatggttatttaatgattttactacttgggaaactggaactcagtgagagggtataccggaactctctgtagtgcctttgcaactttgaattaaaaattaatttcaaaataaaatgtttcatttaaaaaattgcattattgaagtatttcttcccaatcctttctggaagatggtcaaagtacaaattgtcttttccttcaagggagtgacaagcccaaagcattcattaacagaactgcacaacttccccactttttattggagcaggtgcaaggctgcccaaggctcccgcagctggggttaggctgcaacaacaaagccctgtgtggattcagcatgtttagaagcctctagagaccagaggacgaaagagaatggcttcagggccagataccgaggggtggcgtttctcattcaagactttccataaattcccttcagctctttatactgtttgaaaaatccgactcaccaagtattaggtttccctgcatctctgaggtcacgtgttctatcacatctttatctccctggagtagctttcaagtttcaatcttttgttgcctggcttaattaaaattggccacgaataaaaacttgcaccgtttccaaaatcgaggacttgtgtgtttctaagcattgggtttaggcctgccctgtcttgtgcttccagcctgtcttctgctttcatgtagcttggactacatgaagaaaaagaaaaagctaagctcttagcatgacagttggcatataatggtccaagtgctcatccccctggcaacttacacacacaaaggcaggcaagtttttttttttttttttttttggtggcttgtgttttggccttcaataaaggacacttttcctgttttttttcagacagccttattctcctgcccatgcacagccttgcagaattctcatggcatagaaggtgctcagatattggttgtttcggtgcacatatggcatgaagacattctaagcagtctcttctaaatgcttttgatctccaattcccactactaccttttcaggtacataccttaaatagtaataagttgtataactactgcaggatagctaggatagcttgtgcttcataaaacatagacaaaaatagaaatttaagtaggagacactaaagctaaaagcaatacaaaattttggtgtttgttaattaatacaaattttaactaatgaatcattttaattttaattgttaacacaattttaattaacaatatacatttaattaaaattaaattttaatataatttaattaagtttgcagtcatgaaaatttgcggtgcaatggactgttctttggtgttttcaaaatcatgatttaacagtttagaatcactgatctaaaggcctggtcccaaatttcgatgacccttcatctggtcagtataaatgaagttattgtgtgtgaagaaactcacaatcttggtgcgttaaaaatcccagaagtttgtttttcatttgtatcacattatagctctatcgtgggttcagggtggaggcgtggagttctgcacattggtggcagcagagtccctgggagaggctgaggtcctcagaatgttacgaataaggtgccagaaggaaagataatgtgaactgtgcgttggcttttaatatttctacctgggagtgactttctaacttcaaaaatttctatttttgtctgttttatgaagtacaaatgatcctaactagtagttatacaacttatttctttttttcttttttttttgagatggagtttcgcttttgttgcccaggctggagtgcagtggcgcgatcttggctcactgcaacctccgccttctgggttcaagtgattctcctgcctcagcctccgaagttgctaggattataggtgcccaccaccacgcccagctaatttttgttatttttttttattttttatttttagtagaaatggggtttcgccatgttggccaggctggcctcaaactcctgacctcaggttttatccacccgccttggcctcccaaagtgctgggataacaggcgtaagccaccttgcccagccacaacttatttctatttagggtatgtaccccaaaatttactcttccacctgaaagagcttctgctcacatttcatgggccaaagtgagccatgtggccaaacctgacccaaggttggcaaggagatgacgataccactgcttgctcagaaaggcaaagcaccagagagcgtccaggaaatggcacagatgacaccacgctatcatgattgaagtgtctctcacaagattcaaagacagaaatgtgggaagtaagttgtggggtgtgttactgaaaccagagcttcatttttcaaccccacctgtcaattatgcagatatttttgttgaagctagtgaactcccatgattgtcagttggaatttgcataacaattataattgtaatatatcttttcctgactcccagtgggttcctcttgcctcctcccatcttgcgcttcattttggagactgatgttctggaggcttccatctcactgaagtactcaattggttcaacaacaataacatctctttccattcccacttgtaaagtgacttccctgtttatgacttgtctttcagcaaaggcaagcttcagcttttgtccggttcactatctagagaattaagaagcattactctgctcctggctaatgaggtgactgctggtgtttccccggaagatacaggttatcacttcgccatgaaatcttgtccacaatggaagagctgcttgctttctctcctgggccttagagacattcctttttctttctttctttttttttttttttttttttttttgagatggagtctctcgctatcccccaggctggagtgtagtggcatgatctccactcactgcaacctccacctctgggcttcaagcaattctcctgcctcagcctcctgagtagcagggattacaggctcccacaaccacgcccggctaatttttgtatttttagtagagacggtgtttcaccatgttggccaggctggtcttaaacttctgacctcaagtgatccacctgcctcagcctcccaaggtgttaagattacaggcgtgagccactgcaactggccccttagagacatttcttagtccaggcaggatcttgcataggctgaatctagacattaaattcagagaccccttcatcatctaaatgcatcactgaaatggattgtagacctcagagggctaagacctttctgtgtagcagcaatggattcagagtagccatctttatggggccctcatgcagttctctcagtattctgcagggtaagcagtgtcatttccattttagagaggaggatgctgaaggggcccaaacatgcacagctaggaagtgtggggcagatgtgtctgtccagctcttgctgggtgcagagctgcccattctttcctcctgaacctgtggggtatcgaataggtagcggggagcgtggaggagatgatgttgagaccattaaaacagaagccgagcccatggccttgactctgtggtcccgtgttctgataagtgacatagagataagcaggcacacacctttcccttctgttatccaccctgcttgtgatacctcccctctcctcggtctttatggtttaaaaataattgtcagggcatagggccctgagtgcctgtggggggcacctacatgtaccccataacccctccatggggaaattccatagccagccagagattggtattttaatagcaattcctcaagatgctgtataaaaaagaccacagaaacagtttttttccgtatgtcccagcatgcctttgtgtacggtctgtagtattgtaaactccccaaaatcaaaatgtgcatgaacaggggattcgagagagaagcaggtgtagctctgggaggggatatggaatagtcgccccagcgcagggacttctttttgtttttgttttttgtttttttttttttactgtatcaatgtagactggaaacaatgtcagaaggagaaagcaagtagcagaaggatgtttaggatgtaaccatttgttaattacacacataggcacccccgcccccaacctcccacacaaggggaccaactcataaatgtattgtttgtgggttcatacacattgcagtaataccatggacacatgggcaggaaggactccctaccttcagggtgagagctgcccgtggggaggagggaaaggatagttttgatgagagtttcaaataaatctcacctatttctgtcaagttttctgtcttttaataagaagaaaccaaaagaggctgggcgcggtggctcacgcctgtaatcccagcactttgggaggctgaggtgggtgggtcatctgaggtcaggagttcgagaccagcctggccaacatggtgaaaccccgtttctactaaaaatacaaaaattagtggggtgtggtggtacacacctttagtcccagctacttgggaggctgaggcaagagaatcgcttgaacccgggaggcagaggttgcagtaagccgagatcacatcactgcactccagcctgggtgacagagcaactctgtctcaaaaaaaaaaaaaaaaaaaaaaaaggaaagaaaccaaaagaaaatacaatgtggtatcctggactggatcttaggccagaacaaggacatctgtggaaacactggtacagtctgaaacaaatctggagtcgagttgacagttacacagcaatgtgaacgtctcggttttgtcaaatgccctgtggttgtggaagatgttcaccctgggaggactgggtgaagggtactcaagtattctctgtactagctttgcaatgttcttataaagttattctaaaataaaaagtttatttattttttttaaaggaagcaactatgatgctacctctcatcatttctctgttatgggtgcatggatgtccatgagctcatccaccagctgctctttgtggtggtcctgccatttccaaggctgggggcaggagagccagtcctagagcctgttcagtatgatgccctgaaggccaataacgaatcaatctacggacccattaacacgacagggactcagcaagtaaaagaaaaacccacaggacagtgccctgagaactttaaaactctcttttcctcattcataaggtgcccgatataaagcagctgttagtttatggtcaagaaagagggggtagggtgggaggagatctaaaagatctttcgattttcttcttggtcctgaattttgtaaaatgccccctactccattccccaatcttcccacttctcaagtttcagtttttgactgacttgacctaacatttcttgagagagaagcccttaaaaatggcagcagggcctcagaaccttccaggctagtaaatgtttatgggatggaggcactggttggtcatttcctttaggaggaaacaataaatgaagctacttgccttatgcctactcaggccctgagctcctaattatcttaatatactggtgggaagtggggatggaagggggtgggggacccagaaatctctgcgcctctggagcttggaagtgccctttttagtacgtttagtgtgcagtttctcagcctgggcactattggtatgtttaaccagatcgttctctgctgggagctgtcctgtgtattataggatgtttggcagcattcctagcccttcccccaggatctgacaaccaagtgtatctccagacattgctaactgtaccctggggggcaaagttgcccccagttgagaaccactggtttagagtaacttgcctcaaccttgggaattcatctgggagccttagcctcaaacgcactgacccacagtggtgagtgggaaaaacagcatttctagatggacgggttattttctggctgaaagaagcacagattgcaatcaaaactcgaggcttctcctgggaacacagctctacctggctttgaaacaccctggagactgaaatggagctcaagtctctaacgagcaagcattgtctcctgggaaccaaaatacttgactgcaccttttgctcgatgatgctaaaagtttattaaacacacatcgaggactggcccctcttttatttttatcttcggacgttcctcaggaagaatagggcagatctctctcttaccttgttcccctctcttggcaggtaacttactctggggtgggagagggaaggtgagcacagaagctatattttcccgtgtctccctgtagcttaaatgctgcttggagcagggagacctgcttgcttcagaccccagcccgcgggccaactccagcccacaacctgttttagtacagcctgcaggctaagaatggctggtacattttttaaaagtgtgataaatactcgagaagaatcatatttcatgacactaaaatgacatgaaattcaaatttcaaggtctgtaaataaagttttattggaacacatctatccacttacgcattcactctgactgctttactgccgctgcgacagggttgagcagttgccacagacacgatggtgaccgaggcctacaatagtttctgtctggctcttcatggggtttattgatccctgctttccacacgctatgtcccctacctgggaaagtgcaaaaagtaaaaaagcctgagttttgttttgttttgctttgtttttttgagacagagccttgctctgtcacccaggctggagtgcggtggcgcgatcccggctcactgcaacctctgcctcccgggttcaagcaattctcctgcctcagcctcccgagtagctgggattacaggcgtgcatcaccacgcccagataatttttgtatttttagtggagacagggtttcaacatgttggccaggctggactcaaagtcctgacctcaagggatctgcctgcctcggcctcccaaagtactgggattacaggcgtgagccactgtgcccggccaaaagcctgagttttttatctgtcccttttgtccttctgcagacagtgactcagccacacttcctgccccccctccatgttcactggagctcctctgagtctgcgaaagctgtaggttaaaggatgtcccctcggaagactcctctgcatctttaacatgaggcatgtgctctgagtccccacaagggtgatgtcgaacacagggaggcttttcctgcgtttgcttggtcccagcaccctgttctcctgtgtttttgaaaaaattctaaaatgtctcagatggtagttaagagtttgggtctgagtcagaccgtcagactgcagagcccccaccgctctgcccccacctccccgactcaggcaggttgttaaaccctgggtctcctgtttcctactctggggttaatgtgggtgcctgtctcctgggctgctgtgaagatcccatgtggggagacaggaagagggctgacctcgggccgcctgcagctggtgcctggggatgtcagtggtaggcagtgatgctgtcatttgctacaccatagccaatcaggaacccaccgtgcacgggacctgcctgtgccctgagctcagctgctctgttacccaccgtggtgggatgtgctgctggtttgtgctggggtccagagcaggcagtgggcacggtggcccccaagccgtgtctccacaggacttggatcagggcagctggccttctctttgcgatgatacctcagctgaaatgggaggcttgtcggtgtcgactggacacaggcaaaacaggaaactgggtgtattttgacgaatcctgttatactagaaaattgcctcctgctgattaagatctgtgtttattggtgcagagttttaaggagacacccagatctgcccacccttgccggctgggggcacaggcaacctgctgggtttagacagttgactgtgggctggcctactccaaaaaaagcacatcaataaaactttcacagtaaagttatatatttttcttttatttctttgaacaccattcatgtcagacttagtggggtggcatttctgtgtttccctcactttttgatatgggcaaatgaatttctcctttttttttttttttttgagtcagagtcagggtgacaggttctgtcatccaggctggagtgtagtggtaccatcttggctcactgcagcctctaccacctgggctcaagtgaccctcccacctcagcctcctgagcagctggaactacaggcatgtatcaccatgcctggctaattttttgtgtgtgtatatatatctatatttaatatagatatatattatatattatataaatatatttatattaaaataatatatttaataaaaatatactctatatatatttttgtagaaattgggtttcaccatgttgcctagactggtcttgaactcctgggctcaagcagtcctcctgcctcagcctcccaaagtgctgggattataggtgtgagttactgcacctggcccatttcttcattttaagtgaggaccagcccatgccagatgttcattaaatagcatgatttcaacatttatttttatgtatgtgaaaatagggtcaggaatgacaaattactcgccgagctttggggatggcaagtctgtctgtctttgggtccaggtcactggtgtgtgtcctcaggcaagttactgaaggggttggagtgctctgggcctcagtttccctctctggtgggtggctcaaggctcaggacactaggattgagtgagatcatggcaggaaggggctcagtcctcacctgcagggaactctcagtaaacagggctgctcctggctgccttgggggtccagtctcgctgcagagcctcttctaggctcatccgtgaacatgacagtagaccaatatcaatggagaacatgacaatggcctgatgatgttttagttcagcagctgtaattcattggagatgcctggaagtttgtgactaaatacagccctcatatccaagactatacacttccctgagtaccttcacatttcaaacattatatgtatcttatttactcaactcccatcatagattttgaaaagaatccgggacatttgaaaaagtgcgatgcagtcacccctgcatcaggggtaggctaaagacagcaggtaggacagacattgggtagagtgggaattacctttgaatttccatgggaagctgtttcgttatgcagtatctccatatggctgagttccttctcccagtttctctcccagtgttgcagcagatcactgcttcttccgttgcacatgggatgaaataatctgcttgagtgtaggacctgtatcataccaaaacacttgccttcaaacactagaaggtaagaagtttggtatgatacaggtcctacacttaaggaccctctgggtgttatacttacacttaaggacctataacaccctctgggacagcagatactataagagatacacatcctaatggccactacctgcttctgtggagaggaatggtgtttcatttagaactcgttcagcagtcagccgggcgtggtggctcatgcctgtaatcctagcactttgggaggccgaggcgggcagatcatgacatcaggagatcaagaccatgctagctaacacggtgaaacatcgtctctactaaaaatacaaaaaaaaattagctgggcgtggtggtgggcacctgtagtcccagctactcaggaggctgaggcaggagaatggcgtgaacccaggaggcggagcttgcagtgagccgagatcacaccactgcactccagcctgggggacagagtgagactctgtctcaaaaaaaacaaaacaaaacaaaacaaaacaaaaacaaaaaactcattcagctgcagttcacagaacacctgcctagcatggcttcagcacaaaaacatgtcattatctcctctaatagcaagtcttcagggagatgagttcacgtttgcaggggcagctcagtgatactgtccaagcatccatgagcttcccacctccccctaccaccatcctcaaattcctcatgtctcttacctcatgcttacaaaatggctgctgccgccccagccagttcatcctcatgcaatctcacattcaaggcaggaggatggggaatggcacaaagagctctccttgcctgcctgcctacctcttggtttcctagaagttccttggaagacttctccttgtctcttgggctaaactgtgtgtaagcccctgtcttgttacttcgagggagggtgtgaatgtatgcagctggcatctggccagcacagtgggaggcaggggagggaaaagtgggttggcagtggttgttgggtggccacattcaaatgattgaaatggtttctctctccctctttgtcgttgtttcctgtgttgtatacagttagatttacaaaagttatttgtacatgtgatgtggttccactgtatgcacatataaatagaggccctaagcaagcttccaaagcctccagatgatagtgttccactgtgaatatatacagaaggttggttgcacattgacattaatttaaccagaccctctgtagctcatagaaagattttagttattctttaaactcaaacctacctacaggtaggtacattagctctaactttgaggactatatagaactctagccaacagccagttgtttgctgaaaacaagctttgttttattaacataaccctcctgatctcctgagataggggcaaaatttcttgaaaatgacccgaggaggtcaggaattattgtcccctgggaggaagcagaggctggggtggagcttggtttgagttctgcttgtgggacaggcggctcctgtttcccctgagtggaggatgaacagagcaagagactcaaagcattttaagaatctgtgtcagtgtttgttagccaagggtggagagctgcttgaaagaaacgcctgcctgccctggtggaatggtggaacctcatgcttacactgggagcctgatcaaatgttttctagtaaagggttctgggcacctatatgccttctgcttattcccgtgggagactaacgtgatagggtctgggtgcctccttaagcccgttggttggaggagatgattaggggagaagctgagaggtggttctgaaaaatattttgctttctattaaatggctgctgagcaaacggaactctctgttctcgtccccattgtcttgccttgaatgtggttttgtgaagacatgttgcttggaaccacagcagccatcttgtgactgtgggacaagaggcctaagaattaagtcaacatgcagacaatgatggagcaaagaagacagaagaaattggggttcttagtcatatgtttgaactactacattcaactacaattgttggggggaggctcttaagcagtttgaatcacatgttcactcatgaatcagttgggtctagagggtagaccaggctgcatcaacacagttgctggagtcagcctctggccctttgtgcctgggctggggtgtggaggtgtgtctactatctgattacagctatgttagccattgtaataatcatcccagtagtgaacatttgtcaaaggcttactatgtgccaagcaccctttgtcctcttttggtttttttttgagatggagtctcgctctgtcacccaggctggaatgcagtggtacaatcttggctcactgcaacttctgccttctgggttcaagtgattctcctgcctcagcctcctgagtagctgggagtacaggcacgtgccaccatgcccggctaatttttgtacttttagtagggatggagtttcaccgtgttgaccaggctggtcttgaactcccaacctcaggtgatccgcccacctcggcctcccaaagtgctgggattacaggcatgagccaccgcacccagcctgtcctctttagttaatattaacatatttaattttcatgacagccatttcaggtggggcagttattatcacccctattttacagagcagataaatgagcagagagcggtagttggcccaagaccacatacccagttaagcatcattggatttggagatccagttcctggagacttccctcttacacttgatcctgaactgcttctcaagcctgaaggataggtttggagcaggccagtcaacagcattgctaattggagagtctcacatgagggcaggaggaagacacataggggttttacagttatgtgtgtcaggcctaatgccctgtatctttgcttatcaaagtttctgaaaaccaggatgtatttaaattgattaagatattggtatattttcccaaagagcttctgttgaattgattgtgcctcttagtatggtgacaagcgtgtgttgagtagacctggcaatgggtaaagctaacaacacttattatgaataaaactgctaattgagttttaatgaaactgcttattgaggtgtaacgtgtgcagaacagcacagaaatcaagagcacttgtgagtgtttacaaggcaatcacacagggtaaccagtgtgtagatcaagaagcagaagcgaccagaaccccctcgtacttgtacccagcggtaactattgtcctgttttctaatagcataaattaaccttgcctgtttctaaactttatataaatttaattgtacaataatactgttaaatcactaaccatggccgggcatgctggctgacgcctgtaatcccagcactttgggaggctgaggcgggcagatcatgaggtcaggagatcgagaccatcctggctaacacggtgaaaccccatctccactaaaaatacaaaaaatcagctgggcgtggtggcgggcgcctgtaatcgcagatactcgggaggctgaggcaggagaatggcgtgaacccaggaggcggaggttgcagtgaaccgagatcacgccactgcactccagcctgggtgacagagcaagactctgtctcaaaaaaaaaaaaaaaaaaaaatcactaatcacaggagcaatgatttggaaagaagaccccaagtagaactttttggagtctgtttgcaactcttccagttacatttcatataggatacaaaatgtaatttaaaaaccattctctgggccccgtagggtgcctcatgcctgtaattccagcactttgggaggctgaggcaggaggatcacttgagctcaggagtccaaggcttcagtgagctgtaattacatcactgcactccagttgggagtgacagagtgagaccctatctctataaaaaataaaaattaaaaaaaaacaccacttttttgttttgatctcatattctcctgcttcccacaccggaaagaggtttaaaggacaaccatgcaatttgaagggtgttttgatcgtttagcttagggatttaagtttgagttcttacaatgtgaacttgaaatgagtgaggctcttcaagatttccagttcccaccaaatctgccccatcagcccctggggcggcttttgtacgtctctgcaccttcctgttttcagaaatgaagctgattactgtggtccagggacagagtgtggctttaaagaagactcttattttgaaagggagacaggggctgggcatggaggaaaggcagaaccatcttttccttcactgcacctgcatctcctgggcctaatgagtttaggctgatggaacccaggcctcaggaaggattataaattctcatttgatttgatttgcctctaaaataccttaaaccagctgtgtctgcccagctgacccaagcctctctggctgctctggggggaaggtctgagcaggctcctcctgtcctggggaagggagggaggacggcagcttcacttcccccacctggctgctcttggggcctgctctggcctggctgggagcaggcaaggcacaggtctctgctgccctccctggtggccagcctccatgtccttgaattctcccaacagccccagaactgggggcctctgcctgtccccattttatagagagaaaaagttgagccttccagaggtgggttaacttgtcctgggtcactgctggtgattggcagagcctgcgtgtgaaccagacctccaggccccatggcccacgctcaaccccagttctctcctgcatcctgggctgagtaaggctaaggagccggtgtcttcctcctgatttgctcacggggagagtttcaaaacccacttcactaagtctccggagaagctgctgagtgcccagcaagtgagcgtgggaggtggtgtgtgaacagtgctaagcaacagagcaatcagagcgaatagcttccaagactattacatgtgccaggcactccatggacactctcctttcctctggttctcaaagtggggtttctagacctgcattatcaccatcacctgggcatgtgttagacattcatgctcttgggcccaccctagatcacccaccttagacatgctggaagtggggcccagtggcctgtgctgtaataagctcgcgtgtgactctgggcatcctgaaggtggagcatgcctggtctactttactcctgggctttaactggcagcccagtggagtcagtgctattactacacctgcatttcacagaagaggagtgacgcgccccagcaagtggcagagccgagactcgccctctcgcccggctctgctctggaaacctcctgagtcctgctcctttgctcagttcttactttcctggagttaaaatctagaagagaggacagtggagaaacaggtcagcaggtctctcaccaaaataatcccagtagttaggctatgggagggaaatgaaaggggctgagagggaaggaggcccagggagagtgtcagtgggggtgagaccaactcagccgtggggaggggctgcggtgcccgggcaggcctggagcaaagcctctgcggtcgtgaacttggcacgtctaacaattaccagcaggataccactcgccaggtgcttggtggggagtgtttgctccctaggtgaccccatgagcagagtgaggatccttgtacctgttcaacagcccccatcccaggcctcaaacccgtaagtcaggagttaaattcctgaatttctcacactgggaacgccatttcattaatttttttaattattttttttttagggcagagtcttgctgtgtcacccaggagtgcagtggtacgatctcagctcactgcaacctctgcctcctgggttcaagcgattcttgtgcctcagcctcctgagtagctgggagaacaggaatgcaccaccacgcctagctaatttttgtatttttagtagagacagggttttggcatattagccaggctggtctcccggactcaagtgatacacctgcctcgacctcccaaagtgctgggattatgggcgtgagccaccaatcccacagttttaaagaaaaactttctcctacatctctgagaacatagtcggggaccctcatttgcagtggccccctgcaaacccttggtgctacaaagcagtgtgggcgacagcacctcttcaatgatggggacacctgtgatctgggctgtccactaggaaggccatgagccacatacagctgtttagattttattttattttttgagatggaatttttgctctgttgcccaggctggagagcagtggcaccatcttggctcactgcaacctccgcctcctgggttcaagtgattcttgtgcctcagcctcccgagtatctgggattacaggcacgtgccaccatgcctggctaatttttgtatttttagtagagacgatgtttcagcatattggccaggctggtctcaaactcctgacctcaagtgatccacccaccttgccctcccaaagtgctgggattacaggcatgagccactgtgcctggcagctgtttacatttaaattaattacaatgaaatacaattaaacattcagatctcagtcacggaagccacatttcaagtgctcagtagccccacgtgtctcagtgtgctttaccagacagcacagatagagcctccaagctgccccgaggtgttagggtgaaccccatacaggtcaaaactggtagagtatcagcagctttttacatggtacagtctaataggcgagaaaagggacttcagagaaattcagtcctttcctttgttatgggaggaaactgaggcccagtgagcctggggttataccagccagctcacagctcagatgaggccaaaccccaggtttcttgaccctcttgagctctgcctgtctgtcggtccagatcaaggactctcaactcagcactagtcacatttggggttggatgggggaccatcctgagcattgtgaaatgtttagcggtgtccctggtctgtacccagtacatgccaggagcaccccctcctaagttatgacaaccaaaaatgactccagacaatgcccagggtgccttcatgggagtgaggggaggacaaagtcagctctggctgagaatcactggttcttttccctcaatttcaatgagctgaggatggggttggaacccagacatccctggagactgcgttcctccctctgggaggtgggaagccgtaggccagggggctgtctgggtctatagtagaaagagcaacatgtgcttgcggcccatttttcttttcagctctacgggcatctgggtctttttaggcaaagaactggcctcagctctagagataattaaacccatcttttttccctctccctgccccatcccctaaaccctttggttcattcaattcacaatgataacattgttcaagcaacactgcacacatgttgacattgaagtgtttaatcttgtggtacaatcattccctctggcccctaccccaacatctgtgcaggctgcaggctcagggctcatgacaagaggatggccaaggagatgcctgcctgtggtctcgcctccaggtctcatgtctctggacgcagccccccagcacctaacaaggaggcagtgtctccaaagaccctcttggagagccaggcgggtaggactccaggtggtattgctggcagctgaagcatttggtggaaagttcgagagttgaagcagttcaggaacaggggagacaatgctgcctgtgtgccctttgccaggcagggccctgccccccaatctgggggcctggggaggggtaatgaggagatgggtgaatgctacaaaaccttcaggctgtcagcctccctccctcaaggactggcattaggcaggagcaaaatttacaagtctgagagggagctgagtcggatgcagaaccttcactttgagtttagctttggagatttatgtggcgagtgcatcgagtgtgccaagagcagagcatggttcagctcagagctgtccttattgaatcgttgccacagctaagaggtcactggcagctcccatgtgaggaagagagttggtatggctgagtggggaagagtacgggcctttaaagattcagatcagctgtgtgaccctgggcaagagtcagtctgagcctcagtgtcctcatctggaaagtgagcacgatgtgtccccctgcctctgagaggggttttcataaggattcagtgagatgatatatacatgtgaagtggcagccaggccagtgggagggcttctaaaatgctggctgcccacctcacagccatcaggatggtcactgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaactgtaagtccaattaaacctttttcttcccagtctcgggtatgtctttttcagcagcatgaaaatggactaatacattaattggtaccagtaaagtggggcattgctgagaaaatacccaaaaatgtggaagtgactttggaactggctaacaggtagagattggaacagtttggaagactcagaagaagataggaaaatgtggaaaagtttggaattgcccagagacttgttgaatggctttgcccaaaacgctgatagtgatatggacaataaaatccaggctgaagtggtctcagatagagataaggaacttgttgggaactggagcaaaggtgactcttgttatgttttagcaaagagcctgacggcattttttccccaccctagagatttgtggaactttgaatttgagagagctgatttagggtatctggtggaagaaatttctaagcagcaaagcattcaagaggtgccttgggtgtgttaaaggcattcacttttaaaagggaaacaaagcataaaagttcagaaaatttgcagcctggctatgcgatagaaaagaagaatccattttctggggagaaattcaagctggctacagaaatttgcataagtagcaagaagcctaatgttaatcctcaagaccatggggagaatgtctccaggccatgtcagagaccttcatggcagcccctcccatcacaggcctggaggcccaggaggaaaaagtggtttcatgggccagtctctgggtccccctgctgtgtgcaccctagggacttggtggcctgtgtcccagccactcaagccatggctgaaaggggtcaatgtacagcttgggctgtgatttcagagggtagaagccccaagccttggcagcttccatgtggtgttgagcctgtgggtgcacagaagtcaagaattgaggtttgggaatctgcacctagatttcagaaaatgtatggaaatgcctggatgcccaggcaaaagtttgctgcaggagtgggtccctcatggagaacctccgctagggcagtggggaagggaaatgtggaattgggactcccacacagagtccctagtggggtgcagcatagtggagctgtgagaagagggccactgtcctccagaccccagaatggtagatccaacagcttgaaccgtgtgcctggaaaagccatggtcactcaacgttcaatgccagcccatgaaagcagctgggagggaggccgtaccctgcaaagccacaggggtggagctgcctaagaccatgggaagccacctcttgcatcagtgtggcctggatgtgagacctggagtcaaaggagatcattttggagctttaaagtttgagagccctgctgaatttcgaacttgcatgggccctgtaacccctttattttggccaatttctcccatttggaatggccgtatttacctgatacctgtacctccattgtatctaggaagtaactagcttgcttttggttttagaggctcataggcagaagggacttgctttgtctcagatgagactttggactgtggacttttgagttaatgctgaaatgagttaagaatttgggggactattgggaaggcataggtggctttgaaatgtgaggatatgagatttggaggggccaggggtgaaatgggtttggctgtgtccccaccaaatctcaacttgaattgtatctcccagaatgcccatgtgttgtgggagggactcgggggaggtaattgaatcatgggggtaggtctttcctgtgctattctcatgatagtgaatctcacaagatctgatgggtttatcaggggtttcagctttgcttcttccccattttctcttgctgctgccatgtaagaagtgccttttgcctcccgccatgattctgaggcctccccagccatgtggagctgcaagtccaatttaacctctttttttttttcctggtctcgggtatgtctttgtcagcagcatgaaaacagactaatacagtcaccatcaaacaaaacaaaacagaacagaaaatcacaatggtggtggacatgtggagaaattggaacccttcccgactgccggcgggaaggtaaaatgctgtagccactatggaaaacagaatggtgcttcctcaaaaatattgaaaatagagctacaatgtgacacagcgatttcatttctgggtatgtccctgaaagatttgaaagcaggatctccaagagatatttgcacacccatagtcacagcagcattactcgcaatcacaaaaatgtggaagctgcataccattcagggatgaataaacaaaatgtggcccatccatacagtggaatattattcagccttaaaaaggaaggacattctgacaggctacagcacggatgaaacttgaagacattttgttaagtgaaataagccggtcacaaaaggacaaatactgtgtgattccatttataggtgttgcccaaagcagtcagattcatagagacagaaagtagaagggtgggtgcctggagctggaggagggaggaagaaaggggagttagtgtttaatggggacagagttttggcgttgcaagatgaaaaaagtcctggagactggatgtgcaagaatggtatcccgtgtgtttaaaatgactgaactgtacacgtaaaagtggttaggatgttaaattgtatattctgtgtattttaccacaattaaaaataaaagttttaaaaaatggtggctgtttacctggcttaggtgttccataggttgtcagggctgcaatctaagtgagcttctatgaactactcttctacagtacaactgacggctctcacgtccatgctggggcagccagaaagtccttgttgaatgagtacagtggaggtgttatctgaacaatgtgtatcattgtcaacttctaggcgatgttctgtttctctgggcatagagcattctcctcccttctcccaagagctgtgtgtgtcagtgtggcctctccaggctgctcatgttattaagagaacattttcctgttagagtagtcaggtatgtctgttccactttccagaattcccaatttattgcatgcctctggcggctttttcaagctccttaatcttgccatgtaaatctttgaatgaatgaatgaagagccatcatcaaatttcacatccctgaaactgtgggtcgtaaactgcctcctaacagcagccgggataagtcagctccagtgagttctggtgtgtgccagaaccttccagatgagctgtagccctccagggaaagagcgagccagggttggtagtttcagagttaaatgggtaccggggacgttccgggatatggggccctgagcagtcctcgggtctgtgaaaacccagttctgacttctggttataatgtggacttcgattagttcttttagccccttgagcctcatcctcattaaagtggggtgtgggggtctgtccccggcccctaactggagctgaagaatgctttggactagtctgtgctcacagaaaccagactctgagtgaggaacatggaattctaatgctggacttgtggtttttgcctggaaagcatccctttgctcataaaatatttgttcctgcctcatagtttagcggcatctttgggggcagtgagagggccgcatagtctggaaggttaaccaaattttttctgaagaccataaagttttggaaggagctgctgggtgattatttactatccatttatcaactctttccagccctggctgggagaacggcttcaggaggaaatgaaggcggctttgcctgggctgacggttccccttttcatggatacaaatatctttcatgtgcaactggccacagtcttgctcgtcaggtgttttttttttttttatgcatggctgtccccatgagagctgcttcctgaggtctctgagcaaccagtgaccaaatccagtgaatggtccctggaagaggggtctccctgccccctttctctgaatctggccactgttgcgccatcttgccctgccagtcctctggtccttcccttcctttggaccaagtccttctggtggcatcgttctccccctcccaggtagccccaaatattgatccaaggccatgctagtctttctcatcataaatgcatttttcgtgcataactttatccataaacccaattcaacagctcccagcttgagcattcttgccagggttatctaaacctctttttccaactgtccagttgaacattctgcaggtcatctcaagtttcacctgtctgcagccacacgtgtttcttccctaccacttcacctcctgagcgctctctcctgtgttgatatctactgatggtgttatcgccctcctggcattccaggccggcagtgggcagcatcctctagttccccctcttcatatgcttgcttttaatcaattgtcttgttccttcccctagagaagcacttctggtccattacacttctggggtcctgacaagagatggaaaatgctgacatcttttctcttgagccagtcaagattgatagtggctgcctgggtgccagaattaagaaaggagtgttgccattgtttagtgatgcctacctcgggtgccaggagggaggaggagggtgcatgtactgggtatgcatcatctctgatcagagcctcctctgagctccctgcctctgtcctcactccctgcctctgtcctcactccctgcctctgtcctcactccctataatccactttccacagggtcaccagtcctctatctaaaatagatctggtcagggcactgctttgtgtctaacaagggaccaagccatcatggttgatgacatcaatgatcaaccccttagcttgacattcaagcattttcccaatgaggaatttgttgcttttttcttgtcgttctcagcaaacttcttacctaaactccccagcatgccctgtttcttgtctgtcgagccctcgatcatgctgttgcctctgcctacagtgcccttccttgtcctctgggactagtgggcctccgttcttccttaagagtccattcagcacctctcctggaagaaccctcacctgcagagctgcctcgtacctgaacgcaggcactgggatttgccaaagtcaacaaaaatgaatgatctctttagggactgtgtctcctttggcctcataccctgtttccccaaaattgttgacatggaaacagtcagatgtggaactaaagttgaacgtgcctaccctctgacccagaaatcctgcttcaagacatttacccagtggacacgtgttcaccaaaagccatgcacaagagtatgcattgcagcacagcttgtctcaaactgtaaactctccaatggctcaaactggaaactccccaaatgactataaaaaaatgagttgtgtcctattcatacgatagggttctagacagcagtgggaatgcatggaccactggtacacagaaccacatgagtgaggctgtggaaggctgcagacacagaagagaacacatctgtgattccatagtcaggtctcatggaggcagagccagtccgtggtattgggtgttaggaaggcagtcagccttaggggaggagggactggtgtttgggagggacccctgtcgggacgacttcggagctggtaataaatgttttgtgtcctgccctaggtgcattcacgttgtggaaattcatcacacttcgtgaatgcttgtctgtgtgccttactgtgtgtacgttatcaacaaagtagtttacttaaactagaaaggaattgcgtgaagagtaatgtgttcaatgcagaagatttatgaggccctgctaagcatcaggctgtggagggcatgcgatccagagctgagacagtcatgggccctgttcttacagagctcagtcaagggggatgccttacatttgggaatgatccaagtctgaagaaagcggttttcatggtgaatggtcatctggagagaacacagctacctgggagtgtttcctgcccatccatttccacttctgggtgtgtatacaattgggcttgtgtgtgttttgctcagaactgccttggttgcagtcaggcagcagtctgactagagttagcttaaaggggacttctttgaagcatctcaacgtaactcatagattggaagagctgaaaccccaaacttcaggaagggcagggactaccagaccaggggatcaacccagcaggtctctctcctcaattccaacctcagtcctccgtgcttggaagcttctttctcacagaccagccttccctgcaaggtgctggcaaggggcttcccagagcactggattacatccttagagatcaaggcggggagagcgaacaggggctctttcataccaggttccaataaaaataaaagaaggcctatgtgtggccaaggttaaggctggcttcctcccatccctcaactggggagaagagggtcatggaacaagatggtggctcccttggagtcccatggctcaactgggacagtgatgatggactctccaagagagacagatacacgagggatgggagtgggggtggggggacatgggcaaggctccttaacagttgtgcattgtaatgagccatgccccaactttgctcatcctgatgagctatgcccagcacaaaatcatccctcaggaagcaggagaaatatatcttctgtatctgttttctcgtgtttgtaacaatgtattgtgttcgtttagttttgtgcattatgatgtacgactgtacatatgcatatatttgggttcatacccctaatttttagggtgttaaatactgtcccacggctctgaatactgcaggttctgtttaagcaccagctgccctttgcaagtctacagagtgggttgccaatttctttggttgtggccctccctttgtatcagacaactataacttagtgaggggtttgcctgagtatgtctcataactgtaggtgggaggaagaaccccagatgttagggagaggcaaggtactcctgagtgatgccgggggcaggtgtgactcccatctgggacagaagtcttccctggcatggcagaggatcatgaagggggggcgcccaggtgggcagcttcttgttcctacctggcctctaacccattattgacaccttccagcccagaatttcccctcttagggctggttttggggctatttcgggtttttgtaaaaggaagacactggacttgtctttgggacagtgatgggtctgcttgctgtcaggatggtgttttctggaatccattttctttggacttatcttttggtcttggggatttaggcccttttaattttttgaagatgaaagtcctttgttaatgcctgtaagctctctcagcccttggggtgctgggatgtaactggaggtagagggaggaaaagctggaatcctaggctctgggcttccttaggaagcttttctctgtgggcatggggagatgtcaactctagacatttagtttaaaactcaagtcttgggtaatcaactatatacagtaactttagaagaaagtataaagacatattttcacctgaaaaatacatgcaagcttctacctcttgtagtggtaacaattcaattatcttgatacttgagttgaaatggtgtagatttcacactgtggagtggcttccatagaaaagggaaaccttggaaagatgagatttggaagttggtttggactttgaattatccactgcttatttgtgtgtgtgtgtgtgtgtgtgtgtgtgtgtgtgtgtgtgtgtacttcatgactgttctttctttgataatggatacaaaattattttcagaacatgtgacaatgtgggtttcagggagaatagagtaacattgtcgttcctgcttctcatagtctccaactaattaatgaaggaaatcctctcagaaagccataccaaagagcccacaaatgtttgcaagaaatttagttcctcactttatccctgagtttctttttagaaaagaaccttgtaactctgataccttaacagttaagatacagttcatcttctatattaaaaacagttgtacctgcagctgttgtaacaaaccttgtgtttgtgattatgtgtcagtgttttctttcttcattgggcatgactctaatgattgtacctgtgtttatgtcatgcttattcaaacgtatctttattgttcggtctattgcactttttttttcaaatgtaatcataagtgcactgtgtaaatgcccacagcacatgttgcttcttctgcattgattgtcattcttctggctcattgttttagaggccctgtaacaatggcagactcaaatggctcacctgtggctttctcctgtcagcaaatggcttctgtaatcttcccaacaactccatgagaaagggccattgttactatctccagggggaggggaacacacagggattaagtagattggggaaggtcacacagctggtaagtggcacagccaagatcaaactcaggccacctggctctagagagtgtgaaggtcaagagggtgagctttggagttcagccgctcacctgatttgtgacctttgaaagttacccggcctccctgagcctcagtgtcctcatctgtaaaatggggatcagtcctgtctcatggggttccatcagatgatggcaaagagtgcttgctcagtgcaggactcacagagttagcactcagcaaacatgtgctttgtacttccgggctcttcagccatccttagttgtacatcctcagatgttccccagcccctttctctgctcaggctgattgcgtatctgccagtggggctgctctgaagctgggttcatccagcactgggagcagggaactgaggtttgcggggagccactgtgttcaaggcattggactttgcacctgtgcatgattgtgggagcaaccctctctgctgaaagttgaatcatggcacgactcaagggctcttcctggtctttggaggtctggctgtgctgcagtggagaacagagatggttggaacaggacttcatctgtgcttcaccgctcctggtcccctggagaaaagcactcgagaagccatgagttgtcccaagactgtgccacctccttcagggggcagacctggtctcttccacctctctcctagcatactcatgaaaacctctcagatgcaatgctttgggagaacagcttccagggtgattaaagctgcaatgcacaatgccacttctaggcatgaaacacgtgtcctgtgatgttcatagcagcactgctttcagagccccaatctggaaactccctgaacgcctatgaactgtagaatggatacatggattgtggtctaatacaacgatggactatcatatgacaatgaggatgaatgaacatgcacggtgacgtggatgaattacacaagcactgtgaaatggaagaagccagatacaaaagatgatatagtgtatgaggccctgcagcgactgttcaaaaacaggcgaagctaacctatagtttgagaagtccagggtgggaaagggggttggtaatgttctgtctcttgacctggaggaatctccgtgactgggtttactttggtttacacacacgctacacgtatacaacagtgcagttaaaaagttctggcaaacggccaggcgtggtggctcacgcctgtaatcccagcactttgtgaggccgaggcaggtggatcacgaggtcaggagattgagaccatcctggctaacatggtgaaaatcccatctctactaaaaatacaaaaaattagccgagcatggtgacgggagcctgtagtcccagccacttgggaggctgaggcaggagaatggtgtgggcctgggaggcggagcttgtagtaagccgagatcgcgccactgcactccagcctgggtgacagagcgagactctgtctcaaaaaaaaaaaaaagttctacaaacaagcagaggaacggcccttgttgagctcttcagctgttcacgcagccacagagatgcatggtggttcaggcctctggtttgggcaggacctgggcttgaatcccaggtctttggccctggggaggtcactggacacctcctgggtctcaggtgcatgcctcacctacctatgcgggattgtactcacttcctcgggctgctcaccttttggggctggcatgagggttgactgagctggaaaggtgacagaggactggccgggggcagtcccacggtgacacagtcaggccctttgccccgccttcccacctggggtcacctcccgaggctcacttggttcccaagtggctgccctttacggagactcctaccttctctgtaaatcaaagcagattggtgacatccccatggccttctctcccattcatctggcctgtcccatagattgggtcaggagagaagggttccttgtgggcgtgaggggcgtgttgtgacaagcagagctgtcatctggaaggaccccggaacggtttctggagagtccttccctcccgccagctctccatatatggcccaggattctagcagctgtggttcaaaggtcatcttcccgaggtctctccaaagacagggatgctcctgtgcccagccagagaccccagcctcagggacttcatctgccccttcttcctgagagggaacagcctgagcgggtaattcccccatgcttcctgccctcaccctgctctctttttggactgttgttaaggtttaaaccagattgtttttaatggagctgcgcagccagggtcttggggctgccagtgctgtgaacttcttcctcaatggtgttcccgtcctgctgtcccacttggaaccgggcagccataacccagcctgagagctgaagattgctgatcgtatttctcctttcttctgaccaatctgctggccaaactggttctgctctttctccctctctctccagttccccacccccagacaggaagtggagatgggcttgtattttcctgcagatgaaaggtgtctggaggttcttctcactggcctgagtgtggtcattctgccccttccagcactctgtggctcccattgtcattcctgctccatgttggtccagagggggcatgatccacaggagccacaggtccccacccagaaacaccattcctgggctttcatcttggtgcttatcatctatgaaatggacatgacatcttagtctaataccgctgccaggagaagggagaaaggtggaggccttttgccttattttgtcctgagtcacgttcaacctccaccccaactctgccattcactccttttagtgctgttagtctactgctgtgactgtaaaccttggcacctcattagaaatatctgggggtgctttaaagagatatggattcccttggttcaggagggggtcggagtagctgtgtgctggagcctactgtgtgcttctcttcccatgtccagcagcctcacgttggtagcttgaaatctgccaagatggcagtatttacacggtgtagtcagcaggcgcttcagatcaggtccctgagagccaattgttaaatgtttaccatcccagacttgggccaggacatcagtattttctaaaagtttccacagtgattttcatgtgcattcagggctgagaacccctggtcctagagatgtctcatactaggcacagtaaggtttatgcttaccaacaatagctaacagttatccaaccctagcagatgttaaactatttgtgtgaatgagatcattcaaccctgaccataacccatgaaggaggattacaatccccattttttagatgatgaaattgggttccatagaggttttctgttaccttatctagggccactctgttggttagtggctgaggccagattccaacccaggcctgagcccctgggacctgagtctggccaggacctcttggatggctgtggttagtgccctacttttcccagcaggttggatgcagaatcatgctcttgtcgttcaggatgaccatggggaccatggggtctgagcctgtgaccctccagtctacagtgtgttggtgaggaaggagcagttgtcactggggtcactggcaatgggcatgcctccatctagcttaggcaagatgcttggactcagagccagagagtgaaacccagacactaatgagctgtcggtgttggtgtgtgttctcttcctcttccagtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcaggtgggtgctatacgggtatctgggagaggtgctgagtttcctctgggggcagaggaagaaggtggtgagggccagaggatgggtcagattggcacaaccacgtgccaggccctgtaccagattatcccttctaaagaaggtgtatggtgtatgtcacttccttaaaaccatgaccgacaacaaattcaggaatagtagaaggccagggagcccagggatgcgtggtgccttgtgggtttttataggcagtctagatctggctgggtgctaagggacatagaagaaaaggggaaggggaagaaacatttttgaagggctacctctctcccgtttctcactctgaaacccagtgcacgatgtcaggcaaccaattaaggtggccatctaaaataaaatgttaggggaagaaaaaaacccaaaccaaaaaaaacagagaactcttagccttccaagaatcactaggtcagaaaccaaacgtttgtgttgaaagtctttaatttatcgagatccattaatttcaaggtcttgtgagaggtaaggaggctaagaaaaagggctgggacatttagcaggtgcattctattcagacagtcccgaggcagaaatgaccaaggtcctattactcagtggctgggttgctggaccccgcaggctgtcagacatctaccgtccccactgggcagggaaattgatggaagaaaggtggtgtgggcacctccttgtgatgtgcaggcttagcatcttcagctagaaaggggacttgttaccatagacagggacagaagaaccatcacagctacgtttgccaagcactgctatttggtgctggtggggggtgggggtggggatggtcatctaagtaccaagaaaacaaaactgttcttgagcgtttccagagtgttttgcacttgatatcttgtttcatattcacagtagccttcagaagtggtggcttatctgtaaaatgaggagaactaaagtgacctgaagccaaagaatgaggctacccagagagaatgtggccacattaggacgtgagcccaggtttgcaaagctggagcccatgcttatgaaagatatttctttccaaaatttgtttttaggccgggtgtggtagctcacgcctgtaatcccagcactttggaaggccaaggcaggtggatcatttgaggtcaggagtttgagaccagcctggccaacacggtgaaaccccgtctctactaaaaatagaaaaattagccaggcatggtggcgggcgcctgtaatcccagctacttgggaggctgaggcaggagaattgcttgaacccaggaggagaaggttgcagtgagccgagatggtgccaccgcactccagcctgggtgacagagtgagactctttctcaaaaaaaaaaaaaaaaaaaagtttttgagtaggcaagacatgttcatggtataaaatcaaaaggaaagaagaggaaccacagtgaaaatgaaggcttccagcccctgctgaggtggtccctgatgccagtttcttgagtctcctgaaatcagcgaaggaatctgtgttgctgttttcacctgtggaaccccacagtgcactcactcctgcctctggctttcatcgttggatgatgaaccttggcagccctttccaggggttcacacggggtgccctcatcctctgagtcacctcactgttccacggcttgggttgtgctgtgtttcacgtgtgcacgctggctcctctgttctatgatggatggtgccgcagggcaagtaccctcgctgacatacgtgttcatgtctatcagtcagataaagttctagagatagaattgtggggtcagagggcccacacatgggtggctttggtagacactgctgagcagctctcctgggaggtgacatcgacatctactcccagcagccagggagcttcttgcttaggatgaaaccacagcctctgtgtccaggctgttatctggattctccactcagctccggcagctcttggtccttcctgctggctttgtgggcacctggtcccatcatggtctgtggtgcctctgctgtcttgcctgagatccatggggtggatcctgagggctgcagggttgggcagcaggcctgagcactgtgtttggaggagggatgggcgttccaggcgtcctccctgccaggctgccggcaacaggcaacttgggctgggggtgcccattctagtgctggggtcctgctcctgggggcttctgggctgctgagtgactgagtccctcctcagcacaggtacctgctgcatgccatgcctgagggcatcgaccagaacgaaccagacacgagtccctgccctctggaagctcacgttccagcagaggagaggacatggcaggtgggagcattgagcaaggaagggaatagggtgagaagcagtggagggcaagacggagctgctttctttaggtttctacatgttcttcctgtgcctcctgcagcaaagcctccattcttcagaagttaaatggttaaatttaaaaaatatattatttattcatttttctggacaggttgttttgtttttgaacctagaaccaagatgcccctatgatgtaattccccagctattaagagcatggattcaaatcctgccaccagctacccatgtggccttgggaaagagtcatctctcagagcctcagtttttccctctgtaaaatggggataataattgaatctccctcccagagttgtgctgtggatgaaagggggtgacatacttacaacagtgtcttacacacaggaagtgctcaataaatggtcacctgcgttagtatcatcatcatcacagcaggaagtggagcaagacctctttaggaagacaagagccctgggtggtggctgtggcactgccttcccgtgtaggtccaccgagccaattcccctaattctgcaatcttccagtaggaacaaagccctgagcttgcaaatgctcttcaaatcccccacgcttcctccagctcgcctgttcagagataggctttttctttgcatgtccccaacctggttgcatgtccccaacctgggcccgcacagcttcttccagctgaaggcctcctgcagacctcagcccgggggagcccagagcctgccctgctgtccccgccatgtggctgcctctgtctctgtgccgccagctgcccagctgtgcagggctgggacatctgacgagctgtgcctgagctccaggaaagccccgggggtgccgaggattagccggctttgggtcagcctcagcgtctctccccttgtgggagtcactttccactgactcctcttgatctctcggaatccagattaaattccgataatgagccgagctggaggccttccatagccctgcggctctgcttaaagcgcggccccagacagctggaaagacatgttggagccgcccttggcgggctgtggagcgagtgggggctcagaggcaggtctggggacagtggccttggctccagaggccttgctggggtgagagggggctgcgaaaggatcggagtcttatcctcattttctgaaccccaggcctgaggccaggccagctggggcctggcttccaggagctggacttgctcctgtctccattggtgcagactttggttccaggtgaaggtgaggatatttggggtaggggttgtgctgtttgccctgtttctgctgtggagctgggacctggcatcttccatcccagtcttccccgtctctccttgagcatgtgtcaggcttgccccactccacagcgctgccccacatgtaggcgacacacttctgctttgggagctggcctctgagaacctccctgggaggccaaggccagccagggcagcagaatctgctccaagggagtcggccgccaccaaggtcgagatgatgttggcagctggatgaaaatgtccctgggttcatctcagtgattttggctgccaggagggtgacctcagcgtggtctcgagggccaagatttggatcagctgcagcctgagtcactctgaggaagagggagctgccccctgcctgtccccaccacacaggatggattggcagaggaggcctgggctcagtttcctgggtcccttcagcccaggcagaggctcttgccctcgactagccctgggatgggggccctgagtttctgcctttctgagaagctccctggggacgccgtgatgattttggtccataaacctgagaaggtaggtggggctggatgtggtaggaggaacgatgcagccccctcacagggcggccctcgggcagtgggccaagggctccttgcccagtcctctcctggggatgctggggtggtggcaacttatgatgtgcggattcatgacttggtagcaagactctgggcgggttttgccctgccgttagcccccatgagcgtgtttgggcagagagccatggtcacgttccagagcatgtctccaccctgtggttgaggcttcttgttgcgtggtgcttactgtttatgactgtgctggacacttcagctttgtttcatgccttggaaaggttcctatgaagatgtatcatccccattttacaggtgcggagcctggctcagaggtgggaagtaacttgcccaaaagcacacagctacaaagtggcagaggtggggctcaaacccaggctcttagatttcagcagtcaccatcttagccatggccgtgcctcagtgattcccatagtgctgattccctcacctggggctcagatgggtccattgatgagtcctgagctggttttcagccttggctgtgcaatagaatcacagaggcttttaaaactcctgatccgtaggggttgaactgtcattggtgtgctttaaaagctcccaggtgattccctgtgtgctggggtgtgaacaggtggctaagatctctctaatttctcacccatgagctgtcttacatgcccaagaggaaggaaagagattccttttttttttttcttttttgagatggagtctcactgtgttgcccaggctggagtgcagtggcacgatcccagctcactgcaacctccacctctcaagttcaagtgattctcctgcctcagcctcccaagtagctgggattacaagtatgtaccaccatgcctggctgatttttttatttttagtagagatggggtttcaccatgtattggccttctgtgacacattccatgttcccttcagcttggtgtctcagagaagactgttcttcttcccatgagactgagcccaaagtgtagtccagaccacaattgtcagtctcaatggcacaggaaagggactggctaagggtgaagatccctttggactctggctccagaggcttctggaagcttctggaagcttccagaagcctctggagtttcttgctgctcctgaaggctacatgcctgtttcctcgtctcctggcttctaccccttgccactacacctcagccccagggcatgagttctggttttgagctgccttctcaggatgtgccaggtcagcttcctgagtagccttttcagagggcaaggaggattccttttggctgctgggaacttccaggatgtcctggaaggtcagaggagagcagccctcatcaaggagccttggcatttttcctcgcagtccctttctctgggcctcactccagaaccgagactgaagctgcctgagagggagtggcaggcccttaatgcctttggttccgcttggggtcctctcatggatctgcaaggatccctctggaaaaagccacccagctgggcagagatggcaaaccactgtgttcaatccagttaatgccagagacacagccagtatcccctactcagcatctgggggccaaatgcccgttggcttcctgtcctgtggcctgaggccatctggtgggccttggtggcttttttttatctctgtccctgttatttcttcccataattcatcccgagcctggcttcacagggagcatacgggtggtggctgggaatcgatggcaacagattccgtttgctgagtgtttgcggcgggcgggggctcagcaggttgcccacattttccctgattccccgtaggtgttatatcacgttcagtgaagccgagcgggtgtccccacgaggtggtcagtcctgcccctcttgtagaccacctgtgggaaaggtctgctctctttacgtttccatcgatttagctgggtccacaatgcgatcttggagcctcctctctcccatgacacttgtctatgctgggagaagggatggctgcctttgggaacagtcatgatgacaaaagctaattgcatgcaatgggggctctttactgcttcccacaacaaccccccatggagacacccttatccctgcccacccctctttttttttttttttgagagatagggtcttgctctgttgctctgctggagtgcagtggagtgatcacagctcactgcagcctcgacctcctgggttggagcaatcgtcccacctgagcctctcaagtagctaggaccataggaacacaccactatgtctggctagttttttacttttgtagagatgaggtctcactgtgttgtccaggctgatctcaaactcttggcctcaagttgttctcctgccttggcctcccagagtgttgtgattacaggcatgaaccaccgtgcctgctcccacaccctctttcacagacaaggaaatgaaggcacaatactgggttggggattaaggatgagaagcttccatctttccccagtcgcatatgtttttcttccttggctggtggatacacttttttctttctcctcgtggcagtccagtcctgtaaattgggaaatggtggggcaattcatattttccacacaaggaaattgaggcagagaccagtgacctgcccagcctgtcccagtagtgtgtagtgaggctttgcagacgcacctggagccgcctctttttccacccctcggaagttgcacggacttggacagcatgtggacacttgctgaaccgtgtggggctgcatagtgaagatctgagtggggcccagcagagacagtgacagggggtccacaaggggaggagttttgttcgttttgctcactgtggtatccattttgcctagagcctggcacatagtaggtgctcagtaagacaccaaatgcacgaaaggatgaaagcacgacccagccttccctttgaagatgtgggctctctgaattcacagaccacatggtctggtcctgtgtgcctgagcgcatgtacaacagatgcctgctggatgagtgagtgccggccacagtatctttgccctggagctagttcgtcctaccaaatgctccaatgtgctttctcttccagaattgaaactcgagaatgccttgcttgcaatctttcttcagcatctgagcccaatttccaaaaagtgaaaattgcctgtaattatgatactttctgatcctatggatgtttccctgtgatgattataattacgttatttacagctgtgtgccagtgggtgcccaagggtaggtcggttcttgtttgcaaataggggagacatcagcgtgtgtgcggcagcctggggttctttacactgggatgcatttgggaagaatgggctttcgtggaggcagctctctggataacttgatttggcactttgattccaaaagcacttcatgcttggccctgggcctctgctcgcctatagaagctcatttttccaaatgtattaacatctatgtttcgaatcaggatctgtaattgctttagcttttttggcaggagacaaagagaattaatatttttcaatttggtcacaagcagtcatctgtagctgggaagaaaagtgtctgctcaaatactaactctaagggtggggaatacaggcttaccaggaacatgatgatgttttaaaggagacaaccacagttaatgaagctagttcaagttcagattggaagtaggcatgtaggtaaatactcaaggttcttccaaaccctgcttcttcctttgtcttcctattgcaacctctgtcggtgccatgttcttctttttcctcaacaatgcccatggctttccattttgccaccccaagaaaggaggaaggaaagctgacacctggtcttgcattccagcacgcatgccacccttctcctcctgggaccaaggcaggcattgctaatggatccctttccctccctttccctggatccttggtacaggtctctaaataaggcagccactgccagttgagtgaagctgccatcaagtgaaacctgttggccactggtttcaggtcaggtttctccaaagctcaccctcagctgaggattgtgtggctgtgagagtgaaggattagaaagtgtttccaggaaaggcctttaggagcatcgggcagtggggagatggggaggccaggtgagggagcggtgctgcgcagagcaccccgaagggtgactttggctcactcttcctgctagaggttctggagacaaagttgcaccctcatcctagtcccgtcaagagagctgaagtgtttataccctgtcatttgaggcagggtttcggtttccgagcctccgcagtagtgacctttgggggtggctcattctctggggttaagggccatcctgggcatagtagggcattcggtagcagccctggcttctgcccaccagatgccaatgacacatccccacactcagttgtgaaaccaaaaatgtcaccagatattgtcagggtcccatctttaaaagggcctctaactaggccctgactgagaagcacagggtggagggagggagggatgtcaagtacctctgggtgacacagccgaagttgaacatacttaagtgggaagtccctcgcccaccctgtcttcttcccaccttcccacttaccttgctcactgctacctaccaccaaacaccacctaccagcaaacaccagctaccagcaaacaccagctaccaccaaacaccacctaccaccgaacaaacaccagctaccactgaacaaacaccagctaccaccgaacagctaccactgaacaccagctaccaccgaacagctaccaccgaacaaacaccagctaccaccaaacaccagctaccactgaacaaacgccagctaccaccaaacaaatgccagctaccaccgaacgccagctaccaccaaacaaacaccagctaccaccaaacaaacccagctaccaccaaacaccagctatcactgaacaaacaccagctaccacctaaccaacaccagctaccactgaacaaacactagctaccaccaaacaccagctaccaccaaacaccagctaccaccaaacaccagctaccagcaaacacataccagctaccaccgaacacacaccagctaccaccaaacaaacaccagcaccaccaaacaccagctaccaccaaacaaacaccagctaccaccgaacaaatgccagctaccaccgaacaaacaccagctaccaccaaacaaacccagctaccaccaaacaccagctatcactgaacaaacaccagctaccaccgaacaaacaccagctaccactgaacaaacaccagctaccactgaacaaacaccagctaccaccaaacaccagctactaccaaacaccagctactactacaaaacaccagctaccaccaaacaccagctacctccgaacaccagctaccagcaaacacacaccagctaccaccgaacacacaccagctaccaccaaagaaacaccagctaccaccaaacaccagctaccaccaaacaaacaccagctaccaccaaacaccagctgtgcagctcctcacacacatctgtccgaggtggtgctcaaacccagctgttgtcagaacctcctggaaatatattggaagagaaaaatacaggttcccatgtttaaccccaactagtcaggtgtaggggctaggagttttcatcatgaatgtttaaaaacaagctcccaggactggttgtgtcaccttctgggcccagtgcaaaatgaaaatgtgtcaaaaatgtataaaggatttcaagacagcaacagcagagcatgaaaccaagctcggcgtacttctgtgtgtcgggccctgtgtgactgcacgggtcagatgcccatgaagccggccctggccttgccatctccctggatacagatgtctgttgatatctgtgttgataggtatctttatacagatacctttcagccccagcctcatttccagctgtctcctgtacacgtaaacacgtggaaacacagacagatccacagaaacacagacacagacacagcacacagatgcgcagacacgcctggtttcccctgttttaacacctaacatcaatagggtacagttttcataattaaggacccagcatctgcatttttattaatgaaagtcaatcatttattccggacccctttgcttttacttcttgtccttctgtcctgtccaggacgccacctacccttcagtggccacattccctggggctcctcctgcctatgtgtttctcctgctttgcttgtttctgaaagtgacagtcacccagcgtttggagggagttgatgcagagtcctctcccactatcactccgtctatctcagccccacctattttaaaattcaacctgaatccctacgctctggctgtggctcgatgtcttctgaacttgagtgacgtgggtcacagccacacagggtccccagactggagtccttgtaacccctgggctttcagctatggcgacctcagtgcctggcacagagcactccatgtggctttgcttcttgagtggaaatgagattataagagcctttttggggtaagggttctttgtctcctaactcttccccagggcctagttaggggcgctttaaagatggcacttgaggtgtcctcaatagcaggctctttcccctccatgctgtgggcttagggagcgggctcagcctcttgctctggggttgaacccacaggtcccggaagtgggagagggtgggtggggtggtttgggagtcaggtttgcaagtgggattgagagctggaaccaggagcctcccaacaaacctgtcatggtcattctccttggaaagctttctccagctgagtcctgcctccatccctttccccttgggtgttccacatgcgggggctcacggtgcagtaggaaaagcatctctgaggccctagtctggctcctggacataagagggatcctccagcttccccagcatcactggtgtttgagtcttttctctgcagatgccaccacaggttgtcctggcaggggtccctgccatgagtgtagacagcatttctcctccagcccatgtctggctgctcaggtggtgactcccaccatgtcagcctcaccaactgccaccttggacagggcctccactcctcctcggagagatggacccgctgagccgcagacctcgaggcttcccctccccacacaccttcccctatgtgggagctctgtggggaactttctctgacccactgaggagtcggagtcaaggtctatggggaattccccagccccctcaccctcaggagacagtccctcaccctcaggagacagcccctcgccctcaagagacagcccctcaccctcaggagacagcccctcgccctcaggagacagccccctcgccctcaggagacagccccctcgccctcaggagacagcgccctcgtcctcaggtgcacccctctggagctgctccaggaggttctgacgggctgaagtcccaggcccacagtgttctgttttgacgatctccaagcttgccttacttccccgccctctccaggtggttcctggggtcacctctcagacaaactacttgcattcaagtccttgactcaggacctgcctctggggtcactgaagcatgacagaggccaagtgtcaaccacacagggcagccgggagggcttcctggcaaggggcagctttggcaccggcacagcttctgggacctggtgagggcctaccaagtgcaagctgatgtcctcagcctgcccccttcctggacccccccggcttcaggatgctaccgtgagaataagtcttagaacagcccgctctggccttctctagatgttccaacccagcctctgtttttgagaatcttgaatttggaaattgcgtcacttgtttctgtctgcaaagcactgtcaagtttctttccccttgtcgccctgctttgctgcactttttctgtctctgggtttggaatcttaaaacagcctgtggttctcttaaaaaaaaaaaaaaatgaggttggaaagatgacccagcccgaagactgtatttgtggtgcttgtttattccttgagtgtgctgcaggaaaggggctgaatttacctcattctattttggtctggacctggaggctggaggaaatgcggtccccaggagaagtctagaaagatgagtctccccatcctccatggctgcccgcccacctccacagtgccagatgcaggcagctgcccatccgtgtgggatttcccccagagccgtgtcagaagctctgcagtgccccccagatttttctggggggaccccccagagttcttgatgtttcaccagagttcttggtgtgttctgtgagctggaatccagctcgcggctcagttccactgggtttctggatggatcatgcctgggttgaatggaacagtagagcctccagttttccagaaattctggggctcaaaccctgatatcttaagcaaagagggacaagagtcaggtccaaaaggaaatgtgagatgtgctttcttcccagctgttgctttctgcccacctgagtcctcttgatttttgcctgatgtggggaaaggaggtggctccgaagaggtgatggggacagtaaatgggggcactcaaccggaagcccatgcagcctggcagtttccagtgaggggtcaatttgaggtaatttgacagccccctggttccatagccaggcctgtgaaggtggggggtatggaggtgcccaggggctgatgagggtttcccttcaactaggatgtgcagctgggtgcccatggcctgggagtgtgggtgcccagtgggacatagagtgggctgggtgggctaaggccccagtgaactgtgagtcagagccatttctggagctacctgaataatctgaaaaagtatttaccatttctcttttaataatgtaaactattggaagtgaaaccagaaaaccttactggccataaggatgcagaggataccagcacatttgtccagcgtgcatctgaggcctgctttgtgctaagctgtgtgcctggtggagaggccgctccagggctgaataaaatagggctggttcttgctgacaaaaagcttaaaacctggcaggaaaagaggagaacccaaaaaactatacaaacaaactgaaactccagcccagatggcgcaggggagaggacttgggcttggagcgtgtccgacgtggatgcaccattagggcatcagtggacgcttccctgggatgctcaagaacaggcaggtgtgagggaggtgaaaaggcagggaacagtgttgcaggcagcggaaacagcatgtgtgaggggctgtggtgggctggagactggcacagatgaggagggctgggtgggaggaggctgtggagacaggggccggaccatccagggccttacaggttggatgacctggagttgacaataatgcctcctctctctccccagtttctcggtttggactgtcagttccatagtcttctttatcacagaacacattagagagctttggctttttatcctaagagctgataaagggtttgaggcagggaagttaattgctcagcccctgcaagctgctggggcagggggagtgcggggtgagaagagtggaaggggaacccccgggttctctgggtggtagctctccctccaccatcaaaccatcaccgtgcaggggtgacactttgctggaacaaggctctggggtggttccattcactacctgcatatctctgagcctcagtctcccacctgtgagaggggacaacagtgctcgcctctcaggtaccatacggttcagagggctcgctccgcaccttgttctaagatggttccatcttgagttggggtcagctcactgcagctgtgatcttactttagagccaaggcagcttgaatcccatggtggaagattcacactgacattgaggtttgctccaaccagctgcgaaccttgagtctctggctttgcgctggcatcttgagcatatctttccatttaactcattctcagaacaatcctcatggctacctccattttacaaacaaaagaacctgatggacagagactgacttgctcagggttacttcactgaaatttaactccaattttcctcaactcagagcctggagccctacagcctacatccctgagcacccactgtgggacccgaggaccactctggggatttcatcacaaagaggattccgggcctctcaccccctgattgtctctgctggtggctgtgtctctaatgagggagagccttccatttgtcgctgtatttctcttccctcttgacccccagcctctgtgatccacaccttgacacaagtttgaacggctcgttactgcgctccattgccggagcagacatttctttgcagcaggacttttcagagcctttaaagagctaaggtgcattatgacatctctaaggagcaatgtgtcatgtggtgcttcccaacctcatttcaccacagagcattttggatttttgatcctctcattttcctctcttagctatcctattaataagttgcagtttttgagaccttgataaactccaaaccctttgtcttgtggatggagaaactgagggctagaacataagggccactgactcgccttctgactgtgacaacgctggcctccgggtgctggacgggcatcttcctgactttcccatgagtggctgggttggtgctgtctgcagtcagctggccctgcccagagggagacagacagccgtggggtgggtgagagggccgtgggtggccacccgagctctgtctggggcaggaggatattgtgcctctttgtgtatttttccaccttactccccaaagctttaattttagccttcctggatatgcaccgtcttcaagaaagtgtatttttaaaaagccttggacctccctgacttcctcttcccgtctgggggatgccagggactgttctatgatttggcaggaaagcagggcattccctgaagctgaggtgggggagcctggggcccgggctgagtcctccccagcctgcagctcagaaggggcaccccttggacccgggagctggctgccagggtggggccggcttccttctgggctcctttgatctccttcccgggcttccctgcaggctggggttgctgctgggctgactccaggtgcacggcgggttgcagtttcccggcctgactcaccgcagccgcaagcctgtgctccctccatgacatcatgctagcctgggaatgctctggccatgctcgctggctcgctctcttgctccttttcttctgaggaatatccttgcggcccagcaaccgttcacaacatgcaggccttcagaatgtccggcctgcagttttccaaagagcagcagagtgaggcgagggcgagggtcagactaggggtcggggagcgagtcagctgggtctgcgagtggcagagcccgtcatctccactcctgcttagaactcctcccggcttcccagcgctcagcaagacctgacctcccgcggccagaggccctgcaggggacatcgtgcacctgtgccctctcctcactactttctcatcatgacttccgcattcggttctctctgccgggaacgcttttccctgcccttttagctgtgttagttctgctcatcctctgacccccttcgggagatgtttctataaaacgtcctccccgcacaccctcacacctcacatctagtccttttcttttgtcttgctcacccagaggcctcttccctccttcacgccacttaattagggtttgaatgaccctcttgtgtgctacgcacgcccagcctctggacccggagctccatctctggctgccgctgtgtctctggctcctagcagagcacctgtggagaggaggcgtttcagtgtggatctcaggagagaaactgtattcattcctccagctgctgagcccagtgaccgccaacttagtggcttaagacaacacacatttattctcttagagtttgggaggtctgaagtctgaaatgggttttactaggcccaaatcagggggtccatagggctgcatcttttctggagagcctgggggaggatctgtttccttgttgtttctggcttctaggagacagagccccctttcttggctcaaggttcccagccgcagtcacaccaccctgacccctgctttcgctgtcacagcttattctctggcctcctgcctcccctgttatcaggacccttatgattcctttgggcccatgaggataatccaggataatctcccaactcaaaaatctttcatcacatctgcaaagtccctgctgctgtggaaggtggcatacccacagcttctgggatcagggcctgggaggtggcatacccacagcttcctgggtcaggacctggatgtgtctgagggggtgttattctgcctaccacatcatctgaagtgtgttttccttttttttgatggtgggcctgggccagccccgtcctctcctgccctgcctcctctaacttgggtggggctcctggagatggctttctgtgcttcgagtaacctctggcctggggcctgttgctcccagcagaggcgtgtcctgagcctccctgcccctcagtttttgtacaatccccatccccatgtaataggtggtattaaggtgatattaagtggggatgcggattgtactgacctcattggaggagggaggaggaggtgggagagtgtcccttaagagcctagtgtgcagtaggtgcccagtacgaggtgtcagggtgctgagggcccccggccaccagccgggtgattccacatgcggcccttccaaccctggcttgcgcctgctccctgaaggtggtggggggctgtgtctgaaggtagcagagggggatatcaggctggctctcaggctgtgatggcgagaacatttttcattacactgccctaaattatggcccagaactggtgtctaatcctcgttcagccaccagctgcccatgcgcaagacaaaaactctctcatctttccaagctgaaaattaaaatgaccagaatggatttccaagggcctgttctgctcctaagaccctggatggctgggcccaggggcaggaggctgaaggagccccgatggtgggcgcagacaggatggggactgtcccaggtaacgagacagtgtgcactgtgtggccatgttggaattcgtgtttcctgtggctccaacgcgtgcctgggtgcctcagggccagagagatcctcagactcccaactccgctctgttttgccctggggcagtttcagggccatcttccctggatctgtgtttgcgctgaggccgggtcctgcatcccacatgggagtcttactcccctgggaggcgggtggtgggtgaaggcccatgaggatcagtctctaaatagcctctaggtaggtagccagaggccaaaaaaaggacttcctgccttcccacgtttgagattttaaaatatccccttttccattgtggtagaactttccaggggaaggtgggctgggagacactggaaacgagcctggggatgtgcggttcctcgtcctgctcccctagaattagatttcagccgattcacctgggcgtccttgggaggaggcacctgaaagcccagcagcacgctgtccccaggctggtggttaaatattaacgcctcttagtgcggcggcattggggtcaccagcggttcatgccttgcagagcagggctatgggagaacccagtttcagaagagaagagaagacgacttttggggtcttgctgtttctttaatcagaaacagcctgagaaagtggaaggatcatcaagtttatagacaacagacgtgtggcctgtcccctggctctgctgcctttctctgagattagaggagtggaaaaaactgtccaaacccaggaaagaagatgagagccaggcttgccccctcacctaggtttgttctgctgttcaagtataacatggaaatatgttgccccatacagatctagctttttccagaaatagggcatgcttactaaattgagacaatattgacgtacatgtgttagcttgtaaagggaagcaaaatacttcacagtgaattgttgctaccactctggtgtgtatgcgtgtaaatgtttcatgcagctgtgtgtacactttaaaacaattgttaacataatggcaccatactctatatttggggcttagattggccttatccattttcaaaaaatagctttattaagatttgaagtgtataattcagtggtttttggtacattcagagttgtgcagccaacaccactgtctaatgttagaatgttttcatcaccccgaaaggaaactccatacccactaacagttacccccattttccctacctgtctagctgttggcaaacactaatctactttcttttattttctttttgtttgagacagggtctcgctctgtcactcaggctggagtgcaatagcgtgatcacagctcactgcaacctccgcctcctgggctcaagcgattctcctgcctcagcctctcgagtagctgggactacaggcatgtaccaccacgcctggttaatttatatacatatatatatatatatatatatatatatatatatataaaaatatataaatctaggtatttgtttattcatttatttttgagacagagtttcgcccttgctacccaggctggagtacaatggtgtgatttagtagagatggggtttctccatgttggtcaggctggtctcgaactcccgacctcagggtgatccacacgcctcagcctcccaaagtgctgggattataggcgtgagccaccgtgcctggccaatttttatattttttgtagagacggggttttgccgtcttgcccagtctggtcttgaactcctgggctcaagcaatctgcctacctctacctcccaaagtgctgggattacaggtgtgagccaccacacctggccctactttctgtctttatggatttgcctatttgggacatttcatagaaatggactcatatactatgcaatcttttaagtctgactgctttttcttagcataatgatttcaagattcatctgtgttgtagcctttatcagaacttcattttttaatgccaaataatattccattgtatcaattgactgtattttgtttatctgttcatgagttgatggacactttggctgtttctacctttttggctgtgaataatcctgctatgaacattggtgtataagattttgggtggacatgtattttaattgcttctgtgggtagctgaattactgggtcacatggtaattctacatttgaccttttgagacaccactatactgttttccagagtggctgccccattttccaatcctaccattagtatatgagagttccactttctctacatccttgccagtaacactagttatcatctgtggttttggctctagtcatcctagtgggtgtgaagtgctgtctcactgtggtttcaatttgcgtttccctaatggttgctgatgatgtttagcatcttttcatggctcactggccatttgtgcatcttctttaggaaaatgtctgttcaaattagccttctctattttgggagtcagtggcgtgctagctttacaatatgggtttcaaacactccttcttccatgttcttgatcaaattatataagaaagaattatctgttgataatttgcaaaatctgtggttataaaaccaactgggggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaaaaaaaccaactggggtatggggatgggaaagaccttcctatttcagtttcttttgggcaaatcaaaattttcatttctttttgcaccaatttttgcattttgcattttcccagaagtttcagtcctacaaattctgtttcttagcaccttcctatcatatttccaccttgtcaacaagtgtagatttatacggtcctttgaagcggctgtgcagggctctgttgccttggatgtgccataatgtttttaccagtccctctcactggatggttagtgctcagtttttctgttataaacaatgtgactgttgtttgggttatctgtctctgaaactaaccactcatatgtagtggcttaaaacaacatcgttttattgctcaggaatttaggcagggcttagctgggtggttcttctactctttctggtatctgctgtagtcactgatggagctaggagcttgactaggtctggaaggcctgagatggcacctcactggggactggcttggtttttctctctctctctggtttatagacccttatcctccatgacctgtgcctccttcccctccatgtggtctcttccttcagcagtgtagtcagatttctcgattcagtggcttccttcccagagggcaaaaatagaaatgataggcttcttgagtcctagtcctgagcctggcaggacctcagttccactgggtcctactggtcacagcagatcacatggtcagtccagacttcagaggtggggaacagactccacaagtttatgggacagcagcatgtgcatacagagacaaggaattgttggtggctgttatttgcagaaaatctaacactactgtgaacataggacacttttctgacaaattttggagtccaaggtaaacattcttggaatggacaagtggtctgttgactggagaatcatgggcaagtcacataacctctgggaccaagacatgtaaagtccccatcctaggatttcctgaagtttagcagagaatagacaccaacactgacataccttgtaataagtatagatgctcttccaggagtgtcttggagtttgctgccaggctggtcttaacctggctcttcctaatcattgaagaagatggcattattctcattttacataagaggaaaccaagacacgggaattatctggcgtaaccttgccttatcccttctccatcacctgggtttcatccccctctagtattttctctgccccacacaacgctgtgatgacaacacgtatcatacaggatttgacatcttcctatgtgtctcttatccccaggtgagtgaaggaggtggcagggtttaagcgctcaggctcttgagtcaggtttcctgcgctgtcgcctggttctgccacttatcaggtgtgtccctggagacaactggcttcatttcactgaccccaacttttctcatctgtaaaacagtaacaggactttgatcatttcatagggctggcggggagattcagagaaccgaggcgtggaaagcaccgagattctcagcagtggcgaaggtgaaagaacgcatttaggttcctcagggcctttcaccctgagccttccttacctcttctctcacctgggctgggccggggaggccagtgtgttcaaggtaaataaaaatgtcacaaagggctccttcagtgctctcctggttgtaagaaccagtgttcttttacgatgctcaaggtggcagctagaaattccccctctccgagctgtcagactggacctggctgctgagtaattccttccttgtcctttccatgaggtccaacctcatgcctgggctctcagtctgaaagcaaagcccgtgttagcatctcacactcgacccatctcagcaaggctcccgtctcccagtgccttctgatgaagatttggctctcctaagtgtgcctgggacaaattgcaaactatgacttgaaggaggggagttgacacgttcacgttgattcatggatgagtcagtgctggcctgtagcatctggcctcagtgtcatagcctgcaataagagaatgctcagtatcgtttggcgaggcgttctctgtttaaaggtctcactctgttcctttggttaccattcattgttttactgtcctcgagggcctgtccagatatctggtcacattttcctgctaataacaattttccagcaaaatcaccatctgggtttgtgacttctgtgctgaggtgtggatatttcctacaggggccttgggagcctgattcagtaggagaagttgtttcgacttggagtggtgcttcttgtctcatctgttaattgttgagaatcgctaatggttcattgacaaccttggtagcttttcaaagccaggaaagtcatccaggcaaactggagataagacagcaggaaattcttgtttataagtttaaaatctgtgtagacatccccgaagccagcctgaaactacctctaaaagagcatggggaagaagaagtaaatgagtcatgaaaaataatctcatgactttaattcagtttggatgtgaaaggtaaacttagggtcttcaaagtcctgtgtggctctaaaaagacttccttgcttctgtcatctctctgtgcttgagagaggaatgagtcctttacaatctttaaaaacaaacaaacaaacaaacaaaaaacaaatacctcattccttatagtcctggagactgggaagtccaagatctaggcgctggcagggtcagtgtctggtgaaggctgccctctgcttcaagatgacacctcgttgccgtgtcctcacatggccgaagatggaaaaacagaaagggtccagactttctccctcaaacccattcataaagacaccaatccatccccaatggcctaatcacctcctaaagggcccacctcttaataatgatgcattggggattttcaacatgagtcttgggaaggacaaaacattgaaaccacagcaataacagaattaagcattttctgaatcaggttctgggggtcattgaatattacttaaaaaggagactttgaggtggcatgggaggaggtgactcctgcgcccatctgtggtcctggtgatgcgtccattgctgtggggtgcccaccctcccatggctaggagtgggcacatagattgactgggccaactggattctgtcccccagagttttggatggagagaggcccagagggaaaagcagctccgattcgttccttctgtgcttgtgcctgagaaaattgcgctgtgccctcgcacctgcctcggttcctgtctgtttctgaccctggttcttcttccctgtgtaggcttctccgggtctgttaatctcccaatacttgctaacattacaggtctgtttcccgtgtgtcttctctgagccttgttcacattgatgtgcctgacgaatgtctaacatattatggcatgcagcagaagggtgatctagcagacctcacaaacctagagttgtccaggtcagacaggaagataaatagcggtggctgtctgcagtgttagtacggagagctgggggctggagccaaccggagatgtgtgcctcatcaaaggggacatgagtggctcggctcctgcccgtggcttagtgggttacattccaacgaggttgactggtgaaaggctctgaaaaggcagtgtccagaagaactgtctttgtgtacagttgcaagcttgggcttgcaggtagcctggttggtttccagtcctgcctggactgtcctagtggcataaccctgggcacacaacttgacctttcggatcctgagttttgagttctgcacaatggcatggggaatattatctaccctacagagtgttgtaagaactaagtgacatgagactggtcaggcatttcaacctggagcctggcatatggtaagtgctccataaaggatatgcctgacatctttacgtgtgagcagacaagattcactataatcaccaggaagattagataactccaggtatgatagagactgttgttgccctggggcagggaccagtgtcatgttgttcatcattatgccttggtttctggtacaacacagaggtataaatattctagttgactattaaaggactcaaagtattgaaactttgaattcttattaaaagtgtgcaagaaatgttatgaagatctttcatactagaattctactatccagaaatgtaacaatccacttatttaccctcttattcatctactcatctacccattcatccatccatccacccatttacccatccactcattcacctacccgcccacccatctactcatccatccatccatccatccatccacccacccactcatctacccatccattcacttatccatccaaccatccatccatccatccactcattcacccacgtacccatccattcactcacctacccatctacccatccatccaaccacccattcaccctccatcccctgtcaagttaattatgattttacccattttgctactgtaaaaagtaaggaagagagaatgaaaggattttcactattaataccatcagtccagagattcacctcctaactcttggtgggctcataaagatggtgcacgtcctggaaatgaagagtatctgctctggtacacaggtaaatgggctgaaaccccagcttggcaacttcctggttaaatgaccttggaccttgggcaaatcatggctttaccataaattgagtggaaatgatattcccacagcttcgggttgtgggaattgaatgagatagtgtagtgttgagcccgtgggacagtatctggcacatggtgaatagttcagtcactatcaacttctgctctctgagactcttccagcaacacggaggctgcataatccctgtcttcctatactctgtcccgctgggatgcccttaacaatttatggggtgagattgccttgtaacagctgccttttccctgcgtgtatctctttgtagctcttctgcactctctttcctcaccacagctactgaggggtctttgtgcctggatcttggtctgatgttcccacttgtcggggaccagtggactctttccctcccctcccaccccatgaggctctgcttcccatctgttggggtagtggagctgtgacctggctaacgcgaagcccgtgtctctcctcctctctcgcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatggtgagtcccccggccactgccagtcctaatgcagcctgtgctcctggacttcaggagggtctcagcagtgctcatgcttgcttcactacaaacaggcttccccgcccctcccaaccagtactccatgttcagccttttgatccaaaccagaagcagccccttcccctcttttcacaagaagattacatgtttggtcatagcagaattgggtaaggcttcattacacaaagggtggtcccatatcagcaggggtgagggcagccctcttatgagaaatgcagaatcctgggcccaccccagacctgctgcatcagaacctgcactttaactagagccccaaggtgacaccacaggacacaggacattctggactgttccgtgcacggcagggtgtttagcagcgtccccggtctcttactcactagatgctagtagcatctcccagttgtgacaccgaaaaatgtctccagacatcgccagattgtgccctgtgggacaaaattgcccttgtgcaaggcattggtcccttccacattagaacctgaatgtgcgtctgactctccagttcctggagaatccattgtgagtctgccctccccaacacttctcattcccactacagttctgcctcctttgagaagggaagaaggaaggatggtgagtggagaagtgggaatggacttctctatgctaatttttccccaccccaaacagataagaaatgatatcttgtagcttgactttgcttaaaattcagtggtgatggtttccagctgtgtagcttcttccttccaccagttttatgaacaaaacaattttttcatttatttttgaataaacaccttcacaatgtttgcctttggagctatgaacaatacatgtgtaacactaaatagtttccctcccactttcttctccagctgctgagttccacttcccagggacaactgctgtttctgtcttttcagagatgctctctgggtatttcagcaattacatggagattcggctttctgtttttcccctctcccataaatggtggcctggcatatacagtgttctccagctgacttatctcggagactggtcctgtcagccgttaaagagcttccttgttccatgtgttttgtgtccatgtagctctgccacccacacactgtgtgacgttggacaatttccctaacctgtcagagcctgggctttctcatccagcatgcaggtgatgagaggatttgggccattgggttgttacaagatgtaatgggttattatgggaagagtttttaaaaatagtgccttaatgtacgtaggattttcccaggcatcttggtaaaatgcagattctgactcagctggcctggggcagaggagtctgtgttctcagacagccaccaggtgacagaagctgctggtccctggaccgtgctttgagtaatgaggcttagaacaggacctaactgtaatacacatgtaaaggagagcagtcatcatcctcgtcatcatgatcaccaaaactgacatacccagctctcctgggatggatgcctaggtgttttctagtcttttggtctcacaaacagggcttcagtgggaaaccttggtgtgtaggtcgtttttcgtttgagtgtagctctaggaccaattcctgaagtggcattgtctatttgtagttttatttttttttgagatggagtctctgtcacccaggctggagtgcaatggcacgatctcgattcactataacctccgcctcccaggttcaagcgattctcctgcttcagcgcttgagtagctgggactacaggcgcccgccaccacaccggctaatttttctatttttagtaacacatttctgtggacttgtagatgttggggaaaccttccaactgggccccagtgggttctgtgcttctctgtcttgcctgttctgctggctcaggtgattttgtcttaattgacgccagccctgtggccagctcctcttactaccagtcctgccctcatcattccccccagacacagtcagagtccttttgcccctttcacctccagcacctactcccccattgtccaggttatggagaaaggctcagcattggtggaggcagtgctgcctgatggttagagctcgggctcccgagccaggctccccaggttcaaatcctagccctgctatttccggccttgtgacctagggtgagtcacttaatgtgtctcatctggaaaatggggttaataatagtttccatctccaagggcggttgtgagggattagatgagctcatgcaagtgaagagtttaattgctcagtgtgtggttgctacgaagcaccactgtctcttgtgatcctcacaattacccagcaaggtagatgctgtggctcacatccccgtggtgcaggcaggaaatggaggctcctgagaacccgccggggctccatatttcagagcccacctgagaccctctccattccttgcagcctagtggctgcaggttgctatctagagtcagatcaaggattagatgctgtgtccctgtccccctctgactccgggacaccatctttgctcctcctgggcagggccctgggggccgggtgtggtgccaccgcccagtgacttggcttgtccaggtgctgtgcgcgcccaggcagtgagttttgtgtggttgcccaagtcgggggaggatcacccacttggattgtcagggaggggcaaagtgtataatggccagttggctgtgtggagttttggacctcttgggggtgagctaaagagcaagtgagtccgggattttcgagacatcatggctgtgaaaatgctttgttttccctaccgtggaggatctcaagcctggcgtccttcagggtcaccctagggggcaaactgcacatgcaggtgcctgagctccatttcagacccaccgtgggggatctcagaggatgcgcccaggaatatgccccttttccccagtagctttaggggtacatgtggttttgtttccgtgggcaaatcataaagtctgagattctagtgctcctgtcagccaagtagtgcacgctgcacccagtatgtagctttttattccttagccaccttctaaaagaagacttgggtaacttgaggcctggcccagtgacaacactctggcaaagtcgtgcacggtgcctagggcagcctgtttacaagatggtgcctgggctgacaggtacccctcgggttctgggtctcaaccctcccctgccagatcctgcacggggaagggcagcagggcctgtgggaggcggtgtgcatccgacaaatcagtgcacacctgctttgtgcctggccccgagctggctgcagagaccctggtccctaccctggggacctcttactgatattaactcagaggatatcctgcctgcaccagcacccagagaagacaggtgcccaggcagcagcgcccatgtcatcatccagaaggggtagagacagggtcacctgaaccttgcaaccactaggcagttacactgtgcgtgggtggagaggagcccccagcagctgctggaatttggagcccggacacctcctggggccttgcttttctcatgcacacaatgggcatgtggaggatagtaatttgggccagcgtgtttccattctagcggggcgcagccatcgcagaccttctttcagaaggctggtgtttaaccccacatgagcccctgcctgccagtggtctccaaaactccaaagcccagatggcgtcctccttccctcccatctggccacgggtggtggggggtctcgaggtcaaagtgcggaggtgcccttctgagaccacccaggaagcgtgcgtcttttccctcttcctcccagctgggccctcctgtgagtcaccatgcggagcagccgcagctggggctctgctccaggccagcgtgccctcgcggggagaagcctataaactcccaggcacctgcagctcatcaggaggaggccgagcggggagcctggtctcatctccctggggatgggctggtgctacaggaatgagggctggagtctgtttgtctttcccttaatacagaagagaggagaggcagcctctccacttgttccagcccccaggctgtgcttcccacccatggactggctgtgtcctacagcccatgctggatgctggtgtcagagacccggggtgaatctagcactgcccagagccctgtgagaaaggagaggatagagaggagagcgagaggagaggaggggagaggagagtgagaggagaggatagagaggagggggagaggagagcgagaggagaggatagagaggagggggagaggagagcgagaggagaggaggggagaggagaggagagcaagaggagagaagggggagaggagagcgagaggagaggaggggagaggagaggagaggcaaggcacctttgagtggagggaatcctgcagctcggggctcctcccaccttgtggccttaaggcaggggaaccctccctacaagccaggccctgagcttccagtgtgggtgcagcttttagaagcaggatggactagcaacccctgcacactcatactctggcacccctgcccctgtcatagcacagctcctcagtcacctttgtgtggtctcagcagctactccaacttcttggggtcttgttcctttgtctgttccatgaacataataccatcacggattctgtaggcggctggaagaagaaagtgagttctcagaacatgctgaatcctgggcccagcaccctgtctgtgctcatgaatgttagaagttctaattgttgatttatttagttctctcaataatcctgcccaggtagcacaattgatatcaccaacattttatagatgaggaaatagaagctgagaaggctggggaactttctcatgactcccaggtgtagatctgggctttggccagaggattgtgactccaactcccttcctctttgctggaaaatcttccaaggaatgtgttcaccaggctgcagcctcaggatggggtttggaggggcagatgagcccctgcaggggacccagcctggccatccggaggtagagaccccaggaccctctaacatgttaggtcttacctggcttttcacctgggaaggaaagtgtttctaaaaagcactcagaagacagtaggcttcttgcaggactcactgtgggagccccctttgcagaagtgaccagggctgcccttgacttctatgggctcctccctccattacaaaaaaaaaaaaaattagggccgggtgcggtggctcatgcctataatcccaacactttgggagactgaggcgggcagatcacgaggtcaggagtttgagaccagcctgggcaacatggtgaaaccccgtctttactaaaaatacaacagttagccaggtgtggtggtgtgcgcctgtagtcccagctactcgggaggctgactcaggagaatcacttgaacccgggaggtggaggttgcagtgaaccgagatcatactaccgcactccagcctgggcaacagagtgggactctgtctcaaaaaaaaaaattaaattaaaaagtatgttttatggccatgttgatatcaagatgaatattataattctgggtgaattaaaaattaagattatttttgagatggggtcttgctacgttgcccaggctgtccaggctcaagcgatcctctagcctcagcctcctgagtagctggaattgcaggtgcccagctttgaattaaaaaccaaaactttcttagacactaaaagttcatgttttatcttccgattttaagagacattatagtgttttcgtgggccctgcatcccagcatggggagtgaatgatgaatgatggtcttcccccacccccgcatctggttgttagaacaagtttcctacagcaaatagcctctccacctatgttggaagcacagttattcactcaacaaacaatgagccaaggactgttgtgcccctacaatgaggcaaggactgttcgaagcagcaggggcacagccttgaacaaaatgaagatttggctgttgtgttgctcacattcttctaggaggagtccgaccaggaacgagagaccatgtactgaagggtaggggtgaagccatgcagatgaggtctgaggctctgagtatggttcagaagggcttcctgctgctctacaaatcaatacgcccattttccttgtgccgtcttctacccgcaaagcctgctgcagagagatgaagactggtttgggctggggagactgtcgtccttgcagacatggaagcaccaggtcatttgtcccaagaaagggactgcagccttttgtcctggttcatggtgtctccctcctcttccttgtttgcagaagaaatcactcgcgactcaggagggccatgtcaatcagccctgcctctcagatccaagaagatgatcggggagcccttgtctgcctcatgttatactccctcgttggggacccttttctccagctccagtaagcgctggctgtccataccctgagctccaaggtcatagggcacctctctccctcctgcaccccatctttgtttcctgaagtaagtctgctgggggtcaggagcatgtgcattttggctatctgcatgcagagagccctgagcgtctctcctgtgacacacgagagcacgtgtcttacttcatgctcactccagattgaattggatgggattgcagagcatttaaaggattgaagggcatgtgctgtccaagtgtgacactcagctgtggcagctgaggaaggagccaggaggtgagccactcgcctgcggcggctgtggaaactaagccccacaaagccaaggctggtgagcgatgccgcccacggcgcagctggctccaaggtgccttcgctccatgcgattgcttcacatcctgtttgtccagaagccggagagggagagaaaagagaaagcctgatgacccagtggcggggatcggtccttccagggctgggacggcaagaatggggagggcggaattgggtaattggggccaggcagatgtcacaagtgttaactaagttctcacttgtcacttgggccttggtccacccagagaaatggctggagtgaatgtgtttttcacaattaatgagaaacattcttgtgctgtgggtcttggaagggtagcctgtagccctgggcctggaaaacaaaaaagccacaaggaaaccgagatgccacccctgtgcggcgtgggtgggctgcatcccctcctttaccaaggggcctcactgtgctccctgcctgctctccagggtctttccgcagagttcgctgggttcctcgggctggccatgccgattttgctcaagtcgtctggggtttgccagcggtgccaggatgcacggctgggccctgtcctcagctcactctgagtcctatctccaccaggctccttttagaaggcctttccctctatgcctcagtgaatccctcctacctttggggtccccgtaagtcacctacatctatgcctgggcagtctctctgaattttgggggatccttttccctgccatcgcctggactcattggcagatggtgcaggggtcgagctcacaggctccagtcggctgggccagggtgtggactccatctctgtactccctagcattgggtccccggtaggtgactttgcgcctgtgaccttgctttcctcctttgtaaatgtggggtcacagttctaccttgggagattccagcgaggagcgatgcatggaacgggcttagcacggtgcttggtatacattggtgggttttcatttttgttgagaagcaacgatggaatcaactgtacccagaatacttatactggcaaataatagaaaataatgatgtcttatctcatgaggacactgatggttttccctacaagtctggaagtgagtggatctagggttggttagagtcagggtcagcaaaggttttcatcttcagtaaagtaccagagagtacatattttaggctttgagcgtcaggcgttcgtttttgcctgctgtttagtgtgagagtagccacagatcatgcgttcctgactgtgcatcgactgtgttccaataaagttttatttgcaagaacaggcagtgggctggatatggcctgcaggctgtagtttgttggcccctgggctagagtatcaacagactcgaggctttttcccttccggccccatcatcttgacagtgttgacattttgtcctgaggctctctcatcatggttggcaatgtggctgcctccatgtccacaagcatggaaggaaaatgcagtaggcaaggaggaaggatgtttatctcatcatgtgcctgccttttttggggagaagacacttctgagaagcctgcagcatccatccccagcaggagctgcaggggatgctggaaagggtctaatgtgcagcgttcatggacggaggaaggtcaggcacgagggggctgggcatggctgtggggtccgcaccagccacttctgcctcacctccctgcaacgattgggccttctccaatctgctctggaccatcggagcaaaggtctggtcagacagctttcctggcctcttcagacaatagtagctgtgatgctttgtgaacagagggcgcctacagcgtgcaaagggctggttttggcaatgtaaaggactcaatttctgctttacatcagaaaatgccaaggtaagttcaccccaaaacctgcacatgatgtctctcattatatgagtaatcaccaaagctggaagccaccagatggatggataaacaaattatgctacttacatacagcaaaaaggaatgaactattgaaatgcagctacgtggatgatctcaaaggtattgtgcaggttggaataagccaatgcaaaagagtgcaggagtccattggtatgaaatatctagaaaatgcagttatagtgatgtgagtgggtcagtgtcttgccagaggccggcggtcggagccatgtgactacaaagcggagtttcccagccttggcactactgggtagttctcagttgggggccgtcctatgcatcgtaggatgttgacagcttccctggcctccacccactcaatgccagtagcaactgctcagttacgacaaccaaaaatgtctcaaacattgccacatgtctcttggggagcagcatcaccccagttgggagccactgagctaaaaggcagctcagagagttctttgtggcgtggagctgctctgtatcccgattgaagctgggtaccggcgtctgtacacgcgctagtgcttacagatgggcataccaaaaggggtggattttactgtatggtaacttaaaaactaagacttccaaaagcaacaaaacacaccacagagagacaagcactgagtcccaatgaagaaaccagcaaagccatgacctctgggcccctctacctgcctgtcaggtaggccgggcccctttcccacctggcagctgcagcctgcagagagctcagttattataccgcaggaaagcctttctatcccacccttaaggagaatctcttggagatagaatacaagatgccgagttaaatttgaatttagacaaacaacaaagaatcgcttagttcagcatgtccctcgtattgcaaacattatatgtttatctgaaattcaaattcaatcaggcaccctgtttttgtttttttttttcaaaatctgctattcttgggcaaatctgcaggctttaaaaaaaaactattaaacctctgctaaaatatattttcaaactttctcaaagatacagattttatggttaaaatatgatgcaggtcctgccttcctgcctacatcaatttgttcactcacctcgcccctatgccttacagatgcaggctggctccctagccagtgtgacttgtccgggacatttaaatacaaataatcaaagtaaatagttacgcgcactgactaaatctgatattttataacataaaatgaaaaggaattgttctcctgcaaaataacctttctcagcccttcctggggtattagaacaaaatacatgttacatctgtacacgagcacctacgttagtatgtgctttatatatatatacacataaaaaatacataatatatattaatatgtcttctatattttatatataatatatactatatatattatagtatatatactatatatactatagtatatatgctatatactattatataatataatagtatataatatgtaatagtatatatactatatataatatatagtatatattatatatctatgtataactatatattatatataatataatatatagtataatatgtatatattatataaatttataaatataaataaatatataaatttagatataaatatatattatataatatactataatatgctatattatatattatatataatatatattacatatacaataatatacaattatataatatactatattatgtggtatatactatattatataatatactataatagaaaatatataatatatagtatgtatactatctatactatatatactatataatatatagtatatgtatattttatatctataatatataaaatatgtataatatataaaaacatatatatactataatataaaaatatataatatatagtatattatatatattatatattatagtatatattatatatatatgttttaggtggagtctcactctgtcacccaggctggagcgccgtgacatgatctccggctcactgcaacctctgtctcccgggttcaagcgattcttgtgcctcagcctcccaagtagctgggattacaggcgtgcaccatgacgtccagctaattttctttgtgtttttagtctctactaacacggggtttttagtctctacaacacggggtttctccatgttggccaggctggtctcaaactcctgacctcaagtgatctgcctgcctcggcctcccaaagtgctgggattataggcgttagccaccacacctggcctacatttctttcttcctaggtgtaatcaggctaatttgcatgctcctcctcatttagtggctcatgggagggaactttccttctgttggccccaccagagcctgcgcctgtcttgcctctggagcaccccagagcacacggtagtgctgggctcagtacccgaggcatgaacacgtgttcagtaaatgaatcttcaggcactggttgatgcttcatgatgcaccttctaagttcattaatctcttcttgataaagcactacattctctcttgggttttgtaggtcagactcggctgcgatgactcacctttacacatcttcctttcttggcttgtttagggagtgtgtttgtacagccatggctcttgaccagggatggttttcctcccaggggacatgtagcaatgtctggagacatatttggttgtcatgacatggagaggtgctactggcattagtgagaagaggccaagggtactgctaaacatcccaccatgcccgaggcagccccgatgcccactgcgctggagtgggcaggcccaccatgctggctgtggcctgtctggtgaacaagctttggagccagcgttaaagctggcttctgtgcaggagcagtgggtgcaggagaccatccttcccctaagttgttgagcttgttggaggaggagggtagtatgtgtgaggatcccagggaggccggccctgagcgtggtggggcctggaggaggggcgggcaggagcggacgcgcttctggaccaccactctctctcccagccttgttggttccccacacggcattcagaatgggtctcccaccacagaaccctggccacgtcgccccctgcccaaatcccccactgggctgggagaccccaggtgacccagccccatacccacctcggcttcacccccttgggctcctcactcactctctccagcctcaccccctcgggctcctcactcacgctctccagcctcaccccctcgggctcctcactcacgctctccagcctcaccccctcgggctcctcactcacgctctccagcctcaccccctctggttcctcgctcactgtctccagcctcaccccttcaagctcctcactcactctggcctcacctcctctggttcctggctcactctctccagcctcacctcctctggttcctcggtcactctctccagcctcaccccctctggttcctcgctcactctctctggcctcacctcctctgattcctggctcactctctccagcttcaccccctccggttcctcgctcactatctccagtctcaacctctctggttcctggctcacttctccagcctcactggcctcttcactgtgctgacacacaccgtgtatttctcatgaacctggcatgtgccattccctctgccaggaacatttcctccccaaagcctcccatggctcactctgccctgtacactgtgccccactgtcatgtccctgccaccctgtcctaggttcttcctagtccttgccaccatcagacacagcactgtgcacccctgagctgatctccctcgccagtcagctcccagggtggtcgtgttctcattcaccgatgtgccccagcccctggcacacagtaggtgctcaataaacagttgctgaatgaattaatgaaaaaacaagttagttgttcaagcctgggacacagaacctacgttaggagaggaggacgaggcaaaggatgcttctatctcagtgtttccagatgggaagctcctctgtggccaccagggagaaggtcagtgtgtgtttcatcgacgtggaaatatgtctgcaatatattacgtaaagggcagagtgatatgaaacaggattgacggtgcagtcccaatcatgtggaatggcaccctgtctctgcgtcacgcgtgtgcgatggggccagcctcacaggtgtgggtgaacttagaagggccctgtgctgggtttgcttctgctgcccccaccttgaaatgatgaatcacttttgaacaagaggccccacattttcattttgcaccgggccttgcagattgtatagccggtgctggcgcctggggatggatgggaggtcgctgcccgcaaatgggctctgagcaagatgttccagggcctacgttcttctctgtgatttcctctgtttgcagtcatcaggtattgttttcagagccccctgtaccccaagaaaaagtcagataactgagttcagagtatttcagtccaatttcttccaaatgactatagtcaggcatttgacatttcaaggaataacagggacaaaaagacctagctgttggaagaagttgtcccctccccacccctggggtgctgacctccaagctcatgtgtaggtcccacccccttctggggagctttgaccctagttgagaactgactgtaaacccagacggaagggaggccttgggtgtgtttgcagcacgagagcttgtggttgtcgtggcagagaatgcaggctttggttttgacagaccagggttcgaatcttggccttgccgtggaccagctcaaaggccttcctcactcagagtcttgttcctcctttgcaaagtgaggttgcagcatctgccctggggctgtgttgaggatggggtgggccatgagctcccagtctgctgctggtgaggcaggcatttattgggtaaacagccagacactgcggtaggcatccttactgtttatttatacaaactgtccctctaaggcacagtgagtgggtcattcccacccctgttttgctttttagttttttaaaaaatgtgagatctaattttcctaacataaaactcaccatttcaaagagtgcaatttggtgattttttttttttttttttagtatattctcattgttgtgcagccatcccattgtctgattctagaacgtttccgtatcactccgaaatatcccttaagagccactctctgctcccccaacccctagctctaggcaaccagtaagctactttctgtttctatggatttacctgttccggacatttcatagaaataggatcattcaatgtgtggcttttgtatctggcttcttccatttcgtgtaacgagttgaaggtttgtccgtgttgtatcatggatcagaaaatgactcctttttatggcaaacaatattccactatatggattcaccatattttgtttatccattcatttgttaatggacatcgggttgtttccactttttggccatcataaataatgctgctgccaactcttgtgtacaagtttttcatgtgaacccgtgttttcagttctcgtgggtacacgcctaggagtggaattgttgggtcacgtgaagactacatattaaactttttttaggaattgccagtgtattttctgtatccctttgttgttgttgttgttgaaggtgaataagtgtctgctgtggtgttgttcagcctttaggttaaaaatctgaacctttttccaaacttggtgacaaaggggaagattccatacctgtcctcagagtacctgttccacgtcaggttccagatggctggcaccatgctccctgtccccaagtctctaggaaaggggcaagaacaacccaaaataccagttcagactaagaaatcgaagggtttttcatcttagtggctggggtgggaatgcgggcttcagggctggcttgatccagtgacttagcaatgtcaggagagacccggtctctgttctgccttctaccagggtggcctctttggaaacatggtcacctgtggttgccagatggtggctgtttctgtggctccatctatccctcctccctcaatcgtgtagagagagagagagagagagagagagagagagagagggcaggcttccttctggacactagagtgggaggcttcttttccagaaacctccaggatacttctccttcatttattggccagaatgggtcatgtgctcatccctgaactaatcactgtagccagaggattagttgccttttattaaaccacaggccccacctctaaggccagggtggaggctatgtaaggcacaactgccttaatgaaaatccggttggctatcacggaaaggggggacagatgagtctcatggcatcatccccattttacagatgaggaaattcaggccccagcatacaacttgcctctctcagcccacacaggctggttagtggcagatgcgggtttaaacacccttgagactcacttcttgcccctctgtcctgacatttctcagctgaggctgtggctccctggatgtggctgtcctgacagctgcccaaggcaagccagacaccttcactcagaggtacagagagactttttgcagcgcgtggatttaaggtatctggaacagcatcagcttttcaggccaggcatttttattttgccctaaaagccttctagtgggggaaacacaattcctaggggctcagctttaatggtttcttttatagaaccattcaaattatagatgggtgaactccgggaaaccccgctcaagaatgcaggaaagccaaacgttaaagggagttaaggtaaaatagcggcgggtgggggaaaatttgttcttttaaacactagttgttaaaaaaccaaagtgaaccccctggtgctgatctggtcctgggaggctgggtttcttgacttctggcccgtctgggggactccaggtgaagttaattccagatgtgaacaggcccatcgcttttgctggcctctgacccctcccatctaacttgggggcaccgtatctgcagaggctcagcctcccaactccccgtcatcctcacctgggttcagattctactttgttgcttccaagccgggtatccctgggcgggttattcagcctctctgagcttgtgctgtcatgagtaaaacaggctttgtttccactggatgctttatttttggctttgaaatactcatcacccccagacatggtattacatatatatttgccaatgacctcatcattgtcaaagccagtggatagatagtgtgttcttaggtccatctgcagagcaacggacacggagtttgctccctctattttcctcccctgttttccgggaccccataccctgttggtgtccccattcttcctgcccaagcgtcttccagatccttccttaccgggtactcctgcacagtctccgtttcattcccctgacctctcagtggaacacagaggccaccttcacattgcttgtcaggctgtacacactttccccaggcgagctcatccagtcttctggctttaaatgccatctctacactggggacacccaagcttacattactgtctggaccactgccctgagctagcatttattgagcacttagggtatgcaaagctctgtcctgagctagcatttattgagtacttagggtatgcaaagctctgccctgagctagcatttattgagcacttagggtatgcaaagctctgccctgagctagcatttattgagcacttagggtatgcaaagctctgccctgagctagcatttattgagtacttagggtatgcaaagctctgccctgagctagcatttattgagtacttagggtatgcaaagctctgccctgagctagcatttattgagcacttagggtgtgcaaagctgtgtcctgagccccagctgtgcattaagtgacagaggcagggctttgaacctgcctgggccctactccctccctcactagcccagagctcatctcttccaactgatcaattgatcaagcctaggccagacctctgctgcccacctgacaccttccttttggtgtcaagtagggatttcatacaatatctgctaaacgaaactgcattttgtcttccaccctctatttcccagcttatgctccattgcctcagtttccctaccttggtaaacagtccctcccttcttccaggggcttgggccaagagcatgccagtctcatgagactcccctttttctcacaccttttataatcccttcccaaattcagtcctaaatctgccaccttcctggtttggaggctgtgttcttgttattcgagacatcacctttgggggaaactggatgaagggcacttgggacctccctgtacatcgtctttcaacttcctgtgaatctataatcatttcacaacaaaaagttaaaaccaaaataaattctaaagattttaaaaatgaactcttgaggatctggccttttctcaccagcctccctccccactgccctgggtccagtctcacgtcacctcccacgtggaccattctgttgcctccacctggtctccctgcttccaggttgacccctgccatcggctctccaggggcagcctgagtggccttataaacaccactgaaagtcccaccccagtggttcttgcttcttgtagagcgccttggtgtcctgaccagggccctggatgcgaagtcccactcactgggtggcttgaaacaatagggctttattgtctcacagtctggaggcgagaagtctaaagtcaaggtgccacagggttgtcctcttacaaaggctctagggaggaatccctccttgcctcttctggcttcagaggctcctggcaatctttggcatttcatggcctctgtcttccccaggctgtctgcatctgtgtctttatgtggccttcttatggggacactagtcactggattaaggctcatcctaatccaggatgagcttattttaactgacgacagcacatctgcaaagaccctgcttccaaatgaggtcacatcctgaggctctgtgtgggtgtgaattttagaggacatcagcaacagaggacactgggctgaggcaggtgctcgtgttgcccataggacccgacctgactcgtgcccctactgcccctcccagttgtccctgctacttgcccctgccccttgaacacaccctccttgctcctgcctccgggcattcacctctgcagttccctctgcctggaatgcactcttcccaaacatccattgggccccctcactcactgttacccagatctctgctcagatggcccctatagtcattagggttgtttgcaattgttcccaccttccctggcacggagcaagattgccccccaactccctgaaattaggcagataccacgacctgctttggccaatggaatgtgagtggcacttatggggttcgctagcttgccaccttccgcacccctcagcctggttccccaccccttatatttcctgcctgccttccccacttgcatggaaacccagagaacaggatgttttcttggctgctttcgcagttgtgttccaagttccttaaacagtacctggcctagagtgagtactcaataaatacttactggatggaggaataaggagttcatgaatgaaccgggaggcatagcatctctgcagccctgtcccgctcgtggccctcctgtaactactcttctgtgcacttggctgcttcctgtccagggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcaggtatgcttaggtgggagggatcacagacccaccacaggaacccagcagggccccggcgggacccggcaggagactgactcaaaatccattcaggtgctcaccagatggctctggaacaaatacagcaggaagaaaacccccaaatccacccctacacaggacatcttaattctgtaaaaataaactagcttagaaatgcaagtagcaaaacattcgtataacacaacaccaagcatgtagatatttaaataaacagaacaatggcggcacttgcagctacacagagatgaaggaagaccctgaaacatggatgggaagacccctggggggcttaccccatggaaggagggggaggaagaaatggggaggtagaagagtttgctgtatctttatttcataaatgaaaaatattttaaattcatggcaaactttaatacttgataaatattatatatatacacacacacacacatttttttttttttgagatgaagtctcactctgtcacccaggctgcagtgcagtggtgcgacctcggcttactgcaacttctgcctctcagattcaagtgattcttcagcctcagcctcccgagtagctgggactacaggtgtgcaccactgtgtccagctaatttttgtatttttagtagagacggggtttcaccatgtcggtcaggccggtctcaaactcctgacctcaagtgatccacctgccttggcctcccaaagtgctgggattacaggcgtgagccactgcacccggccaggtggtaggtgttttaagaatatatgatgtgcgatacttttcagtttgtttgaaatgtttatttacgataggttttaaaaaaattaaagataatatttttattgcaagcaaatcaaacattaacagtaaatataagtaaagttaacgcattgtgcgaaggagacttccaggaggtcgtgctctgcaggtcctctaaagcagacagcttttagcccatcatgttgtgtggttcttgaggctctgaggtagatggcctcccacttcacagaggggaaaactgaggctcaaagagggtaagtcgtttgtctaagggcacagtgtaggtaactggcagccctgggattgggtccctggggtctgggttgtcccttgccccaggccctcttccctgttgggcattgccggggccatctacctggcctggatgagcttcggtgtccccagcaatcccattgggtgctttctgacaattcaccaggcattcgtggagcccccacaggagcctggctttgtcccgggcactggggctgtggctggggtgcaatccctttccccataggctgattgggaaaccgacattgacagcctctggtggcctgggggtgctgggatccccagaaggtgcattctggttttgagctttggaggtgggctggcctggagcagccctgctggcaccgtgggcatctgtggacagccctcccacaccccttgcctggctcatgccccctgcacatgcagtgtcaagtccgccagaagatgcatcgggactcctcccagactaaaaccaaagcttcaaataatgaacctcacaacaaaccattttccagtggactggaggggtgacacctcccagatccaaggagcccagtttgctccccatccccaatcccatcccgccggccaggggagctgctgcccgggggtgccgtttctctggctcttcaggaagccatttgcaatgagcagggcaatagcctctccaagatgccagtgtcttaatctctggaacccgtgaatgtgtcaccctccagggcaaaggggagttacgactgcccttggaatcacaggtgctaatcagctggccttccaatacgcgggctctgtgtagcagggtggtcccatcagtccttataggagagagcctttttgagctgtggttggagccatgtaagcacagagcacagaggggtggagatgagtggggccaccagccctgggatgtgggtggcctggagaagctgcacaaggcaaggaagggatcctcccctagagcccccagttgcatttacctgctaagactggtgttggacttcagagccacagagctataatccgcttgtattgttttgataatttgcttggttaatttgttaaagcagcgataggaaagaatacatctttgttggcaaagtgattttctttttcttttttcttttcttttttttttttttagagacagggtctcacgccattgcccaggctggcgtgcagtggtgtgagcatggcttactgtagccttgacctcctgggctcaagcaatcctcctgcctgagcctcccaggtagctgggactatagatggatgccaccacacctggctattttttgtagagacagggcctccctatattgcctaggctggtgtcgagctcttgggctcaagctatccttccactttggcctcccaaagtaccgagattacaggcatgagctactgcccccagcctcctcagagtgcttccctcatcctgctaaggagctgggacacaaccatctgggggccggctcaggagttgcagccttcttggctccaggttgatcacaaggcagaaaaaggtctgaggtgcaaacctgccctgccaccatgtgggaagctattagctgcttatcacctccggggcctgcggttggtcccaggaagcacccaaggggagcaaggggctattgagaaaggtcctggcgaggggatagcagcagccccacccccaaattaaccctctagtgccaatagcttcttcctccttacctagcctagcttgaaatttatgttcattttacttttcaagggagaaggcaggtcagtggggttggtggcctttttaagacaaggcttcctgacccctggcgggtgtcctggggcccccggatggacctcagtgggtctgtgtggcccagagtgtgtagggattccgtatattttcttttctgacagtggatccatttttccaggtttctcaaaggggtctttgatctcccaagtcaaaaaccaaccaaattccttcatttgtattcgaagcctcttttatgctggactcttgaaggctaggattcaatgtcgaacacccacacaaaggctgcccttgggggtgttaatttaggacaggaaggagggggttgccattcacatccatacatagtaacagacccagagtcagggtggtgcctagggaacgcagcccatcccgagggctgcagacaacatttcgtggcgagcgagctgagagctctgggtccagtgggtgcccacgaggccaggctggtccggagaggatgctctgggctgtgggacctgcaggggcagaggcctgtgctgtggggtttcctggcgcctttggggagtggggaggaggctgtgggggctgaagcaggggaggggagtgagggtgggcgggtcaggcattctcttgggagtcacgtcttgagtttgaacttcatgccaagcatgttcagaagtctttgcagagattcaagctgtggtgtggggtgcaggtgataagatcattctggctgctctaagaaaggtgaggaacagggtgggtgccgagggggtgctcggaggccggagactccttagaggatgtggcagatcatccaggcaggaagtgtaggcaaactgcatcccggcagagacttccgtgtcttggagctccatcgggtgcacctgggtaatgagggggagaggaactaggcatcgcgggcttagaattcactctgattttccccaccgcctcctcatcaaagccccaccaagtctccatttacacagcccccaggacggggctctcactgtttcccgtggcagaaattcattgctgggaacctgcctccttcccgcggatggctcgtggccctgtttgcagctcttctaaaacctgcctggaagttaagaaaaaaataaaataaaaataccgaggcctgggccccaccctaggcttaggccagagtccttgagtgtgagtgtgtacgcctgtgtgcctgcccctttgaatcgctcgtccccccggttttgggctggagccctgccgtggagccacacaagttgaatctctcggcagccctgtgtgtgctggggcgggggcacatgctccggcacgctaccccacgcggagctcgctttcctgcccgccagccccctcccccggggcttcacgtgctcttcagatggtgcggtttggggttgagaaactgggtccctgcacttccttctccccacccacgtttggacccagctccctggtaagcagccgcctttgccagatgacccgtggaggcgggagctgagcctaagcaccagtcctgacttgtctgcggcccaagcagggggttgaggaggtggatgaatcccggtgctggcgtcagggctgtctcctgctcactttctgttgcttgggggcgggtggggcaggcttggacggacaggggagctgggagtccctccttcgtttcctttccttgttttcctgctaataagtcctaaggatacacaggagctccggccactttctgctgggacagccgtgatcaaagagccctggaagcacagagcagggtctggagtccctggtggcagggccagtgcccacgcctcactcgtacaccataactagcttcatgagctgtgctcggccttggtctgtttggccttgggtttgaactaagttatgccaaatgtcgtggctttactttaagacagggttggggaaagtagcactcaggccactccttgtcccttctgtgctcatgacagacattgctaatagatcatggcctctcctgtgctcatgacagacattgctaatagatcatgggacttccttctgacggagcctgaacacagcttcagaatcctccttgactcaggacaccaaggagtcagcaatgtccctggctcgagctagcagcttcacctgacacatccctgagctgaggggatgttccttctcctccaccctgccttctacccccccacagggaagagggaggaggctcgtggaggggcatggctacctgtggccctgggcattgccacagccatgaaggccatcttaggtttctgcttggcatcgtgtgctctagagggcaggctgtagagtccagctgtttgggctcctcccagatggttccttgaccttgaccttcctgtgttgaggacaccctggccctggggaggttcctgctgccccagagctggttctctctctcccagccctgctactcccccacggagggtggggaccaggggcctctgggctccccctggctgcctccatccactctgagcacccccttgcagcattgagccttggggctggttccagccacgcagatcttccctccgcccacactgtctgctgacccaggccccagcttcctcattccttgccaggctcagtgcctgcctctgatcctctatccgatgctactccagcggcctcagacatggagggcgcctcgtccccactgctcagcatcgtcatgcaggaatgcctcgcccttggatgcctccccaccctcctatctcacttccttttggttcttacccacatgtcacctcctcagaagagcgcctgctggcacccgcggcagcatgcccgctcactccagcttctcctgccttgttttcctctgtagccctcatctccgtgtaagtcatgtgcactcacttatctatgacccgcctctcgttctggaaaagcccctgagtggcagggctttgctgtcttacacctgggactcatctcatgcctgcacaccaggaagcagcccctagcaatggctgaatgaatgagtgactccacaaggcatgcaggccgcgagggcagggcacccaggggcaagcgctcctgccccaaagcctggagcccaccagccccgccccagccttcagcgagttcacttcaccgaaagtctcaagtgtctcctcaggaatcacacatgtgattcggttataatcaattaaatgtaatttcgttattggtgtgcatatctttccacattgcttttctgaactgtagataaattttatatctgtataaatagatatattcaaaaatggcattttgggaggccaaggcgggtggattacctgaggtcaggagtttgtgaccagcctggccaacatggtgaaaccccgtctctactaaaaatacaaaaattagctgggcatggtgatgagtgcctatagtctcagctactcaggaggctgaggcaggagaattgcttgaacccaggaggcagaggttgcagtgagccaagattgcaccactgtactccagcctgggcaacagagcaagactctgtctcaaaaaaaaaattgctgatgaaaataaaagcagcctgcttttcagtccccagcagggagcatggtgctcctgtctcagcctgagccttggaggccagttcctgactcctgtgctctccatgctgttctcctctctcctgcctccttcctcctcaaccctcttctttctcctttctgctttccactcttggcttgctgcttctagcccatttcattccacaattgttctcagccatggggtagctaaggcacactgaaggtttccaggaccaacagaatgtccagtctgtgtctgaggaggtgtcctaatttgcagtgtgtggtccatgggaggctagcttactgcaccactcctgtcccacccattttacagatgaagaaagtaaggcttagggaagggagttcggcgatgtccttcttatcttaccatttctcattatcctagaagctatgcagatagaattctcatgaatcagagaaaagccaaaaattgagtggtgttccactctttgacatataccctaatggcatgtagtgggtgtggaggaaagagccatgcattcaaacagttaacaggtgtgtgtgtgtgtgtgtgtgtgtgtgtgtgtgtgtgtgtgtgtgtgaatggagaatgtgcgtagtttcaaatttccctaacaagtgggctagaagaagaagaataaaatatgaaactgccatgaacactcaagcctaccccaggaggtataggagctctcttcattttgcaaaccaggagtccaagatctaggagagctggggtttgactccagagctagagcagtccccaagacctggtcttgactcacgagttagactccactcagaggctgactgtgctccagggtctacacctctaagggcgacacctgggctcaagcagactgccgttttctatatgggatgagccttcacagggcagccagttgggatgggttgaggtttggctgtagacatcagaaacccaagtcaaatgcgcttcaaccagtagaaaattcaccagcccgcagagctaaggttgggtggacattagggttggttgatccaggagctcaacagtgtcctctgagccccagctccttctgccccaccccaccatcttcagtgctgcttcctctcaaggccacagctgtagttggccaggggggcttcattattttttgctcctgggcagtaggaggaagagaatgaatgtctctccatgggtctttcttaggaatgtgggaactttttccagaagtctctatgtcttttagtttgtgttgggtcacttgcccttcctgaaccacttcctgactcctggacaggatgtgcactgatgagcttagctttggggatctaatagtgactttacaaagcctctttgagaaggtgacattggaaccaaggcttgagccagacacaacaaagattgcagggaggggcattgcaggtggaggaaacggcacatgcaagagccctgcggtgggagtgagcttggtgtttggtcaatcagttgtcagagcacaccgggccctgtgggccacaggcacagcctgggccctgctctgagtatgacagagagcccctgggaagttgtaggtggaggaaagacaggtcatgactaggaaaaaagcaatccctctgttgtggggtggaaggaaggttgcagtgtgtgtgagagagagacaagacagacagacagacacttctgcaatgtttacaagtgctcaggccctgacccgaatgcttccaaatttacgtagttctggaaaaccccctgtatcattttcactactcaaagaaacctcgggagtgttttcttctgaaaggtcatcaggttttgactctctgctgtctcatttcttcttgctggtggtggtgatggttgcttgtcccaggccctgtcccgcatcctcttgcccctgcagagggatgagtgtgttggggcctcacgagttgaggttgttcataagcagatctctttgagcagggcgcctgcagtggccttgtgtgaggtggatggggtttgattcccttatggaatccaggcagatgtcagcatttaaacaacacacgtgtataaaagaaaccagtgtccgcagaaggttccagaaagtattatgggataagactacatgagagaggaatggggcattggcacctcccttagtagggcctttgctgggggtagaaatgagttttaaggcagttagaccctcgaactggcttttgaatcgggaaatttaccccccagccgtctgtgcttcattgctgttcacatcactgcctaagatggagggaactttgatgtgtgtgtgtttctttctcctcactgggctctgcttcttcacttccttgtcaatgcagagaacagcagcagcgaccagaggcaggcctgtaagaagcacgagctgtatgtcagcttccgagacctgggctggcaggtaaggggctggctgggtctgtcttgggtgtgggccctctggcgtgggctcccacgaggcagcgggtctgtgctcagtcttgtttctcatctctgccagttaagactccagtatcaagtggcctcgctagggaaggggacttgggctaaggatacagggaggcctcatgaaatccgagagcagaaatgtggttgagacttgaacttgaaccaggaacccaaacactttggactctgaaccccattctctgcatgcacctcattcccatcccttggctggctgcttctcaagatgatgccgggccgtgtgtttgaatgtagatacctggggagccatctccccctctgccctctgacttcatttaccccattcccattcccacgggagggacggatctgcccagcttggttcaggcacttgttcctgaaccagtcaactgtttcaggggtggggtcatgttactggcacatggctgccccctctggagccatttgcatggagtgaggcaaaaggcaggggatgaatcctaggagaggagtgagggtcatgtgatccacctgccgtgagctctggtgtgattctcattcagcagtcatgcagcatctgcagcgttctgggccctgttctaggtactggattggagatgcagcgatgaacactgcaatgtgtctgccctgtggggctcaaatatccctggagagggtattgtcatgaggtcatcagggcaactggtggtattctaccctcagggagcttgtagttcagtgggagagtccagaatcttccctggggattatgcccagacacactcagggcgtacgtgcacacagccagctctgagccctcctgtgagcctgccctcaggactgatgaccacatccacctgcagctgggacagaacccaaactccaggggcctctgctggaagattccatgtgcttaagcatcactgaggagtatattgattattgggcaacatttctgtgccacccagaccctagaggcaaggatggcacatggatcccttactgaccagtgcacccggagccagcatgggtgatgccattatgagttattagcctctctggcaggtgggcaaaccgaggcatggaggtttgtttaaggtgaactgccagtgtgtgaccacctagtgggggtagagctgatgattgcctcacaccggaggctccttcctgtgccgcgttctgtccagaagacacagccatggatgtccattttaggatcagccaagccccgtggggctttccttcatttttattttatgtttttttagaaatggggtcttgctctgtcacccaggctggggtgcagtggtgtgatcatagctcaccgcagctttgagccgtcttcccactcagtctactaagcttggactataggccaagactatagagtggtccttctttccattcttttgggaccatgagaggccacccatgtttcctgcccctgctgggccccctgctgctcagaaggcatggtctgaggcttccaccttgggtcgtgagcctggcgtggtggtttctggccagcatgggggttgggatgctgtggctcaggccttctgcatggtttcccacactctcttctcctcctcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgtggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagattccatgtgataatgagattaacgtgcccagcacgtggcgacactcagtaggtgttattcctgctctgccaacagcaaccatagtgataagagctgtagggattttgttcttttgcttagaatccaaggttcaaggaccttggttatgtagctccctgtcatgaacatcatctgagcctttcctgcgtactgatcatccaccctgccttgaatgcttctagtgacagagagctcactaccaggactactccctcctttcatttagtaatctgcctccttcttttcttgtccctgtcctgtgtgttaagtcctggagaaaaatctcatctatccctttcatttgattctgctctttgagggcaggggtttttgtttctttgtttgtttttttaagtgttggttttccaaagcccttgctcccctcctcaattgtaaacttcaaagccctacttgggattgaaggtccttaggctggaaacagaagagtcctccccaacctgttccctggcctggatgtgctgtgctgtgccagtatcccctggaaggtgccaggcatgtctccccggctgccaggggacacatctctatccttctccaacccctgccttcatggcccatggaacaggagtgccatcgccctgtgtgcacctacttccatcagtatttcaccagagatctgcaggatcaaagtgaattctccagggattgtgaaatgatgcgattgtggtcatgtttaaaagggggcaactgtcttctagagagtcctgatgaaatgcttccagaggaaatgagctgatggctggaatttgctttaaaatcattcaaggtggagcaggtggggaagggtatggatgtgtaagagtttgaaattgtccatcataaaatgtgtaaaaagcatgctggcctatgtcagcagtcacagcctggaggctgtgaacagagtgccagtcactgatgctcttgcctggcacctacagttgctggaaacccagaagtttcacgttgaaaacaacaggacagtggaatctctggcctgtcttgaacacgtggcagatctgctaacactgatcttggttggctgccgtcagcttaggttgagtggcggcctcttcccttagtttgccttagtccccactattccctattgtcttacctcggtctattttgcttatcagtggcactcacgtggcactcataggcatttgagtctatgtgtccctgtcccacatcctctgtaaggtgcagagaagtccatgagcaagatggagcacttctagtgggtccaagtcagggacactattcagcaatctacagtgcacagggcagttccccaacagagaattacctggtcctgaatgtcggatctggccccttccttccccactgtataatgtgaaaacctctatgctttggttcccttgtctgcaaaacagggataatcccagaactgagttgtccatgtaaagtgcttagaacagggagtgcttggcttggggagtgtcacctgcagtcattcattatgcccagacaggatgtttctttatagaaacgtggaggccagttagaacgactcaccgcttctcaccactgcccatgttttggtgtgtgtttcaggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggctctttggcctgtgtctgtctgtgtgtgttgtgtttttctctcagttcttggacactgaagttctctcacactgctaagagctccctgccttcgtctccaccgtgaacgctctgtttagcatccaggccttgcggggaagtggccgctcgtcaatatttggtgcagctgtgtggggctccgggcaggagagatggaaccaagcaacacatgtgaatttggtaggctcgactacaaaggtccttgattgaattacag

SEQ ID NO: 16519 - DNA, 67386 bp, Human
  misc_feature (1)...(67386): n = A,T,C or G
ggcggatcacctgagatcaggaattccagaccagcctggccaacgtggcgaaaccgcgtctctactaaaaatacaaaattagccaggcatggtggcacacgcctgtaatcccagctactcgagaaggtgtggcaagagaatcgcttgaacctgggaggcagaggttgtagtgagccgagatcgtgccattgcactccagcctgagcaacaagagcaaaactctatctcaaaataaataaataaataaaatacaaaaattagcggggtgtggccaggtgcagtggctcacgcctgtaatcccagcactttgggaggccgaggtgggcggatcacgaggtcaggagttcgagaccagcctggccaatatgatgagaccccatctccctaaaaatacaaaaattagctgggcgtggtggcacgtgcctgtagtcctagctactagggaggctgaggcagaagaatcgcttgaacctgggagatggaggttgcagtgagccatgattatgccactacactccagcctgggcaacagagcaagactccatctcaaaaaaaaaaaaaattagctgggtgtggtggcatgcacctgtaatcccagatacttgggaggttgaagcaggagaatcacttgaacccaggagacagacgttgcagtgagccgagatcgcaccattgcactccagcctgggcaacaagagtgaaactccgtctcaggaaaaaaaaaaaaaaaaaaaaaaaagaataccctcttctccagtgcctggcacactagtaaaggctcagtatggttgttgctttaggatggaggactaacacttctttcaagttcaaataggcgatttccaaactcaatgccaattctgaaactgctactacttatttttcaggcagtggaaacacctttctggatgattctaaggcagaacttggctcaaactctcaatgttgccactgttttcgatattaacccgaaaagcctaagatataccaaaatcagaagaagccattgagactatgtatgcttacagtagaaaggcattcagcatcagcaaataggtcgagtgcctcctgcttcccaggccaaattttctgaccccccgccaacaaaaactagctttcaagagggctcaggctgtcacaatgattggcattctttgctgtaagtactacagtattgaccttgaaatttttatccttgaaaattgagtttcatgaatgtttatcaaatgtcttggttccaggttaaaaaagtctttttttttctatgtgctagtctgcccttatacccttacaaaagaacttgtctttaagccataatttaaatatttacaaaaaatttaaaattaacacctgtccatggtacaaagctcagaaaacccaacggtcttagatgaaaactgtctcctcccatccttgttccgtatctctccattcccttccttaggctgggcgatcgctattaccattaccgctatactatgcttacacattcatatcttcatttatgtgggtcttcttgtttaaaaacacaaaggcatatctatacacattttcctgtgctttgctttctttcacttaatttatctcagagctggttccacattagtacataaactgcagctttgctctttttaacggtggcaggccattcctctgaaagatggcctgatttatttcaccagttcctggttttgcggctcaggatgggaaaaaggaagtctgagtgaatcgcgttgaggttactaggaattgccatgctgcccacctcccgaagtgttaggaggtaacatctcatcgtctcatcgcactccagtggagtgtcgcgaagttgcaactcggccccaaggcggcccgcacttccacccgcacacaaaggcaggtcgcagccccgcacgcggggacagggccagcaaggggcggggaccctcggggccgccgcctccgcagccccgcgtgtgggaccctggggcgggccgccatcttgtggtgcggccgccgcctgccaggagacacctagcaactccgcagcggccatcttttacaagaaaccttcgctgcaaccgctgcgtcacatcaccgcgtctcccagggacaggaaagcctctccgtgtttggtgaagcttcaggggaagcagtcatcctgtcgtcgcatacggcaaaatcctccattgccgtagccgttcggctgacgtgacaagggaggtgcaggccaacacggcgactccgcgccctctggcggcagtgccggagcagcggcgctgtctttgacctatccggcattcggcttccgggaccgcttggcggctgtgaatgcagagctggggcgacgtggggctcgcttcctgggactgggtgtgagcttgcgcagtgagccatatgggggtcatggcctggcgtgggggcgtggccgggtggggccgctggatttggtgctggaaagctagggaagtagtcgtgcgtttaagaacggccggccggcggggtggctcaagcatgtaatcccagcactttgggaggccgaggcgggcggaccacgaggtcaggggttcgagaccagcctggccaacatggcgaaaccccgtctctactaaaaatacaaaaattagccagcgtggtggcgtctgtagtcccagctacttggaagcctgaggcaggagaattgcttgaacccaggaggcagaggttgcagtgagccgagatcgtgccacttcactccagcctgtgcaacagagggacactcgtccccccccaaaaaaaagcccgggctgggtggcttacacctgtaatcccagtactttgggaggccgaggcaggcggatcatctgaggtcgggagttcgagaccagcttcatcaacatggagaactcacccatctctactaaaaatacaaaattagctgggcatgatggcgcatgcctgtaatcccagctactcaggaggctgaggcaggagaattgcttgaacccaggaggtggaggttgcggtgagctgagattgcaccattgcactccagcctgggcagcaagagtgaaactttgtctctctctctctttctgtctctggcacatacacacacacacgcacacacacgggcctcctgtggtctcacttggtcctctttgtgacagtgccattgttaccatttacagaggaggaactgaagctcatggttgagcctctcacttgcccactttgccaaaccctggtagggatgggattagaggctccttttctttcgtgaaatgagacaacgatctgggggatcgttggaaggattaaaatgagtattcagattacaatgctggattcttaatagtgtcctctgttaataataataataatgtagtagcaacagtcacgtagtctttacagtcacaggtgcatgtgtgtagatggggttctctctgtattagccaggctggtctccaactcctggcctcaggctatcttcgcacctctgcctcccttagtgctggtattacagatgtgagccactacaccagcctgcagtttttactacaactctgtgaggtgattagtactagcattcccatttgacaaataaggacagtgaagaaagcagaagtaacttggccaaggtcacagaacagccatagcaattcctgggtggtgtggagtggaaggctctggccttaactgctacacattgtctctggtaacaaggccctgcctgaagtatattccggcttctagaggttgcaaggaaatggaccactcatcagttcttgcagcctccttatgatctacagtgggacttcgcaaaggcaggcctagtaggaaaacaaagagaagagggttggaagaagggaaggattggggctcagaaattatgagggaatggactagaaaggatagaaacaaagctcttgggcaggtgcagtggctcacacctgtaatcccagcactttgggagggcaagatgggagaatcaattgaggtcagaagttctaggccagcctggccaacatggtgaaaccccatctctactaaaaatacaaaaaaagaaaaaagaaaaaagaaaaaatgggtcgggagcagtggctcacacctgtaatcccagcactttgggaggctgaggcgggcggattacctgaggtcaggagttttataccagcctggccaacatggagaaaccccatctctactaaaaatacaaaattagccggccatggtggtgcatgcctgtaatcccagctactcaggaggctgagtcaggagaatcacttgaacccaggaggtggaggttgcagtgagctgagattgcgccattgcactccagcctggacaacaagagtaaaactccatctaaaaaaaaaaaaaaaaattagctgtgcttagtggcacatacctgtaatcccagttactcaggaggctgaggcaggagaatcgcttgaactagggggatggaggttgcagtgagctgagatcgtgctactccactccagcctgggcgacagagccagactctgtctcaaaaaacaaaacaaaacaaaacaaaaattaactgggcatggtgttgcaggcctgtaatcccagctaatttggaggctgaggcaggaaaattgcttgaacccgggaggtggaggttgcagtgagccgagatcctgccactgtactccaacgtgggtggcagagcgagactccgtctcaaaaaaaaaaaaaagaaacaaagcttttgtccccatctccaccagaagtgaagaaaagaatggcttccagcttgaggaatggggaatggggatgatggtactacactactactactactattaaatactactgctactgctacaacactacacattcatatctattcttagaaggtattaatcccagaaattcaggttgaggttgggaaaagtaggttccttatccttgggaatctgtttacttacctataaaaccagagtgtagtaaataggaatccctgtcctggctgcctagccaggttgttaggaggaaagagagatttggtgtcctatactagcattcagaatgacttgtgatgggacactgtttgcaaggctggggaaagcaggctgtgatacctacaagtgggagtgtacatttttacaactccatgaggaggcaagctggcatatctgttaatgtaacattaatcctttgtaccaatcctttgattaagcacttcagggccaaggaaactatcttacatatgtattcccccatgtgcacagacaaacgtagaaagaggtacagttgagggctgtttgaatggcaaaagcatggaagcaaactaattgttcataaataggggactggcttgatttttgaaaaatgacacatcaagcctgagcaacatggtgaaacgctgtctctacaaaaaatacaaaaatgagctgggcgtggtggcaggcacctgtagtcccagctactcaggaggctgaggcaggaggatcacttgagctgcagaggcagaggttgcggtgagtggagatcgcactactgcactccaacctgggtgacagagtgacaccacatctcaaaaaaaaaaaaaagacacatttgtttaacaggaattctatgcagcccctcctacaaaataaagtagtactgttgtagaataagctccaagatttatcacatataattataattatgactgtggctgcaaataacaatgtagccttctatagtgcaaataacaatgcaaattacattgcaaataacaatgtagccttctatagtggcttaaacagacaagggttaatctgtctcaagcaataagtagcaataagggcaggcacatctgagtcttgtatggggcattggtgtgttgtcaggaatgcagactctttttctttttaaaatttcaaaagccttaagaaggtcacagtggcacatgcctgtagtcccagctactcagaaggctgaggcaggaggatcgcttgagcccaggagttccaggctgtaatgagccatgatcatgcctgtgaatagccactgcactccagcctgggcaacatagcaagacctcatttctaaaacaactttttttaaaatttaaaaactttttgcctcatttcaccagatccctggcttggggagccttccttccccatggtgggacacctggctttggatttcaccttcttgccccttccaggtggtggaggtaatgggtcagcggggcgggagctggacttggctaagcttccaaggcaggaattgggccgggtgttgggccaggctctgagatgtgggggtttctcccgtgccccccactgcatgagttccgtgggcagatggtatactctgggtctccggttgcagtggggctagtgccccaaggtggcttgaagacctctcagcctgagggcgaggcaggagcctgggtggagagcaactgtgaggggcctccctggagccttgcactgccccagctggtgccatgaagctagagaaggagaagctggagcaaaacctcaacgagtcccaggacatcaaagctctgtaatttgccaagctcctgaagcagaagaggatcaccctgggatatatccaggcccgtgtggggctcaccctgggggctctttttttaaatgtttatttatttgtttatttatttttgagacagggtctcactctgttgcccaggctggagtgcagtggcgtgaccttcgctcaccacaacctcttgttgtgcccaggggtgttagagagaacgccacactttgagacgatttaagagtcctttattaagccggcggccaaagagacggctaacgctcaaaattctcttggccccgaggaagggggttgattaacttttatacctaggtttaggaaggggaggggaactcaaatgcaataattctacagaagtaaaaacatgcaagaataaaaaaaaaatggttacaaagagataaacaatttaaaagacaaatggttacaagaagagcaacggtaccaggtgcaaggctttaaacctttattataattagatatagggggtatgccggacaggaactcaaggctttatgttgttatctctttgagaaaaatcctgggaacttcatacattgttggtgctagtaccttatcagttaattgggctactttgaaatgctgaggatctgcttacacaggttaactccttgcggaagggggttgggtaaggagcccttagtatcttgtaaattaaggggtcaattggagtttgtctggctttcccagctagagagagtcttatttacatgagaagcaaggctaggtgattaaagagacaagcaggataaaattcaaagtaacgagttagagtaaaaacaaggttaggcgtttcactctgcctcctgggttcaagcgattctcgtgcctcagcctcccaagtagctgggattacatgcatgtgccactatgcccagctaatttttgtatttttagtagagacggggtttctccatgttacaggccaggctggtcttgaacttctgacttcccaccttggcctcccaaagtgctaggattacagaagtgagtcaccatgcccagcctctggggggttctatttgggaaggtgttcagccaaatgaccatcagctgctttgaggctctgcagctcagtttcaagaacatgtgtaagctgcctcccttgctgcagaagtgggtggaggaagcagccaacaatgaagagcttcaggagatatgcaaagcagagaccctcaggcaggccgaaagaacaagaacccgggccagtcgcggtggctcacacctgtaatcccagcactttgggaggccgaggcgggaggatcacgaagtcaggagatcgagaccatcctggctgacaaagtgaaaccctgtctctactaaaaatacaaaaaaaaattagccgggtgtggtcacgggcacctgtagtcccagctactcaggaggctgaggcgggagaattgcctgaacccggaaggcggagcttgcagtgagcagagatcgcgccactgcactccagcctgggcgacagagcgagactccatctcaaaaaaaaaaaaaaaaaaaaaaaagaagaagaaccgagtgagaggcaagctggagaacttgttcctgcagtgcctgaaacccacactacagcagattagccacattgcccagcagatcagccacatcagccagtgcgcccacaaacccacactgcagcagatctccaggttgggctggagaggatgtggccccagtgtggttctgtaactggcgccagaagggtaagtgatgaagcaatgactatgcactacgagaggattttcaggctgctgggtctcccttatcagggggccagtgttctttcctccggccccagggccccattttgataccccaggctatgggagcccccacttcactatgctgcgaggggaagcctttaccccgtctctgttgccacttggccctgccatgaattgaaactgaggtgcctgcccttctaggaatgggggacagaggaagggaagaagctaggggaggagaacctggagtttgtgccagggcttttgggcttaagttcctcattcactaaggaaggaattgggcacacaaagggtgggggcaggggattttgggacaactggttggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattagccgggtgtggtggcgggcgcctgtagtcccagctactcaggaggctgaggcaggagaatggcatgaacccaggaggtggaggttgcagtgagccaagatcgcgccactgcactccagcctgggcaacagagcaagactccatctcaaaataaataaataaataaataataaataaaataatttttgtctaattcaaaggttatttaaagattatttatgaaatgaagtaaaagaaatgagtaaataggggacatataaagaaagtatgaaccaaaaagtatttgagacaagtctcaatcaatttagaagtttattttgctaagcttaaggacacaggagacaggtctgtgtatttctccaaagatgagtttggattccaagtctggcatacttttaagtgttacatcaggagtgtctaacaacaaagcctgatatttccgtaagtgtcctcgtcatccactggtgtcctttagcttctaggactccttgtacttggtgtggggttaaaacctccagatgttgtcctaaagccagtttattggtttcatctactaaaagagcagttgctgcaactgtcctgaagcatccaggcctgataagaaaggtgtgtgaggaaaccaaagtccctgaagaacagcttagatgataggtaaaatgctctctatgggcttgtccatctaccctgtgatcatacagttttggggtgacagaggcccattataatgggacaaaacagaataagcagcccagcaagcaagttaatattcttacctgccaaagtcaagggttcccaaggctcctccagagatatggctagttgtctgatgggagctgtggcggaaggttttggccctgtcactcctggacttgcctggctatttcgtggttcctttctttctttctttttctctttctttctttctctctctctctctttcctttctttctttcttccttccttccttccctccctccctccctcctttcttttcttttcttttccttttctttctcagagtctcactctgttgcccaggctggagtgcagtggcaccatctcagctcactgcaacctccgcctcccggtttcaagagattctcctgactcagcctcccgagtagccaggattacaggcatgtgtcactatgcccggctactttttgtgtttttagtagagaggtggtttcaccatgttggccaggctggtctcgaactcttgacctcaggtgatccacccaccttgggctcccaaagtactgggattacaggcatgagccaccgcgcctggccttgcctggctatttcagccatcattggttcgggcgcggatagctccttccagtgcggtgggcagtccctcttccaatggccagttttcttacggtgtgcacactgattcatgcccaagacacagtgactggaacacccagctttgggcttcctgcctttctgcttcccttgttcagtccaagagcaaggaaagcaatcccatgtgggaggtgagcttaaggctgcagccaagagctacaccttgtgggaggtccttcttgctctttctgcttcctctgctttgtccgttattaaaaactaaaaatgccaggctgggtgcggtggctcacacctgtaatcccagcactttgggaggccgaggcgggcagatcacgaggtcaggagatcgagaccattctggctaaaatggtgaaaccctgtctctagtaaaaatacaaaaaattagctgggcatggtagcgggcacctgtaatcccagctactcaggaggctgaggcagcagaatggcatgaacccaggaggcagagcttgctgtgagctgagatcgtgccactgcactccagcctgggcaacagagcaaggctgcatctcaaaaaaacccacaaaaaacaaaaaactaaaaatgccatatccaaaagctgttccataggaatttggggacccatagctgctttttgtagtttcctacgggtatcaggggcagaatgggttataaaatgtactccgaaaagggtttgtccttcccttgaggcaggatcagtgttactgtagtttctgatagcctcaatgaaacgcccttgaaacaaaactggattctcatctttaccctgagaaacttccttaaccttttcagagttaacaggctttttcatacctttcttcatccctttcaacaaacaagtgaccatatgatctttcctccccaagtcctcactgcccctttgatagttccactttggatcttgatctggaactgctatacctcctgcctgatatatataatggtttgggttgtgagccaatacctcgtctgcatgggtcctagctgtccccaaaatgtgttgtttctcttccactaaacaacacagagacaaaaagacatgcagatcctgccaagttaaactataggttggagttaatttctccaactcatctatgaattgtcctggatcttcagagaaaagaccaaacttctctttgcatagagccaaatcagacatagaaaagggaacatgtgctctcacagtgccttcttccccatttgccacctctctaagtggataaaggtttcccactggaggttgataggaggctccaatatgagtggtacttgctggactaagttcctcagggagtggtgggtacagagtgggactagacgggtaagaaggaggggatgaagcgttctcaatagagttttcaggtggactagagggagaaatgaccgacacatctgaaccttcatagctgacagaaggaggttctgctccacccaaaaatgcctgctgtccctttgtggtcaccagaaatatgttacaggacaggggtccccatccaggccccaagagagggttcttggatcttgtgaaagaaagaattcagggcgagtccatagtgcaaagtaaaagcaagtttattaagcaagtaaagtagtgagcccggtgtggtggctcacgcctataatcccagcactttgggaggccaaggtgggcagatcacctgaggtcgggagttcgaaaccagcctgaccaatgtggagaaaccccgtctctagtaaaaatacaaaattagctgggcgtggtggtgcatgcctgtaatcccagctacttgggaggctgaggccggagaatcacttgaacccaggaggcggagattgcggtgacccgagcaagtccagccgttgcagtccagcctgggcaagaagaatgaaacttcgtctcaaaaaaaagtaaagtagtgaaagaacagctacaccatagacagagtaggacattcccgaaagtaagaggaggaatgcatccaccctaggtacaatgcttgtatatatgtggggagatgtgctctgctacaagggtttgttataaaggattaattttttaaattactatattttgcaaaaatcaatactattatcgatttgctttaaagcaaaattaggaactatgtctttgttctccagatattgggatatctggatactctcaagtctgggtctgtttagtaaacttttttttttttttgagatgggatctcgctctgtcacccagtctggagtgcaatggcgtgatcacggctcactgcaacctctgcctccctggttcaagcaattctcctgcctcagcctcctgagtaactgggattacaggggcacaccaccacacccggctaatttttgtatttttagtagagatggggtttcaccatgttggtcaggctggtctcgaactcctgaccttgtgatctgcccgcctcagcctacccaaagtgctgggatacaggcgcgagccaccacacctggcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggaaatgggacattttggataatatgctgtagggattctagatcttgaccctcctcccctttagggtttaattatttgcttttgtatttgtttagtgacttactgaatttttttttttttttctgagacagtctctctctgtcccccaggctggagtgcagtggcacgatcttagcttactgcaacctccatctcccggtttctcctgccttctcctgcctcagactcccaagttgctgggattacaggtgcctgccactgtatctggctaatttttgtagttttagtagagacggggtttcaccatgttggccaggctggtctcgaactcctgacctcaggtgatccacccgccttggtctcccaaagtactgggatcacaggcatgagccactgcgcccagctgacttactggatttttttttttttttttgagacggagtctcactctgtcccccaggctggagtgcagtggcatgatctcggctcactgcaacctctgctcccgggttcacgccattctcctgcctcagcctcccaggtagctgggactacaggcgcccgccaccacgcctggctaattttttttgtatttttagtagagatgggatttcaccatgttagccaggatggtatccatctcctgacctcgtgatccgcccgccttggcctcccaaagtgctgggattacaggcatgagccaccgcacctggtctgacttactggaatcttttagtgaaggctgtcttttctctcacagagtaaatcctctttcttccttttctttattttctttctttttttgacagagtgttgctctagttgcccaggctggagtgcaatggtgcgatctcagctccccacaacctccacctcccaggttcaagcgattcttcctcctcagccttcccaagtagctgggattataggcatgtgccaccaagcctggctcattttgtatttttagtagagatagggtttctccatatgggtcaggctggtctccaactcccgacctcaggtgatcctcccacctcagcctcccaaagtgctgggattacaggcatgaaccaccgtgccccaccactttctttcttttttctttccttctttctctttttctttctttcttttttttttttgacagagtctttgttctgtcgcccaggctgtagtgtaatggtgtgatctcggttcactgcaatctctttctcctgggttcaagcaattctcatgcctcagcctcctgagtagctggaattacaggtgactgccaccatgtccagctaattttcgtatttttggtagagacgccatgttggctaggctggtctcgaactcctgacctcaggtgacaccttggcctcccaaagtgctgggattacaggtgtgagccaccgtgctcggccaatcctccttgtttcttaaggaggtacagctatgggtaaatccatagctgtcttgggatgacagttgccttgatagaggtgttgtcctgtctttccctgacaacaccctgcagtttaatttaattaagttaaattaagcagctgattgcttaagagttttcaacaatgatgggggcagggcataaattgctcttcaaagtaatccaatcaaatgtgctcctttgaaggaatagtttctgatctcagtgttttgcatttgtcctaatcctaggaggcctcttctcacctgtcttattcaccattccctcttataaactagcggttctccagttctgcctttcactttaaccttcattgtttaattgcttttcattgagagcacccatgatcttgcaaatgggaggagattagaagctacctgttttactgcctgcttctctcccctggcaaaatctcagagaacagggtaaagacaatggcaagttcttgctgagtgacacctggacgctaggacctaagcactcagtgggtggggaagtgtgggagaagccaaattcctctccactggcctctcttgaaatgcaaagtactgggacgagggtgaccagggctccagtctcctcagtgcaccatgcctaaggtagcacctttgtcctgcaagttgggactgaatagcggaagagaaactgctactctcagctgtacttgcctactatcttagattaaacaacaggtagctggaggcaggatgagaaacgctgaccttttcctcatcccaaagataaagccttcttttttatttttattttttattttgagacggagtctcactctgtcgcccaggctggagtgcagtggcaggatctcatctgactgcaccctccgcctcccgggttcaagctattcttctgcctcagcctcctgggtagctgggactacaggagtgcgcaaccaggcccggctaattttcatatttttagtagagacggggtttcaccattgttgggaacaagccccccaaaatctggccataaactggccccaaaactggccataaacaaaatctctgcagcactgtgacatgttcataatggccctaacgcctgcactggaaggttgtgggtttacgggaatgagggcaaggaacacctggcccgcccagggcagaaaaccgcttaaaggcattcctaaaccacaaacaatagcatgagcaatctgtgccttaaggacatgctcctgctgcagttaactagcccaacctattcctttaattcggcccatctctttgttttccataagggatacttttagttaatttaatatctatagaaacaatgctaatgactggcttgctgttaataaatacgtgggtaaatctctgttcgggcctctcagctctgaaggctgtgagacccctgatttcccacttcacacctctatatttctgtgtgtgtgtctttaattcctctagcgctgctggattagggtctcccccaccgagctggtctcagcacaccatattggccaggctggtctcaaactcttgacctcatgatccacccgcctcggcctcccaaagtgctgggattacaggtgtgagccactgcacctggccagataaagccttctgactaagagctgcagggagagggagccctgtctggcagcagcaatctgcagcagattctctgccttgctgatctgatagggaggagagtggtggcagtcttggttcagatacctgagatgcttgcttttcctacagaatattcatagattttattgaataagtgtttctgcattttcctgttgcccttatgacaatttctagagtttttgtttgtttgtttgtttgtttttgagacaggatctgcagccttgacctcctaggctcaggcaatcctcctgcctcagcctcttgagtagctgggaccataggtgcatgctaccatgcccagttattttttaatttatctgtagagacggggtctccccatattgtcctggctggtctcaaattcctcggctcaagcaattcttccacctgagccttccaaagtggtgggattataggtatgagccactgtgaccagctcgtttctagaggttttaagtagttgggtctttatagttttcacaagtcttactggagaataggtcatggagctcctcatgctttcatgctggaatttggtattctacttatgtctgttttttttgttttgttttgttttttgtgatggagtctcactctgttgcccaggctagagtgtagtggtacaatctcagctcactgcaatctctgcctcccaggttcaagtgattctcctgcctcagtctcccgagtagctggaattacaggcatgtgccaccatgcccagctaattttttgtatttgtagtagaaatggggttttaccatgttgcccagtctggtcttcaattcctgacctcaggtgatctacctgccttggcctcccaaagtgctgggattacaggcatgagccaatgcctagcgtgttatagtctttttgttaaagttctgaaaacattgatttttaccatttctgccagtattcttatggcattaatggatgtaaaccaaaaataaaattctaagccccccaaccacctgaatggattcctcctcttggccaagggcattccaaaataaacctgaaacattatttcagaccatcatgggaatgggtggtgggacaggccacattataccttcctctcgttgaaattcaggcacaactgaccagcattaacattaaaacagagaccttgagacggagagagcagactctgtagcaataagataccaacatgacagattgcagtcacaaaataaataaaaaggccgagcgtggtggctcatgtctgtaatcccagcactttgggaggctgaggcatgtggatcacctgaggttaggagttcgagaccagcttgaccaacatggtgaaactccatctctactaaaaatacaaaaaattagccaggcgtggtggtgcatgtctgtaatcccagctacttgggaggctgagacaggagaattgcttgaacccaggagttggaggttgcagtgagccaagcttgtgccactgcactccagcctgggcaacagagtgagactctgtctcaaaaaaaaaaaaaataaataaataaaaatattttatcccaaaatatattgcttcgacatattttgaaatgggcctgcaaaactgtctctttaagtctgataaaaacatttacaatctattctctttgaagcctgcataatagaacctgaatttcatctgcataataagaaccccttattttaaccccagacactcccttctattgattccaaggctttagataaactctcaaccaataaccaatcagaaaatctttgagtccaccgataacctggaatgcacccccttcctgctttgagtcatcccacctttccagatggaaccaatgtacatcttttgtttttttttttgagacagagtctcaccctgttgcccaggctggagtgcaatggatcgattttcgctcactgcaacatgctgcctcccagattcaaacgattctcctgcctcagccttccgagtagctgggattacaagtgctcatcatgatgctcatctaatgtttgtgttatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaagttagttcatcacgcccctctgaggctcaggaaatgcggagacccgggcggcgggcggggccagggggccgtgggattcctcggggccgcgcgagcctgggtggccagggccccggcgcctccgctgcccctcggtgcgcgcccgccctcctgcctgggccacgtcagcaccggcctgcccccgcgcgggtcgctgctcacgtgggcagctgctgggatccgcggccgaccagcctcggagcttgcccctgtttgggccgttctcggcaccgctcgggagacctcgggccggtagaacgcacctcccttccgtaaggcgagcgcggcagcccctcggcccggtgccagcgggcgccagacttcatttctcacggcccgacgaggtggctcaagtagaggacaaataaatgaattaaagtgaatttcattctcttaattcagtatctggtccgttgtaggtgcttctttctagacatagagaaccatcagaaatgtaacaggtttcgcatttttaagttggtaatcacttgaaatccctatgaatgtgatgcattttaaggttcctagtgaacgctttctaaatgttaaaactctttttaaagttagttttaaaactcctgcacgtaatataagttctcttatgctgtacagaaaaggaaagtccaattttctcccttccccctgctgcttctcattcttacacctcggcaataaatggctgtgtttggcttaaatgtttccaggtatttcagtgatcaccaaagaaaatgttgggtttgggagtaaagggaatgtacatacacagaggtttggtttttattactattgttgttaaacaatttcattaaatgattacctaattatttgttgagagaatagtcattatagtgtcacatttcttctaagcacacttcgttctctgactgaatatggagctataaagatgggtttatagagattacgtttctgaaatgactcctattttctttcatgcgttgtccatgatgaaataaagttttactcaaaggcttgtggaaagatagatcaaaacttcatgtaaatttgccttgccatctttgaatgtcttgaatgttaaatcccgttctttatagaagccagttgtgatttaatgagcttgttacagtataagtggaccacagcaggagctcggctatcctgccatcatgcctgcgagctaggttaatgtacttattttatcttgtttttattttttctcccaactttattgaggtataattggtatacaaaaaactgcctattattagtatattcaaaatacgtatacactggtgtaaccattaccacaatccgggtaataaacatatctgtcacctccagaagtttccttttgtcctttagtttgtttgtttctgtggtaagatactttcttactgggactctactgtgtgtcagatattatggtgggtattttaaatatattctcatttagccctcatagcaaccatttaaggtataaatcctcatatagcaggcaaggaggctgtagtctgtcaggttaagttatttagccccttacatgcggtcttacagtgcagagtaagtcagggctccagcttattccgtaagttgtgtgttctcacactgtataatgttgcctcttctggcttttatggctgtgagataggattgtattgggtataagacttgcagtcacattaacagatttatttaaaatcattttcaattttgtagtccaagacaccagttaaatggatatatgtgctattttgtactcctatcccagtgggaaacaactggatgataaacttaacaaggagatgtatattttccaacagttgtgttggaaactgatgaggttgctgaaatgtttttcagtgggttcttttctttttctttttttttttgagacggagtttcactctcgttgcccatgctggagtgcaatggcgctatcttggctcactgcaacctctgcctcctgggttcaagcaattctcctgtctctcctctggagtaactgggattacaggtgcatgccaccacgcctggctaatttttgtattttttttttgatgcagagtcttgctctgtcgccaggctggagtgcggtggtgcaatctcggctcactgcaacctctgcctcccaggttcaagtgattctcctgcctcagcctccggagtagctgggactacaggcgcgtgctgccacgcccagctaattgttgtattttttttgtagagacagggtttcacgcatgttggccaggatggtcttgatctcttgacctcatgatccgcccacctcggcctcccaaagtgctgagattacaggtgtgagccactgcgcccggccaatttttgtatttttagtagagacagggtttcatcatattggtcaggctgctctcgaactcctgacctcaggtgatctacctgcctcggcctcccaaagtgctgggattgcaggcgtgagccaccattcctggccttcagtgggttattttcaaacccttgtagaattttaggagctagcagaagggaccatggtggttactgactaggagccagtggttgcttctctttttaccaccaaggacccatctaatgatttttcctctcttttggatcctgtatctgaaatattttggcatgctaatattttattaagtaacaatatttttcaataaaacaaataagtctgtataactgaacacaatgagagttcctgatacacacacatatactagaatgttccttttttttttttttttcttgaggcaagttctcaatctgttccccagggtagagcacagtggcccagtcagagctcactgcagcctcgaatttctgggctcaagctatcctcccacctagccccctgagtagctaggactacatgtgcgcaccactacgcctggctaattaagagcaattttttgttttttcagagatggggtcttgctgtgttgcccaggctggtcttcaacacctagcctcaagcagtcctcccaaagtgttgggattacaggtgtgagccactgcacttggcctggctggaatattcccactgtgataagattctagtcaaagtaatgaaacttgtttgtattagactgtacagctttattgaggatgattgtatgattgtttttaggctttttgatatattttaaaagttctccaatacagctttttgtatcttactgggaatcactacttcagtcctaaaagatagtctaatttttgtttttttcagttgagggtgggttggcagagagatcagtgggatatgtatacccttctcccttgcagtctgctccacagtcttatgattggagataactactctttctcagaaaacccctgcagcctgctggagtgaacatccttttcctggttatgtatcttgttgctgtgagggtaccccaaacagtggtcattggctcctccccaagggtattttgccactgttaaccatttttttttttttttgagaggaagtcccactctgttgcccaggctggagtgcagtggcacgatctcagctcactgcaacctctgcctcccaggttcaagtgattctcctgcctcagcctcccaagtagctggccttaaaggtgcctgccaccacacccagctaatttttttatttttagtagagatggggtttcaccatgttggccagctgctctcaaactcctgacctcaggtgattggcctctcaaaatgctgggattacaggtgtgagccaccgcacccggccaacttttttttttatgagatggagtttcactcttgtcgcccaggctggagtgcagtggcatggtcatggctcactgcagcctccacctcctgggttcaagcaattctcctgcctcagcctcccaagtagctggattacaggcacctgccaccacgcccaactaattgttgtattttttagtagagatgaagtttcactatattggccaggctggtctcgaactcctgacctcaggtgatccgcacccctcctctgcctgtcagagtgctgggattacaggcgtgagccaccatgcctgcccagttttaacttttatattagtgaagaaacagttttaggctgggcgtggtatctcgtgcctgtaatctgtgggaggatcgcttgagcccaagagttcgaaaccagtctgggcaacatagggagatcttgtctctacaaaaataaaaacccatgagacttttttttttttttttttttttgagacggagtctcactctgtcgaccaggctggagtgcaatggcacgatctcagctcactgcaacctccgtctcccagattcacgaaattctcctgcctcagcctccacacgccaccacacccggctaattttttgtttttttagtagagatggggtttcactatattggccagactggtcttgaactcctgacctcgtgatccgcccaccttggcctcccaaagtgctgggattacaggtgtgagccactgcgcccagccctgagacttttctattacatcactaaatacatttctttgagtatgcttatttgaatgtaaatgagaaaagcatcaagaaagaggcctttgggaagtatatttggaagtgtaatctttttgtgtatgtgtgtatttctttttttgagacagagtctcgctctgtcacccaggctagagtgcagtggtggtgcaatctcggctcactgcaacctctgcctcccaggttcaagtgattgttctgcctcagcctccctagtagctgggacaacaggcgagcgccaccacgcctggttaatttttgtatttttcgtagagacggggtttcaccatactggccaggctggtctcaaactcctgacctggtgatcctcccgcctcagcctcccaaagtgttgggattacaggtgtgagctaccacacccagctgtgtgtatttcatcattcaggaaaatgttacgcatttatagcggttttatgccacttttttttttttagatggaattttgctcttgttatgcaggctggagtgtgatggcgccatctcagccggctgcaacctctgcctcccgggttcaagcaattctcctgcctcagcctcccgagtagctgggattacaggcatgtgccaccatgcctagctaatttgtatttttagtagagatggggtttctccatgttggtcaggctggtctcgaactcctgacctcaggtgatccgcccactttggcctcccaaagtgctgggattacgggtgtgagcccctgcgcctggccatatgccactttgtaaaagtaagtctttgacaatattcttgtgtttcagagaaaaaaaaattgttactgaaaagaaaattcaatctctaaaaagttctgatagtttgactgctttaatggggatgttctaaagcacttggttaattattgactcaaaatttagaagccaaaagacatgaataataaactatctttttctgttgtaggtaaagggagaagatgaggaagagaacaatttggaagtacgtgaaaccaaaattaagggtaaaaggtaagctgacaaacaatataccttgtctcttgttaaaggttatgtcagggttgggatcatatgggatcataaactaggagagttgcttaggaagtgcctgctttattacagggttttttttttgtagagaggaggtctagctatgttgcccaggctggtcttgaactcctgagctcaagccatccttctaccttggcctctcaaagtgctgggattacaggtgtgaaccactgcatctgtcctagaggatttttttttttttcttgagacagggtctgttgcccaggctccattactgtggtgccatgttgactcactgcaacctccacctccagggctcaaaccgtccttctccctcagcctcccaaataggtgggactagaggtatgtaccaccacacttggctaatatgtgtgtgtgtatatgtatgtatttttagtagacaccgggttttgccatgtcacccaggctggtcttgaactcctgtcctcaagcagttctttgcctcccagagtcctaggattataggcgtgagtccattacgccccaccgaggatgttttaattaatgtatgtgataataagcaacatgctgtaatatattctggactcatttatgacttctcattactaatgctgaaattggattcccctaagcagtggcagtttgttttataggaagaaagtagttactttctatatcagatcagttctccctcctggttccacagagctttatgtgagaactccaagctgtttgcctcagcaagtattctcctatctatgattggctaccattctgcttccatggggcagacaaccttccccctggatatctcacccctaagccttcagggcattcaaagtggtaacttctttgaaggcctactgtgaaggctgggtggggttaaacttgcatagttgtttgctcagacctcagcacctagcgtggagcctggaacttattagttattattattattattttttggagacagtgtctgttgcccaggctggagtgcagtggtgcgatggttcaagtgattctcttgcctcaggctcccgagtatctgggattacaggcgtgtgccaccatgcccggctaatttttgtattttttttttttgagagagtttcgctctctttgcctgggctggagtgcaatggcgcaatcttggctcactgcaacctcctcctcccgggttcaagtgattgtcctgtgcagcctcccgagtagctgtgattacaggcatgcaccagcacacctggctaatttttgtatttttaatagagatggggtttcaccatattggtcaggctggtcttgaactcctgacctcaggtgatctgccgcctcggcctcccaaaatgctgggattacaaatgtgagccaccgtgccccacaagttttgtgtttttagtagagacgggtttccccatgttggccaggctggtctcgaacttctgacttcaggtgatctgcctgcctcagccttccaaagtgcggggattacaggtgtgagccaccactcctggccccatagtttcaattactgtgtgatcctacctatctttgtttttttttttttttggagatggagtcttggtcttgttgcccagactggagtgcagtggcgtgatctcggctcactgcaacctcagcctcctaggttcaagcgattctcctgcctcaggctcctgagtaactgggattataggcgtccgctaccacacctggctactttttgtatttttagtagagatgggatttctccatattggccagactgttctccaactcctgacctcaggtgatctgcccgtcttggcctcccaaagtgctgggattacaggtgtgagccactgctcttggcccttttttcttttttcttttttttttgagacggaatttccctcttgttgcccaagctgaagtgcaatggcacgtgatctcggctcactgcaacctccgcctctggggttcaagcgattctcctgcctcagcctcccaagtagttgggattaaggcgcgtgctaccacgcccagttaattttttgtaattttagtagaaatggggtttcaccatgttagccaggctggtctcgaactcctcaggtgatgcacccgcctcggcctcccaaagtgttgggttacagttgtgagccactgcgcctgacccctttttttcttgtatgtgagtatatctattcttttcttttttgtgagttggagtctcggtctgtcacccaggctggaatgcagtggtgcgatcttggctcactgcaacctctgcctcccaggctcaagtgattctactgtctcagcctcccgagtagctgggattacaggtgttcaccaccacgcccagctaatttttttgtatttttagtagagagagggtttcactatgttggccaggctggttttgaattcctgacctcaggtgatccacctgccttggcctcccagagtgctaggattacaggtatcagccactacctggccaccttttttgttttctgtgttatcttcatagttgtctttctttggttgttaagtttaatccttgaattactttgagttcatgtacagcaacatcctctcaggagccacattttaatgcgtggtgattatctcaatttttcttggtgattatcttgattttccactgagtgtatgaagtaggcatctcaccagccccgaggctgtaagatctgagagttagctttaaataagtcgctattaaaattgctttctcttgctttaagagactcctctccctctctgaggctgtctgagtaccctgtctgtgtttattggctctagctgctggcttgtagcgtcttggataggcaaggtaacttagttattaggactgtgctttttgcatctttactgcctgggatcaaatcctagctctgttatgtttactagcattttcctcagtttcctcatcagtaaaataatagtgtttacctgatatgatcatggctaagagtcactaaattggccaggcgtggtggctcacgcctgtaatcccagcactttgggaggccgaggcaggcagatcacctgaggttgggagttcgagaccagcctgaccaacatggagaaaccccatctctactaaaaatgcaaaaaagttagccaggagtggtggtgcatgcctgtaaccccagctactcgggaggctgaggcaggagaaccacttgaaccgggaggcagaggttccggtgagccgagattatgccattgccagcctgggcaacaaaagcaaaactccgtgtcaaaaaaaaaaaaaaaaaaaaagattcactaaatcaatatatatataatgtacttggagccttagtaagcacttaataaattttgaattaatcacaaagaaggctaatggaatggaaggaacatttcaggcagagatatctgtaaagatacggagggttgacatttcatggtgtgtttagttaactgggctttcagagtggctcttgctcagaggaaggtgaagctgtgtagggtgggttgagttcagtttaaggactgctctgaaccattattaaaggcgtgggctttatccttaaagcccacagttgggaacattaaaaaattttttttcatagcttaccattttattcatttctagttatatgtgcatacattatatgaatttgtctttatcacctcttcctgccacagaaactgacctatatggggttctcagtaaatcagtttgagtacatgagtaaaaaaccaagtcattcacacaatgttctcccattagatccagctagagaagagctttaggaaaaaaaaaaaagacctgctccatgtacatcagtttagacagttctgtgttgtctagccttttattgattgaaaaaccttcattagctggtgcttccacattttggtaagacttgatgttcctaatgatcttggagtgctgaaaggttctgatttgtcttctgaattatcaaagcaaaattaaattatgtggcagcatttaacaacttgtaaaatgaatgtgggaatgttgatttgagattgtgtagatgggctggggggaagggagattaggagattaataggaagagatgcagtagtctaggcacatggtattggtttgaatggaggaggaggcaaaggaagggatgggtctgagaggaatttctgaggcaggattgcccaggtattggggacagggcagagtgaggcatcagaagatgcctgggtttctagcttagagttgatcagatggcagtggtattaagagagatcaagacttgggatcatgaatgataaggttttgttgaattgcatgtggggtggtcagtggagctgtctagtaaacatttgaaaatttgattttagaattcaggacagagagtgggatgagaagcacatttgggacttgaaactaagaattggttaagactgtcctgaggagaagattccgctacttatattttgagtagtgaacgtcacagttgtaatatgaaatataatggtgtgactgataaagacatgcaagttttgtgttctataaagtcatatcaggaagagtgatccatgttctcacctttgaggacaaactcattgaagcttattaattcaatttttcactagtggtttctacgtcttctaaaaattgttctcctggcttggaaaactgattcagtttagaattagtaccctgtgaattttaagtttccaggccatctgtttttcttttttttccttttttgagatggattctcgctccgtcacccaggctggagtgcagtggcacaatctcggctcactgcaacctccgcctcccaggttcaagcaattctcctgtctcagcctcccgagtatctgggactacaggcgcctgccaccacgcccggctaatttttgtacttttagtagagacagggtttcaccttgttggtaaggctggtcagccatctgtttttctttaaaatattagtagctttatttttttcttgatatgaggatgatataagctccttataagacaaattagggcctggcgcagtggctcatgcctgtaatcccagcactttgggagcccgaggcgggtgtatcacctgaggtcaggagttcagaccatcctggccaatgtggcgaaatcccctctgtactaaaaacacaaaaattagctgggcgtggtggcggacgcctgtaatcccagctactggggaggctcaggtaggagaatcacttgaacccagcaggcggaggttgcggtgagccaagattgtgccatttcactccagcctgggctacaagagtaagactccgtctcaaaaaataataataataaaaaataaaatgaaattggaaaagacaaactaaacttattctacaaccttgagacagttaccattaacattttgttgaacattccttgaaatactattctttacattcattcatttttttttttttttttttcttgagacggtatctcgctctgtcgcccggctggagtgcagtggcacgatctcggcgcactgcaagctccgccttccgggttcacatcattctcctgccccagcctcctgagtagctgggactacaggtgcccgccacaacgcccggctatttttttttgtatttttagtagagatgggctttcactgtgttagccaggttggtcttgatctcctgacctcgtgatccacccatctcggtctcccaaagtgctgggattacaggcgtaagccaccctccccgggtctatgtatgtttttaaatggagttattctttgtcatttgtaaacagattttcgttatttacattgtacatggacatctttccatgttaatatagatatgtaggttagccatatttctaatgactgccaatattctattgtgtgaagccatatttctaacgactgtcagtattctgttgtgtggttctattaaaatttttttttttgagatggagtctctctctgtcacccaggctggagtgtagtggcgctatcttggctcactgcaacctccgcctcccgggttcaagtgatcctcccacttcaacctcccaagtagctgggactacaggtgtgcaccaccacgcccagctaatttttgtatttttaatagagacagggttttgccatgttggccaggctggtctggaactcctgacctcaggaaattcacctgacttggcctcccaaagtgctgggattacaggcatgagccactgcacccagccaagagatcacctttaatatagtaatttaagtcttttattaacaggacatggtggcaggtgccagtagtcccagctactcgggaggctgaggcaatagaatctcttgaacctgggaggtggaagttgcagtgagctgagatcatgccactgcactccagcctgggcgacagagcaacactctgtctcaaaaaaagaaaaaaataatttaagtcttctaagacagatatctagctgtttctctcagggctgtttataaatagcaagagtgtaaaacagtgtaaatgttcaacaatggaacaaaagttaaaaacattctaataggtaatcccagctattcgggaggttgaggcaggagaatcgcttgaacccaagaggtggaggttgtggtgagccgagatcgcaccattgcactccagcctgagtgatagagtgagactccatctcaaaaaggaaaaggtgatctcttaaagataattgcttttgtctttggttcaaaattttgttgtgactttgaactgctactactgttttcagtatcctcagtctctcttacttctcttgccttgttcttcctttagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggtaagctcaggtggagtccagcccatccctgtctgcttcagagaatgtcttgcagagtgactactggttgataggcttgggtggtgtggggtggatgaaatctgcagtcatttctaaggtcatcccaaaagtgtttaacctgcagtgaaatgactccatgggggtcttgtttctccttgggggatcacaggtagaggctaggggtagcatttggagaggtggaatgggtgttggagatggaagcaaggcattccacgcagaggcagtaagagggacaaaggctttgagatggtgtggctgggcagatactggggtagcaaagctgttggagtggttgagggccttccttgaatgttgggccttggttggaacttgaagagagagggagcaattaaggcttacaaagattttgttactatggcaaatcgcaaacatgccaaagtacaaagactagtataaactcccacacacgtcacttagattcagcggttatcaggttaccataattaacctacctctttttttctttggtggagtacttaaaaaaatttttttttttaagagacaggatcctgctctgttgcccagcctggagtacagtggcataatcatagctcactgtaacctcaaactcctgggctcagtccatcctcccagctcagcctcccatgtagctggagtgacaggtgtgcgtcaccatgcccagttaattttttatttttgttgtagagacgggatcttgctttattgcccaggctagtctcaaactcctgggcccaggtgatcttcctgcctttgtctcccaaagtgctgggattacaggcatgagccatggtccctggcctttttgctagaggattttaaagcaaatctcagcagtcatgtctttttacctacttctataccatctctaaaaaatatgggtattttagacgtttaagatttctttgcactgggtgcagtggctcatgcctataatcctagcactttgggaggccaatatgggaggattatttgtgcccaggaattcaagaccagtctgggcaacatagtgagacctcatttttacaaaaaataataagctgggcatggtgacacactcctgtagtctcagctacttgggaggctgaggtgggaggattacttgagcccaggaggttaatgctgcagttagctatgattgcaccaccccactctaaaaaaaagatgtctttgcatctctctgtgtgtttagaacatgtgtcaccaaggatgtgcaatcaaaatactttgttctaatgctacttgaaataattgtttcttttttttttttgtctttattttattttattttttttgagaaggagtcttgatctgtcattcagactggagtgcagtggggcgatctcagctaaccgcaacctctgcctcctgggttcaagcaattctcctacctcagcctcctgagtagctgggattacaggtgcccgctaccacacctggctaatttttgtattttttgtagagacggggtttctccatgttggccaggctggtcttgaactcctgagctcaggtgatccgcctgcctcggcctcccaaagtgctgtgatagcaggtgtgagtcactgcgcccagcctgttttttatgtttcaaatgtcagtttgatacatagttagggctgttcgttttgggttgttttaaacttttaagaactttttattaacataattttttgaatatgaaaacaacatgatttcgtagtcaaaattacatataacaagttatgtgtaacaaaatcatataacaagttatatgtaacaaaatcatatataacaagttatgtgtaacaaaatcatatataacaagttgtatgtaacaaaatcatatataacaagttgtatgtaacaaaatcatacataacaagttgtatgtaacaaaattatacataacaagttttatataacaagttaaaaggccaggtgcatatatatatatgtatatatggccttatatatataagtgcacttatatatttatatatatacacacacgtatatatataaggccaggtgtaccattttgttttttatatatacacgtgtgtgtgtgtgtgtgtgtgtgtatatatctatagatatctatagatatctatctatctatatatatatatatatctcaagttataggggcaggcgcactggctcacgcctgtaatcccagcactttgggaggctgaggcgggcagatcacttgaagctaggagttcaagaccagcctggccaacgtggtgaaaccccatctctactaaaaatacaaaaattagctgggtgtagttgcactcaactctagtcccatctactagggaggttgaggtacgagaactgcttgaacccaggaggtaggggttgcggtagccaaggttgtgccactgcactccagcctgggcaacagagcaagactctgtctccaaaaaaaaaaaataatagagaattcttgcttccaattctcccattcatttgttctccttggtaaccatttatgttagctttaggtttattcttctagtgtttccttctaaatgtatgaggatttgtagtaaacatacttatattcctccatgtctcaaaacatagctccctatgtatattgttgcacggtggggttgtttttggggagagagagggtctctgtgcctcctgttgtggttgcagagtgcccagggcccacgtgcccactgtgaagatgacagccttgccactctgagctgtgctttctctaactgcatgatttcttttacttacttcaaactgagtgagagttcatgttgggacactgatttgattttcctctacgcaggcttttaaaaatataaatatttggggttttccactttcctccattttaagttaatagaacgttcatgagaggctgggtgcggtggctcaggtctgtaaccctggcactttaggaggccaaggttggcggatcacgaggtcaggagttcgagaccagcctggccaacatggtgaaaccccgtctctactaaagataaaaaaattagctgagcatgctggcgtgcacctgtaattctaactacttgagaggccgaggcaggagaatcacttgaacctgggaggtggaagttgcagtgagccaagatcgcgtcattgcactccaatctgggcgacagggtgagagtttgtctcaaaaaaaaaaaaaaaaaggtttatggagaccatttggcaaaaaggaagatttgaggtcagttcacaaccactatcgacactatggacattttagtacctgagtcgtgtctaagcatagggctttttaatgtacttattatgcttattgtcatattatgtataaagtattgtgtaatacctttgccacttagaatattctctaaacattttacatattactacattacctttgtcaacctttttttttttttccttaagagagggtcttactctcgcccaggctggagtgtagtggtgcaatctcagctcactgcaacctctgcctcttgagtttaagtgattcttccacctcagcctccccagtagctgggacttacaggcatgtgcgaccatgcctggctaatttttgtattttttgttagagacagggtttcaccatgttggccaggctggtctcaaactcctgacctcaagtgatctacccactttggcctcccaaagtgctgggattacaagtgtgagccactgtgcccggctggcctgtaaacagtttttttgttttgttgtttttgtttttgtttgtttatttgttttttttgagagacagtctcgctctgttgcccaggctggagtgcagtggcacaatctcggctcactgcagcctccgcctcccgggttcaagcgattctcctacctcagcctccttagtatctgggactacaggcgcccatcaccacacctggctaatttttctatttttagtagagacggggtttcaccatattggccaggctggtctcaaacttctgaccttgtgatctgcccgccttggcctcccaaagtttcactgtgcccagcctgtaaaccgtttttaagtggctgactcactgatttgatgtcctagagcttatttgccaagtttctatagttaaacagtttttttctatttaatattataatatacatctctgcatattatacaaaagttatgaatttttgtattctcaggattttctgaagtaatgtttttcaaattgaaggatatgaacattttaaaatctcttgctggttgggcacagtggcttatgcttgtaatcccagcactttgggaggtcaaggtgggtagattgcttgagaccagcttggggaacatggtgaaattccatgtctacaaaaaatacaaaaaattagctgggcgtggtggcatgcacctggaatcccagccactcatggggcttgaggtgggaggattgcttgagcccaggaggttgagactgcattgagccaagattgtgccactgtactccagcctgggtgacagagtgagaccgtttataatttaaaaaaaaaaagaaaaaaaaagaaaaacctcttgctgtattttgccaagtagtttttcaaaagatttaatcaattttttaggattccagtgtgtgaaactgccggtttccttatgcccttgcttgtactggcattaaatgctatcaaatatgattatgagtgaattgtagttttaaaaatctagtcatagaatgagtgaataaactagcgaataaactagttgtaagagctaacaaaatagatcttgtccttttcatggacttttgggaagcaaggtgtgttgggccttattgagaggtagtatttaccacatagaagagtgaaatcgggctgggcacgatggcttgctgggcacggtggctcatgcctgtaatcccagcactttggtaggccaaggtgggcagatcacctgaggtcaggggttcgagaccagcttggccaacatggtgaaaccccatctctactaaaaatacaaaaattagccagatgtggtggcacacgcctgtaatcccagctactagggaggctaaggcaggagaatcgcttgaacccaggaggcggaggttgcagtgagctgaggttgtaccattgtactccagcctgggtgacagagcaagactctgtctcaaaaagaaagaaaaaaaagtgaagtcagaacttagcagaccttgtattgccacttaggtttatgaccttgaacaagatattggaaactgccagggcttgaaatttttatttgtcaaatggggataagtagttcttatttcatcatattgtcttgagaatgagatgagataatgcacttatttagaactcttacaaaactgcctaatacaatcagctccagacacattatttttttgtgtcctattttttgagttaataatatatcatgaatatttattcccatatgttagcaagaagtcctagtaaacataattttaaaatgttgcatacgttagatacatcataatttacccgttctgttgctgatatataggttgtctccaatcaatctgatttaaactaatggtgcattctctgttgccaaaactttgaactatttgtttccttccttccaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaaggtatggaatgttcaacttggacattgtgagaaatgaggactttatcacagctacctattctttgcttttcgaaactagctaaatatttaggcagttgtttagggttgactgatgttcatcttgttgattggcagtgttagaaaccaacagaatcttaaaaaatacccccccatatatatagataagccattttcttttttttctttgagacagagtctcactctgccacccaggctggagcatagtggcgtgatctctgctcattgcagcctccgcctcctgggttcaagtgattcttctgcctcagactcctgaatagctgggattacacgcatgcaccactacacctggctaatttttgtatttttagtagagacaggatttcaccatgttggccaggctggtcttgaactcctggcctcaagtgatccacctgccttggcttctctttcttttttttttttttcttgagacggagttttgctcttgttgcccaggctggagggcaatggcgcgatctcggctcgccacaacctccgcctcccaggttcaagcaattctcccgcctcagcctcccgagtagctgggattacaggcatgcaccaccaagcctggctaatttttttttgtatttttagtagagacagggtttctccatgttggacaggctggtctcgaactcctgacttcaggtgatccgcccacttcggcctcccaaagtgctgggattacaggcatgagccaccgcgcccggccgccttggcctctcaaagtgctgggattacaggcgtgagccaccatgcccagcctaaaccatatattttttttttttttggagacagagtctcgctctattgcccaggctggagtgtagtggcacgatctcggctcacggcaagctctgcctcccgggttcatgctattctcctgcctcagcctcccgagtagctgggactacaggcgcccgccaccatgcccagctaattttttgtgtttttagtagagacggggtttcaccatgttagccaggatggtctcgatcttctgaccttgtgatccgcccgcctcggcctcccaaagtgctgggattacaggcgtgagccaccgtgcccggcctaaaccatattttttaagtgaaaatttgaatagaaaaaggaaaagcatattcatagtactgcgccacccaaacacagctgtcattttgatctatttctttgttcttttgtagtgtttttaaaaaacattttatcatattgcatatacagtttttaaatcttttttgtcccataaatgaaatcttataaacttttttttttacttatgtatgatagaaggggtcagtatgtgaacaaaggtattataccttcctcccatgatcaaaatacactgacagatttggaagatacaataaagtatatcaggtagaaaaaccctttctgtaaccctaccacctagtaatttgatgaaatttcttccgtcttctatctttacttttcttctctgcaaaataacttgcaagattatttttacctttgtattaagtcttcaatgttcacaaaggtatttgcatttcccttaattatttactgtttagaagaatttgggtagttagcacccttgattgagaagtcgacgcaaacctttgtggggaaagttagacttttttaggttgtttatgtttggggactattttaattaagtagtaccatgtgaggatcttggtgcaggaagtcttctgtgtttaggatcatttcctctcagctggttcctggagttttagaagggcatatccactctcttgcagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtcagtcttcaatagtaagggagaaactaaccttttctttaatttcgtgaatttttttctttcaattatcagtctttatagatggggtgtgttcatttgtcattctgaggaaggctggttttatcaggaacaactttttataagtgggtacgagttagtattgtaaaagtaatacatgcatttgatagtcaatccgaacagtatgtaaaagtcttcttcttacttgcagttctgtcatcagatggaaccgctgaaattcctttaaatagtttttgagttatttaaaaaatgaaaattcagagaataataaaaaacacttttatatgaacacccagaactaatgattgaaaacattttgtcatattttctttcaagtctttcttttttttgagacggaatctcactcttgccacccaggctggagtggaatggtgcgattttggctcactgcaacctccacctcctggttcaagcgattctcctgcctcagcctcctgagtagctgggattataggtgcccgccaccacgctcagctaattttttgtatttctagtagagatggggtttcaccatgttggccaggttggtcttgaactcctgacctcaggtgatccacaggcctcggcctcccaaagtgctaggattataggtgacagccaccatgcccggccaagtcttttttttaaacctttttactgaaaaataagatacagaaaaccatacaaaaaatgtatagctcagtgaattattatgaggaagaccttgtgccgctccccaccccctcctgtcaagaaatcaaaatttgctagctactcaaaaagtgttccatgtacctcttccttctcaaagtcattgccccgactttgagtaatcactttcttgaatatctttgtagttttatcacccaagtgtatatctctacatactataccttagttttgcccttttcaatctattcaatttgccttatctattaatctgcagttaatacctacatctgtttttcttggcttgatcttcactcactgcaacctctgcctcctaggttcaagcgattctcttgcctcagcctcccgagtagctgagactacaggcacccgccatcatgcctggttattttttgtatttttagtagagatggggtttaactacgttggtcaggcaggttttgaactcctgacctcaagtgatctgctcgccttggcctcctaaagtgctgggattataggtgtaagccactgtgccaggcctgttttttcatttaaaacttttctgggaggctgaggtgggaggattgcttgcactcaggagtttgagaccagccggggcaacatggtgaaaacgggtctctacaaaaaaatttttaaaaatgaaaaattatctggctcacacctgtagtctcagctactcgggaggctgaggcaggagtaacacttgagtccaggaagttgccctttagcctgggtgacagagcaagaccctgtctctaaaaaataattaaagttgcttttctttgcatttatgttaaagcattattatttgttgttattcactctaatccatcttaattagccttaattcctaaaatgcctcttttatttctaaatttttttcctgatttctatcatttttctgaatttttcttttttttttttctgtctcactttgttgcccaggctggagtgcagtggagcgatctcagttcactgtaacctcccaggctggagtgcattggcgcgatctcagctcattgcaacctccgcctcctgggttcaagagattctcctgcctcagcttctggagtagctgggactacaggcatgcaccactacgcccagctaattttttatttttagtagagatggggtttcactatgttggccaggctggtctcgaactcctgacctcaggtgatccacccgcctcagcctcccaaagtgctgggattacaggagtgagccaccgcgcccggcctgaatttttctaattattgtttacattgttcttgcatgacttacatgattttattaatacctttagcttgttttggaatagcaggagcagtctcctggttcgtttttatgggcgtcttgctggcatgttttcattttcttacaggggtgttcttgttttcatcccatttttcttatataacttaatctttttttttttttttttttttgagatggagtcttgcactgtttcccaggctggagtacggtggcacaatctcagcttactgcaacctccacctcctgggttccagtgattttcttacctcagcttcccaagttgctgggattacaggcatgtgccaccacacctgactaatttttatagttttagtagagatggggtttcaccatgttggccaggctggtcttgaactcctgacctcaggtgatctgcctgcctctgcctcccaaagtactgggattacaggcatgagccactgtctgttgatcatttttaatgtgacctttccgaaggagggatggtttagagtggcttttgtaccttcccagatctctgctattttagtgcaaaaacatgtggcttgctttctgagctttcctctgtgcggtttttgagttccattgtccctatcatgttcatttttgattgtgttgagcagtttctcctcactgtagggcactgtcccagaaggggagttctgctctcagggactagactgctgcagactcgtagaccttctgcaggcccgtttcactcaccattaggcagggcacaactgctccgagtttcagccactcctcacactggcctgctgtgctctctagggaatcccggttgtgtgttttggggttctgctgttctcaagcccatcagttgccctgtttcttctctctgcgttctccttcacagacactgataacgtgaaggtcttgtggctgtcggtgttttgacccccatccctgtctctgtgttgtggggttcagtagagatactttgttgcctggttttgttgtaaacatggtccgtgggtttttggttttgctgtctacttgctctgtctttatgtgagcccctgtacttctttctctcctgcccatttgatccgttttccacatcattgcttatgcttgcttgatccttcaggtgaccagtatgcactgaagatgaggtttgtggaccatgtgtttgatgaacaagtgatagattctctgactgtgaagatcatcctgcctgaaggagccaagtgagtgtgactgttcctctcctttgcacccgatttctctggttgtacccttgtggtaccctaaggagagcctatgttctaggggcacagtctttgtgtcacttttctctagatttactttatcagggaacatctacttggcctctcttgagtcacatgtccactctgactgccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggattcactgggtaggatgtacaggagagctgtgtcaactttgtgactccaaggagtggggccagtactggtgagaacttgggagtggaggattcagagggacagttgttgccccagcagacaagggctttaaaacaaagggctttctggcactggctcccctgtctcaagagagtgggtgttctccatagctgagaagggagcagagtggaggagtgtgaatttagtgatcttgaaaggctccttagccttggaattctctgatcctaaatctggtttattgatgtagttggttggaggctatattttattcccatcttcttccaggaacattgaaattgatagtccctatgaaatcagccgtgccccagatgagctgcactacacctatctggacacatttggccgccctgtgattgttgcctacaagaaaaatctggtagaacagcacattcaggacattgtggtgagtggctccactgtttgccttccatggcgtcttccccagacagtgggctctgggggccaagaactcaccttctgtccctccttgggctggagtcatttgagctcatggcgtcttctggtcttggggtggggcagcaggtcgagtgggccagcctgggtgagtctaggctcccatgtccctacagccccgatgaagcctgtcctcttgcttctcccaggtccactacacgttcaacaaggtgctcatgctgcaggagcccctgctggtggtggcggccttctacatcctgttcttcaccgttatcatctatgttcggctggacttctccatcaccaaggtaccgtctctgccttcttcctgcttgtcatttgtgtccttggtaatatttcaccagcttgagcactgatcctcacagtgagcccagggcaggacgccatggccaaaagacccctgcctgtgctcatccttgccggaagggtactttgtttttgttgcttgtggtcactagcacaggaggttaagtccctgcttctgtcttgctttggctctggagacagagtaacttggatgctcagttgaggtaggaaaaacatgaaaagattggtgcttatttagctgttttgcttcttgttattcagtggaacttggaggtggaagtcccctcttagtcccctctccctccccacctcccccttggtgattccttgttgggagcagaaaccactgacctggccctgtcagcaccgttctccccactcccactctctgctccctgacaggctccgtggctccttggtcctccccaggctgcactgctgttatcctcaggtcatcctcttgctcttttcttccttccttcctccatttctcattctctcattgttccttagggctcttggctccatgccccagggtaggcactagtaccaggcacttattgtagtcaggtgggtgaggcctggtggaggagatgagcacagctggtgcttgaggactgtggaatgtgatgacaggcacagcgtgtgtttttttttttgagatggagtctcgctctgttgccatgctggagtgcagtggcgcgatctccattcactgcaacctctgcctcccgggttcgagcgattctgcctcagcctcctgtgtagctgggaccacaggtgcgcaccaagggtgtgcttctagtggggcaacttgggaggccccaaggctaccctgaggaggtgacaggcaaagaaggtggggaagggcattcagttggaggggctgatgtttgtgagacagcagggaggggttttggtaggacctgtgagcaaagatgttgatccagccgaactgtgtgggtccacttatatgcagatttttttcttttcgttttcttttttttttttcctgagacggagtcttgctctgttgcccaggctggagtgcagtggtgcgctctcagcttgctgcaacctccgcctcctgggttcgagcaattctcctgccttggcctctcgaatagctgggactacaggtacgtgccaccacgcccggctaattttttgtatttttagtagagacggggtttcaccgtgttaggatggtctcaatctcctgacctcgtgatccacccgcctcggcctcccaaagtgctgggattacaggcatgagacaccgtgcctggtcagatttttataatcaaatgcagataggaaatacagtactcaatacagtgtttgagggaactgaaaccaaatatgtggagggctgactttttgtatacttgggtttcacagggctgactacaggacttgagtatgtgcagatagtcggagatgcgggggggcgggggctcgaggaataactgtgtgtgtgtgtgtgtgcgtgtgtgtgtgtgtaattatttctgctgaatcattggaggttaagttgcagacgttgtgcccctttacccttgaatagttgagcatgtgtgtagcctgagagcaagggtattctcttacataatcataatacaatgatcaaattcaggaaatgtaatgttgccaaaaatctggtagaacagcacgttcagaactttgtggtgtgttctgccttctgtgccttcttcctcaaagaatgggtaatgtaattgtccattagttagttaatactattaactggccagttaattagtactgttgaccaacatccagtccataattttgctgactgtcccccgatcaatcacagctcactgcagcctcaaactcctgggctcaagccatcctcccacctcatcctcccaagtagtttgggactacaggagcataccatcatgcccagctaattaaaaaaatgttttttttctcgagacagagtctcactctgttacccaggctggagtgcagtggcacgatcagggctcactgcagcctcgacctcctgggctaaagagatcctaccatctcagctccctgagtagctgggactacaagcatgcaccaccatgcccggctaattttctgtatttttattagagatggggttttgccatgttggctaggctggtctcgaactcctggactcaagcaatctgcctgcctcggccttctacaatgttgggattacaggtgtgagccactgcacctggccaaaatatttttttgtagagacggagtctcattatgttacccaggctggtcttgaacgcctgacctcaagtgatcctcctgcctcagctgcccaaagtgtggggattataggtgtgacccaccattcctggtcctttctttgtgtttaataaccttgacatttgtggtgttgtagagaccagttttatagaatgtcccttaattttggtttatctaatgtttcctgctgattaaatgggcaagactgctgtaatatatatgcagggcacactgacattatcatccttgttcacatctatctgtctgccttactggactgtgaagtgaaatgtctgcttcatctttttttttttttttttgagatggagtttcgctctgtcgcccaggctggagtgcagtggtgcgatctcggctcactgcaacctccgcctcctgggttcaggtgattctcctgcctcagcctcctgagtagctgagattacaggtgcctgccaccatgcccggctaatttttttttctatttttagtagagatgggatgtcaccatattggtcaggctggtcttgaactcctgacctcgtgatctgcccaccttggcctcccaaagtgctgggattacaggcatgagccaccaggcccggctggtctgctcatctttatggccctagttttgcccattgctgaacctggtccagattaggtatcagtaggggtttgactttgactttccaagaaggtggcatttcatttttggatggctgctggtggcagatgttctttgggagataaggtcagagtggacccaagcctggatgttgtcacacatggtgcctctccttccttcaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtaagtgtcgggcgtcacagagttgcttggcttggggccctccatgcctcactgctttgtctagggcagacactgggcagctctcttgcttacctgcatgcttgtgggataagactgcatctggccataacttttcatgtggtgccagtccttgtggaggaaaaagggatttttggggtcctggtgtgagctgggtgtggaggaagctctgctagcctcgtcagcactgcgtgcccttgtggccagtattgagagtagctgcatcctctcctggaggccagactgttctaggtcccaggctgcttatgttgtggtaaaatgaacctagactttagaatcaataggtttgaatccaggctctgattcagagtttgtaaacctggccaagtcacctaacttctgtgcctcagtttcctcatctataaaatgggaatgctgttagcccctcataggggttctgagtgtgaaatgagttaatgcatgcaaaatattcagaaccctgccctgatacaagctatgtaaaggagttatctgtaaatgaggacagtaaccttttcgcagaggtgcccctcagagtcactgactcccctgtccactccctggcattccctctcctcactctgtgtgaatttcctcatagcacctaccactttttttgttgtttgtttttgagacagggtttcactctgtcgcccatgctggagtgtagtggcgcaatctctgctcactgcaagccccacctccaggctcaagcgatccttccacctcaagtagctgggatcacaggtgcacaccaccatgcctggctaattttttgtagagatggggtttcgccatgttgcccaggctggtcttgaactcctgagcccaagtgttctgcctgccttggcctccaaagtactggaattacagatgtgagccaccgtgtctggcccacgcctaccactttctgaaacgatttattcttctacttaagtgttaattatatgtcagcatctgtggacaagatcccttatctgtccttagtgctgttttctggaacctagaattgtgccgcgcgccatggctcactaaacatttgttgaatgttgaatgaatgtgactataccagtcctcaatgtgacgtacagtaggtgacaatgcctgtcacccccccttcccttgccattgatcttttgcctaattgaatccctggaactgatttgacaagctgcaaggagagaagtgatgttcatagaggagctgctatgtgccaggggcatgataggtgctgccaagtagtttcatactcagtcctcagagtcctagaatggagatgaggcccagggatggtgcagggcttgttcacaagggcgtaagaacggggcttgtgggtggtgaagttggcatttgaagccaggcctatcttcctccatagccagccctgctgccctgggacactgtgctgttggctgcatttgtggctgatacctgtggagctctggggtctgtaggcctgggagatggtggggcctgctgagtggggtgggaggacagctcacaagtcctgccctgctcttgcctcggccaggtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatttgtttttggtctgttgaagatctctcataatttaattcttaattttgggaatagtgcttttatcaagtgctttttattcattaaataatggatttgcttctcagcaggtttgcaaggcaagcatttacattttacatattagaacactgaggtattctagtaccagagtgttgaaagtggtgccagagtgttgaaagagttgacgtggcttatgtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagggagccatccgtggcctgccacactcagtcaagtcctgtggtaccctctcgttttcctttgtacctcttctccacctcatataccacggttggaatgtgtgtgattactgaactagcttcaatagggcaggggttttgtcttttatgctcatctttatgttaacagctaggtgttcagaccaatctatgacacgtagttgggttattgaatgtttgcatgagtggcttacaaacagcttaaatattggcaggtgggttgagggattactggggaagtctgtagaagaccagttgtgaggaactgatgctgaattctgtttcagacatggcaaaatggaggtgctcgggacatccaagtgggagtgtccctgggcaggtggatattcaggcctggaattataaggtctggtgtgcaagtggtaaatgtggggctgccgggcctagacatggttatggaaaaggtgagaaggaggctgtgggaggggacagtgcctaggaagggtatagaataagaagagatccagaactgaatattaagacgacaaagtaatagtggccacctgggttgacaaagaccaggactctccttacctgggacgagaaagaccaggactgtggtgtcatgaagccaagtggaaaaatgtttccaggagtgaaccatctgaggctgaagagaccgagcagtgccttttggctgtaggagtggatcactgaagccttttacccattggtgacttgagaactgtgttggtgtggggatgggaattggacggaagtgagacttaactttgagtcctgacaaagcatttcgcaaacaggctgggaaagggatgagtgagggccttcaggaggctgtgctgcttgaatgttctactctaaggtgggggacaccaagtgtgttgaatgccattgggaaagatccagttgaaaatgagaagttgaacatagggattaggagattgtgcagggggaaaatgggggatccaaggacagtggaaggatgggaggagcaagaaggaagaccctccagagtcgtgctctgcagtcggatccctggatggaaatcccaggcctgccgctctctgtgacctcaggcaagtctttccgtgcaaaatggagtagggctgttacctgcttcctaggatggctgtgtgggtcacatgctgtcataatgcaaggtggcgtatagcaaatgcttgttaaacagcgacggtctcgccgagctctggcctgagccgggggcagagggttggtcctgtcctgggggttggaagccgtggaggccacgtttaatcagtgttcacagtggtgtgcccgtggacctggcctcacgcacgcccggccttgggagcccctgcgggagggtgcataccctgacctgcccgagaggcgtctgccgcagcccctgcttcccctagggaacccccgggcggctgtgcctcacggaggggccctgctttaccgcggctgcataccacctcgggccatttggtcagctgcttcacc

SEQ ID NO: 16520 - DNA, 47122 bp, Human
  misc_feature (1)...(47122): n = A,T,C or G
tcaatgaggggctaagcaactttgtggggtgctgtctctagtgctgatgaaccacatgccctagtaacaacctcagccttccaaggcctggcctctgttcttttaggccctgaaaatgccaaaagattccattcactgatggaaatcattaccaagtcctataaaagccaacgtgtaaaatacatgcagcaaaactgatgaattcaagtgtatgtgtttgtgtgtggtctagaaccttaattgaattcatgagaagccttaattgtgagctgtgttgtaggctgtgtgccaggcacttaggttaaaatggtaaacaatcaaatgtggtctacaccctcaaaaggcctgcagtttactgggagagaaaaacattgacccagtaattatgcaaatcattagaaacctagattcaaaagaaaagaaaaaagtatatagaaacctagattcaaatgttagaatcaagatgtacaaggaggtgtgagaggccgggcgcggtggctcacgcttgtaatcccagcactttgggaggccgaggcgggcggatcacgaggtcaggagattgagaccattctggctaacacggtgaaaccccgtctctactaaaaatacaaaaaaattagccgggcgtgatggtgggcgcctgtagtcccagctactcgggaggctgaggcaggagaatggcgtgaacccgggaggcggagcttgcagtgagccgagattgcgccactgcactcccgcctgggccacaaagcaagactccgtctcaaaaaaaaaaaaaaaaaaaaaaaaaaaaaggcggtgtgagactgtggaactactgtaattggatttgatttcaggtctgtctcaattctaacataaactctcctgcactctgggcaagtccttcccttcctctggatgttagtatcctcttctgtaaaaatggtgtcataccatttgcttctgaggaaatctctcctatttgttggaattcagccaaggcaacatcaccttcatgatgccttccctggctctccaggctgttccgggggcttctgctctggtcttctcgccacctgggtgtacctgtctcagcacatctcacgttgcaagttttctaagcaagaagtaaacgcatcaagacttttatccctgtatccccagtgcattgtggtgtctggctcgtgtttgttgaacggatggatggatggatggcaagtacaattgtggtgcaggttgtgctaatatcattatgaaacctgaagggacaatttgctggctgattgtctcagctggagtcatgggacgtgatgagcattattatataggttttgaagcctgaagatttctagttctgattatttgtgatgctttcttgggcggatgggcctctttccgcttgtttgtagctgcatgcgtaattacactaccttacagggctgtggaattttgaaaactgcaaaatgttatttacagtcaactgaactcagcaggaaccttatctctcggtggaggatggaggatagaagcaggggaagacaattccacggaaacggtggtgggttgagctgggcctttccagggagatgcaaaggtatgggagtcagaaaacattggttagtaaccaatcccagtttaagctctgaacctcagttcttctgtttccaaaacggaaataataacttgagatttgcgtaagagtatgacgttcaaatgtgctaatggataggacggaaggattaggagtggtacccgggggccactgcctcgtgcaacgccccagccctagatcaaatccggggcgtggtcccactgtgctcccgaccccagcctcggcaggaagcgccggctacgggggaagccaacccggagacacagacggaagtgggtgaccggagctctagcagcagccgcgatgggcgcagccgtgagcctatggagagcggaggtgttcccgcttccaccaatggaaagccggtctaggcgggcctttgcaaattgccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggtgtggccagtggaccagggagttgggggctgcaagcagggctgctgcggcgagagagctgctgaagtcggtggctcggggcgggatgcgcgcgccaggggtctcccgccattatttcctcagggaagtgaaaatgggccaggggctcggggaggggcgccgccctggagctgggtgaggggccgccccaggatacctagtgacgatccactgggggcagttgacggtttgccaactcatggacaagtgctgatataaacccacacaaccccgtccccttaattcgtaccaggctctattcgcgacactgggatacagcgggaattaagataggagcttacattttagtgtagtgagagacgataaacgtgtacaccaataaataaaaataattatcttatcttggtggggttagttactgcagggctttgtcggccacggtcaggaaattggattttattgtgaatgcagtggcaggctatgggacggtttaaagtagggaattgactaaactttaaaagctcattttggttcccaggatccgggaactgagggagagaagtgggaattatggagaagagcaatctggtttatccacccctccaagcatcctttttgaccattccaattaaatctcctttttctaagtgctggtgatgccaagtactttcacatacatattattttttggcaggtgaaaatattgagttggggagagggcacttcacgtatatgcttgacactcgttttagtaacggtaaacctggggtttgcacccacgtgtatttctgactcccaaatcagtgctctatgatgatacagccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgcgctccagcccgggtgacagcgagactccatctgaaagagaaaagaaaagtagcatctgaagaatatcttctaggttctattaagggcagtgtgctttggtaactgaagtggaaatgggatggatatagcatacccacacacattgcttacatcatttttttttttttttgagagggagtctcgctctgtcgcccaggctggagtgcagtggcgccatctcggttcactgcaagctccgcctcctgggttcacgccattcttctgcctcagcctcccgagtagcaggtggattacatggtcgggagattgagaccatcccggctaacatggtgaaaccccttctctactaaaaatacaagaaattagctaggcatggtggcaggcgcctgtagtccttacatattttttgaggggctgccataagtgtgggaccaaggtacttcacagtccatgaggaatagaggtagaagagataagatgtattcacaagactctggcacagtgtggtcactgcccagagagaagagcaccttttagatagtcacgtattcagttattaaatcagtgtagcaaaccttatattatgtaatcctgagatatagatgctcagctagtgtaactttctcagtgttccccccttatagtcaaatattctaaaatatatgaagttccatagcccatttatggaatatgtgtgtgtatatatacacacatgtgtactgcaaatggttaataaaattcagagatttataatgtatttaaaatatactaacagatgataaagtaatttaaccttgaggattcaaaacatattcaatggatctaatagtgccataggtttaacttcacattcagtatttacagtgttcactgatggccagctagtactctatgtcattgattcttaccccttaataggttactctgggaatttgatgaaagctatggatcctttctctggaaaaaatgtatatatgaacataaacacagttttgttcccaacttcaagaggtatttgggcccctggcgtctatccctgtaccctgggccaaaaatcagtgttcccacttgtactcatactgtgcattcttcacacagtagtagctagcaccatcttttaaaaacaaatcatagcatgacacatagtcttcaagaccttttcagtggctttgtattatttatgtagaataaaatccaaactttaccacacactgtaagttcctgttctgcgttctggccgctgtctacctcttcaacctcatcttcctggtctttttcgctatactttggtcactgcaacctttctgtcccttggatatgccaagcttgtttctgctttggattttctgaattcgctgttttctttgcctggaacgctgactcctgctcctcccagaggttcacatatcaaattaaatgtcatcagaaagacactccaggatcactttctagccactcgttctctctcatcatccctttttcttcatagtagtgatgaagattatgtgtgcaatgtttgtatgtttgtatccctccctaaaacatgagctccacaagtacaaggcttttctgccttgccttcgttaccctcggcacctagaacagtgactgcagtgcactggcactcagtgttagttggatgagtgtgtgacttgtgtaggccagggactgagatttttccccttgtgaaacattttaatattgatttattatttctttccattgtggtgtgtaggcatgtggcgtcatagtagaattaatcaaaagcaagaaaatggctggaagagctgtcttgttggcaggacctcctggaactggcaaggtactcattttctctcattttttaaatctacccaggagaatgatcctagtgtctaagccaaattgaattcatgtcttaactagtctttgtttagctaaatgggttatatgtatgtttttaaaattaatatgcaataatacaattgggtatctaaaatccctgcttctaaaattcaaattatcctggcctacctccagagaagaaagaatgaagtccttgaaggggtctcattgtctctagaatttgtcctttttctctttcaagtctcctttgctgtggaaatacatttctgttggcctagggcttcataaagatcttctgagtgacatcttacttgaggggacaaaaaaatgagtcaagcattcttccaaatgctagctttacgcatcgctattgtggctgtgtgggagatgaaaaaaaggaaaacaagaattagagacatgatttttatcttcaaggggcttacagtctctccagggcagaaagaaaggaaatcatgacagcacaggaggactcagtatgagtgctcagctttgaggtattgactaatattaaatgcagctggaatttaaggaggcagcactgtgggctggtacagctggaagggttgagacttgacattttcccttcagagctgggagaggatttggctttgcagggaagataagggcctttcaggcagaggacaccgtgtggcttcttgggattcgtgaggggactggccagatacttgaaactcaccagagttcccaatttgagcttgcttattcttcaaaagggccgcttgatgtgggcaagtaggagcttggggttgtgtgtgaaaagaaatgggctttaaattccagctctagtattgacttgctatgagacctgaggcaggtcccttaacttttctaagcaaaagcatactctacctatttcaagcaattattaaactgatcgattgtaagataatgacttgcattataattttgaaatgattactgattgtgtatcttatattggtatcttacaagaggaagaagtgctatatttgtgaacagttttttctcttcctatataaaagcaaattgtgaacagttttttaaactgtaaagtgccatacagatgtgagcttcagttacctctctccaggcaacattagcttgtccagtgcatttaccatttatttgcttgctattccttatatcttagaccttctctttccctccatttttcttcttcctaaagtaaataatttagaaatttcttctagaagtttgttggtgggaaagtctctcacgtttgcattcattatgttgcccttgttttgaaaaagagctatgttggctatataattcagttgacagatattttcttcagtactgtttcacagtacttctctctcaatgttatttgctcctttggcttctgttgtttttgagaagtctaattttgagggttttgagtcttctttctgcatgtttttgagatatttttgggtttggtgtttcactattatatgtcagagtggattaatttttgtttatcatgcttaatgctaattgtgcttcttgaatctgagtattatgtctctgctcaattctggaaaattgtcagccttaggagaatcgcttgaacctgggaggcagaggtatcagtgagccaagatcatgccattgcactctagcctgggtgacagagcaagactacgtctcaaaaaaaaaaaaaacaaaaaaactgtcagcgttaatctcttcagctattgcctttccccattctctttgttctttccttctggaactccactgagatgaggttaagattgcagtggttttcaacctggggcagttttgcccttgcaggggactttgacaacgtctggagacatttttggttctcacgacttggttgggggtgctactggcatctagtgggtggaggccagggatgctactaaacatcctgtagtgcacagagcagtttccataataaggaattatctggccacaaacgtcatggagtcaagctgagaaaccctgggctagagcttctcgttttgtcctctttgtcttttagcctctcatatttgttatctttttgactctgctaaattatgggtaatttcttttagatctttgttccagtctaattgtctcttaagctatgattaagtgactgattaatccaatctattgaatatttttttccttttcattttgaaaagtttggaacctacaaaaaacttgaaagaatagtgtgatgagcccctctataccctatacctagatagccagttataaatattttgtgacatttgctttttctctagtttatttctgaaccacttgacagtaagttgtaaggatgtcttcctacatgaccacggtgccatcatcagacccaccttgctaatgctattatattcccccaatttttgtcaattaaaaattaaattaattaatttttaaaaaatgagcagcagagccagggagagaatggtgtctcaggaaccaagaaaggagaacctttaaagaaaggagtaggtaaccatatccactgtggtagagaaatcacaaagatgagggagcctggcagctcatcatatgattccatgagcagttaacaaatgtgctttcaaagacaacgaagttaaattgttttaatgaaaagaaaatataggtgatagaaatcagaaaacatctttccaagttgtttcagtttttggctttttaaaaaacaccagaatatcaaaatgcaatcaaagattacacactgcataaattgttacaagttataatgtctttttttttttttttttgagatgaagtctcgctctcttgcccagggtggagtacagtggcgtgatcttggctcactgcaatctctgcctcccaggttcaaacgattctcctgcctcagcctcctgggtagctgggattacaggtgcctggctaatttttgtatttttagtggagatggggtttcatcatgttggtcaggctggtctcgaactcctgactttaggtgatccacctgccttggcttcccaaagtgctgggattacaggcgtgagccactgtgcctggcccccagatgtattttgttatggcccaccttttttactcatgtgtggcccttcaagagtcctcttttatgttttttttttaattgtaatgtttttgtttgtttgtttgttttttgagacagtttcagtctgtcgcccaggctggagtgcagtggtctgttacccaggctggagtgcagtgatctcggctcactgcagtctctacctcttgggttcaggtggtcctcccacctcagcctcctgagtagctgggactacaggtgcacaccaccacgctttggctaatttttgtagttttcgtagagatggggtatcgccattttgcccaggctggtcttgaactcctgggctcaagcaatccacctgcctcggcctcccaaagtgctgggattgcaggcttgagccaccgtgcccagtcccggttttattcaggggtttctatcttaagtgctataccttgctgagctttcctgtatctacagtctctgaactttcaaggcaaatagtttactgctctgaatgttattatttattcaattctaggtgttttgtaagaggagaggttttcagtggacccagtgtgccatattgctagaagcatatgtctttcattttttttggtgatattgtattgctttcctcccaggaaatatgagaagtgctcagcactgtggtattaccttataagtttgtccactcccttccaatgtgtatgaaggaatttggtgacttctgcttaatggtttgctgcagggtcccaaagtttaggcaacttacctgggtgacaggcagaaatactgcttattttagagatgcaaatgcatggttcatatgcatttccactcttgaggacctcacactgttaataatgggtttgggttttagaagaaggagatattcagatgagattgaaaaatagagatttcttcaaccttcttttggcaacaacctcttttttgtgccacttgtcactcacatggggtgagtacaaaaaaaaatggctttggagattggggtttgcatcctggtgctgctgcttgcggttttaccttgggtgtgttggtaacttttgagtttgtttcttaatctataaaatacaaattagatgatcaaggtcataggctagttggggagattcgatgaggtctatgcagcactctgtagtaggtgtaggaatagtagccatatcatatactttccctctggaagtctttaaatggaggaaacgagacacacatgaagctttttttttttaaccaagtatttatcatattttaatggaagtatgttcatctcttctgtattagttaaagggagggagagtgccattgaattggatgtggtcactgtctttgaagttcaaaactgagggtagggaattggggctggcagagatacaaggaagagaaagaggagtaactgggaaggggtggtcctgtccagcctgtggccccacggggagtctgctgttagagtgctgctcctctcattgtgccctttcatgttccagagatttttttcctttgctcttagaagaataccagttttcaaggtgtcagccttgagctcacaagtgcagatgcctaatgaggcaggcaacggggatgagggaagtggctgggtgcactgtggcgtgtctgccttgagccccaggtgctcggccttgctgaaggtcaccatgagactgcaggccaaacagaaccaggctgtgagcaacgagtttgccacttgtgatctagcatggcactttagtactttcatttgacagatgaggaaatcgggcacctgagatttgctgagtgcccaaggtcacactgaaaattagtggcagaaccagcactaatctttctgttcctggctagtgcattttatactgtgctatacactgattctctaccagattttactacctcaaaactatcaccaaaagggcatagaaaagaaaatctgagaggaaccttgactgttaattttaagacaccgtctcagtttcactttgttcttcagtaacaagcttgttttcagtcttagcccatatacctggggagctggccttactcgtgctcctgtttcagagttgaggaaagatgaaaatggcatttagaggccatggcattgcccagttctgtaccaactttaaagcatttgcttgccatacttgacatttgaccgtacacctgtgaagtctggttctgtttagcatttgccagctgtaattatcttgtcaaaaatcaatttgtagtttaccacagggcgtgtttaagtgtaacttgttaagaccaactcatagcttcaaaatcctacttgaggtatccttcttcactctttgtgggctacataacataaaatgaacaatccattcattcattccttcattatttctgatgggttgtagattggtgttttcctgtatttgtaaaaagagaaagcaggtatctcaaagatccagtggtgtattcggagcaattaggtcagagccatatattgatattgagagaacaattttggatgactgtaaagttggcccttcctatctgtgggttccacgtatgtggattctgccaaccacaaatcaaaaatactcaggaaaaaaacaataaaaaataaaaatacaataacaaaaataatacatacttaaaaatacaatataataactatttacatagcatttatattaggtattgtatgtaatctagagatgatttaaagtaacaggaggatgtgcataggttatatgcaaataccctgccattttataccaggacttgaacatccatggattttggtatccctgtggatactgaagagtagactcttctaattatgataacatgatctttggagtcctgctgccagagattaaatctgcgctgccattttctagattatggtacttacgttgcattacttaatgtctctcagtttctcatgtgtaaaatggggagaatactagtgtctatttcataggctggttgtgaggatcatgtgaggcatttggagttgggcctgcactgggtaagtctgagtgaatgataacttgtaattatagggaagataagagatgccatttatgatttaaattgactgtccacaaaagtcatcaaacatttattgtgtgaaacatgctaaatggtaggactagatgttcagctgttcctagttcctggtggttctgtagcatgtgtttctgaactgtcatgttttcaggactgtgaactgtgtttccgttgctttcttttgtagacagctctggctctggctattgctcaggagctgggtagtaaggtccccttctgcccaatggtggggagtgaagtttactcaactgagatcaagaagacagaggtgctgatggagaacttccgcagggccattggtaagtagtgtcacatttgtgggaggagttggtctcacttcctgaagcctgtgcaccgaagcctctttgtggtgaagatgcctttatgactggtattcgtggcactgctgtttttcttttggcacttagtagtgcattatttttcaaataaaacaaaaccccagtttttctcattgaagtgcgttagcaattggagcaactatggaccctagctgtgagcctgcgcttcttcatgcaataaatagatgtgtctaaaagtgtttttttaatgagtcatattttcctggaagtcttattttgccattagagatgactatccactgaaaaggttttggactcaagccagaatctttgtgtgccatgtggccagaatgcccctggtcctggatggcgagccagaagagttgtggcctgtcatagagtgaggagactgaggagtggggactggcagagcttagaggcttatggcgcctaacccttagggcctcaggctatcatagtgagtgcctgtgatgagccaggccttccctcctctgaggggagattatcaatctacatttcgcatttgaagaagcagtctcagaaggttaaataacttgctagggacccagttagtaagtggcagaagtagtttgatccgacatctttctcatttctagagccgttgctgtgaagattggctgtgagaagaaaatggcttctctttcgaatttttgctttttgctagctaggacttctggggcagttttttggccccatttctgctggcacagcactgggcaagtcctagtttccctcagatctgcttatagaaatagcttatttcttttaactgttacataaaagtccagttattaagccatttctgttttttgaacatttagatttattctcagcttttactcttaaaaacaaggctactaggaatatccttttatgtgtctttgtgcacatgtgcgagtatgtttctaggatttgcctgctgagtcgtgggttatgaacactagtcagagtgcctgtaccagtttccaggctctttcattgtcaaaccaaagtaagtattcttaagaaggaaatttaccagaaaacttcaaggaaatgatgaaacttaaaagactgatgaaaaagttcagtttcggagtaagatcaggtagggccatggttaaagcttttgattttacattgaacaaaaggagaagcagttagaaagtgctggtatccctgggctctggttttgcttttaccagacccctccggctgggttgggagtggatagtaaggagggtgagggcagagaggagtctgagcaggacaaaatagtggcttggaccagggtggtggcagtggaagtgcaaagtggttggattctgggtgtgtttgcatggtagcgctgacaggatttcctaaagggttagatgtggggctgaaagaaagagaggagtcgaggaaaattcccaggtttggccatttttggagatggggaagaatgggagggagcaggttgggtgtttactcagcgtctcctggggatacagtggtcagtgcttatctttgtagacacagttcctggcacatagtgggtgctcaggaaagttcttctgagtgagtgagagaagtgggtagactttgaagcagttagaaaacagaagccttttttttttttttttgagagagagtctctgtcgccaggctggagtgcagtggcgtgatctcagctcactgcaacctcagcctcctgggttcaagcgattctcgtgcctcagcctcctgaatagctggaattacaggcatgcatcaccacacccagctaatttttgtatttttagtagagatggggtttcaccatgttgtccaggatggtcttgatttcctgacctcatgattcacctgcctcggcctcccagagtgctggggttacaggcatgagccaccgtgcctggctcatgccctgtaatcccagaagtctttagctaaaaaatatgaaaacagaagtctttagctaaaaaatatgtctgggctatagacatatgttgtttggtttatgaagtattttttataaatttggagctagttgtcaatatttagcaatagggaagtgtcataaagtgctcatttctgcctccttgaagcagctttccttcccacagcaggcggagctgagcgggtacttctgaccaggtccccataagcattgaagtttgtgactgtttttctaaaccagagagattatgaactgtgtccagaggctaaattttgtgttacttggaatatatttatttttattttataattttaacacttcctcagtgccacgatttgaatatttttaaaactgcaaagtatttctgactggaaatatattatttttaccatgaaatattggattttttggtgcttattttaattattttattttgttttagtgccatggtctcactctgttgcccaggctggcctttaactcctgggctcaagtgattcttccacctcagcctcccaagtagctggggctataggtgcacaccatcatgcctgggtttggtgcctattttatttaagttatctatttttaaaacatttttctctttttaaattttttttagagacagggtcttactctgttgtccaggctaaagtgcagtggtgtaacaatagctcgctgcaggctcaactccttgggctcaagagatcctcctgccccagcctcccaagtagctaggactgcaggtgtgcatcaccacacccagctaattttttaaaaactgtatgtaggccgagtgcggtggctcatgcctgtaatcccagcactttgggaggccgaggccggtggatcacctgaggtcaggagttcgagaccaggctggccaacatggtgaaaccccgtctctactaaaaatacaaaaaattagcggggcatggtggcatacgcctgtaatcccagctacttgggaggctgaggcaggagaattgcttgaacccgggaggtggaggttacagtgagtggcgattatgccattgcacttcagccctgggtaacagagagactctgtctcaaaaaaaaaaaaaaaaataaaaaaaaaaaatttccagagaggccaggcctggtggctcatggtggtgcctgtaatctcagcactttaggaggcaaaggcaggcagattgtttgagcccaggagttcgagaccagcctggggaacatggtgaaactgtgtctctacaaaaaatacaaaaattagctgggtgtggtgacgtgtgcctgtagtcccagctactcggaagcctggggtgggaggatcacctgagtaagtcgaggctgcagtgagctgaaatcacaccactgcacttcaacacaggcaacagtgagaccctgtctcaaaaacaaaatcgggaggctgagacatgagaatcgcttgagcccaggtagttggtggttgtagtgaggtgacattgcgccactgcattccagcttgggctacagagtgagacaccatctcaaaaaaaaaattgtttttgtagagatggggtctcactatgttgcccaggtggtctcgaactcctggcctcaagtaatccttttgccttggccccacagagtgctgagattataggagtgagccactacacccatcccagtgccagttttaaacagaggtattacaaacttatagagaaggatgtaaaacattaattaattatgaagtaaaggcttataccgtcaccaccgaaggaacagagcacggccagcacctcagacatgtgtccctccctggtcacaaccccttcctctcctaggtgggacccacaatgtgccataattgtgtgggaatggtttatgtgatcatcataaccttgtacaccccatgtgtgtatctttaaaccatggggcttaattttgccctttttaaagtttatctaaatcatactttatgtgttccttgtgtcttgcttctttagctcagcgtctatatctgtaaggttcagcccatgtgattacatgcagtgtactttgtggatttttacgttgtatttggaatagcagtggaaatgactcgcaggactcctttaaggtttaaaatcttctgagtattttttttttaaacatgtgcccatggttttatttaactcataataaagatgagatgaacagtaagatgttacaactagttcaaatgtctgagtactttttttttttttaattgagacaaggtgtcacactgtcgcccatgctggagtacgtggcatgatcttggctcactgcaatctgtttcctgggctgaaatgatctacctaccttggcctgccaaagtcctgggattacaggcgtgaaccaccgtgtctggtccctgagtattttttttaaatgttctatttacttaaaaaatgtttttctgatattgataaaatctgtgaaaactggctttcacatggatgtatgtgtttgcattgcttaaaggtaacttgaatgctttaaaattcagaaaaatagagataagttccttggcatctgttttgtaatttgccatttttgaggggaggggacagtagtaccattcttttgatggcagcgaggtgaaaagaaaatttcttgatcctaccagagaataaaaaggcaggccattgactatcttcaaaaaggaaccctgcccatcttcctctgcctttgaattctgtgaagttgggagagggggtggggaggaagcaataagccgaccagaaataaaaagcagggagtctgtgctatttccttgatgtgatgaaggtccctgtcagggatatagaaacctgagccagcagatgaaacctgtgtcatttgtgttgtcgttgccagagatagcgccagctcagcccctttcctggctaacagccggtttcattgtccgtcacccacgtcccctgccagcttgtcagcacagagcaacttctaaacaaatgtgggggctagtgagagacgggaatgtctttcttcccctccttgaggaatttcatgccacattcatctagcagtaaatataagtaagcattccatttgaaggaatttatcgctgtgggatataaaaggtttgattttaaaaaatcaaagttcactttaaaagtacaggattttcccagtttaccacaatgttctgatatattcgtgttgtttggagaatttttgtctaagattaatgttcaggaactaagaatttggtaaagcacaaatgaaatgggtcctctcttttggggctattccaaaacttccatttataggctatcagatagaatgaaggtagagtaaaacttttccttaactttaatatctgagagtctttgtcctgactgggtttctggggtagagaaggcaaacagcccaatgataagataatgaccacatttaaaagtgagaagttacagagcgtacctgacactataggtagtgtttcttagtgccattggaatatttccatatcagaacggaggtagcttaatggtgagaacaccaaatccttatcaagccaccctgccatcagaactagtttatgtctccacatttgtgagttgaatagtttttcatttattctttagataactggatctcaactgtgtctgcactttggaatcatggggggaatattaaactaatagtgatggcaggggcccatcccctaggatttggaagcaagtagtctgggtacagccagggcgtgattcattataggggcccctcaggtggacctaaaggttgagaaccatgaccataggctccagcggagatttagagcagtatttcgtaaacttaggccatcagtggtcttacttcaccgggtcccactggtattatttacttaaaatttttttttaaagtagacttggtaattttatgcatatgtacagaaaagtgtgcagaacataaatgcatagcttggtggattattgtaaagtaaaaacccgtgaaaccagcagctaatcaaaaaagggaatgttgccagaactccaaggtacccttgatgtccactcccagttgccatccttccttccccaagttaatggtagtcttgatttctaacagtacagttcagttatgcctggcttttagtgctgaggttgagggtgtttcggtgatacaggctataacattacatggctgactccttagagttctcaggccattaccatatagaacatgtaaatgtatctgcaggttcgtttcttgggtattattagtagatgatgtgcctaatgacaaccccttcactcttagtgacttcattcattcatccattcactctacctgcctatgtgctgtgccctcagctcaggtgtgggcaatctgcagaggggtaggcaaggtctgcaagttatggcattgccgtgggctgctgctgtgccagtggaaacacaggtcaccatggggacaatttggaggatgaggaagaagaatgtgtgaaggggggggggatacgttttaaactgagtctgctaggaggagttgcctaagctaaaaagagtggttcaggaagcagaaccgttatatgcaaaagcatgtaatgaacatagagatcacgttctaaaagttaatttaacaatgattcttggataatgaacaaacgtttattaaagagctaatgtggatgatgtttagaattcagagagaaatttacctttatttgcaatattctaatgtaaggtgctttggaaattggttttgttgttatggccttagaaaaactgtagagcagctgggaatggtagctcacacctgtaatcccagcactttgggaggccaaggtgggtggatcacctgaggtcaggagttcaagaccagtctggccaacatggtgaaacctatctctactaaaagtacaaaaaaaccccaaaaattagccagatgtggtggtgcacgcctgtaatcccagctacttgggaggctgaggcaggagaatcacttgaacctgggaggcggagcttgctgtgagccaagttcgcaccattgcattccagcctgggtgacagaatgagattctatctcaaaaaaaaaaaaaaaaaaaaagaaaaagggaaagaaagaaagaaagaaaattgtagagcaacacattgcaaataatgcatgacaactgggtatttcttcttggagtatgcagtgagagccagaggcccataacacctggcagttttgagtgtcacccactgttgacatagatacctaattattttagtatgttctgctcaggtttcatagtgtcagagggtgtgtaatgagttattccactggttttaagatttcctttgagagtcagaaattcaggaaacaaggctacaggagttttgatagccactgttctggtggaatagaatagtgtgggttcagagactggattaaaggctaaaggtannnnnnnnnnnnnnnnnnnnnnnnnnnnnnnnnnnnnnnnnnnnnnnnnnnnnnnnnnnnnnnnnnnnnnnnnnnnnnnattttaagaattataacttgtctatctagttctggatttgaacctagaaagttcccttaaaaagttgcatttctaggccgggtgtggtggctcacacctataacccagcactttgggaggccgaggagggtagatcatgaggtcaggagatcaagaccatcctggctaacatggtgaaaccctgtccctaccaaaaatacaaaaaaattagccgggcgtggtggcgggcgcctgtagtcccagctactcgggaggctggaggctgaggcaggagaatggagtgaaccggggaggcagaggttgcagtgagtcgagatcgcgccactgcactccagcctgggcaacagagcgagactctatctcaaaaaaaaaaaaaaaaaaagttgcatttctaatagtgcctctaatttacattgatatgtttgtattgcctttttacccatcatgacaccctggaatgtacattattaaggttgatttggcagttctggtgacatggaagttttgggctctcagtgtgagagaaaagattctgcttctcaccatggcccctctgccacctcttccagggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaagtgagtacatgtatgtggcctcttttcccttgactctcccagcactgtgtggctttgggcaggtggtgtaacctctctgcatcccagttttcctgacctgtgcactgcaggtattgatttctcacagaattggttgaggatattgtgtgtataaagcggtacctagcatagggcttgcacataggaggactcaaggaagatagctcttttcttacttactcctaggaaactctgcatgttaaaatgtgagctgtgtggttaagtcaagaaactgcctctgccatcccatgtcccatattatgaccatgcatcaaataccctgggctgggtctgaacctgggcattaatttttccagttatcagtgcccatgctcatagaaagaaacagcattgagtaatcaaataagagttgtataaagatgatggatgggcttcccaggggccacatgcagaatcctgactgcagttgcttgtgtcaggaacctgtggtcgcttcagtggctggttctgtttagtacagggctttgtggagaggccagaatggtgacactggatagcgctcaaagacagtcctcagccacctgtcctgtaagtctttaggatggaggcagtagagtttctaggggaagagcatgagttttggagtctaagtccttaaggaatccctggctttgttacttacaactgtgtggcattaatctctgagtagtagtttctttatttgttgaatgggaataataattgcctgtctttcagggttatggctttgggtgtggcacctagttacctaatgaatgatagctgttaatgttatcgtgagagccttcacttggagaaatggagcagtctggattttaggctttgccttattattattaataaatattatcattatagctctcatttattgtatgtgtcaggccttggactaagtgcttcaacaaacatttattgtcattcataactttatatgtgtatatgtttgcgtgtgtgtatgtgtgtatagttttcctcatgttaacagatgaaggctcataaagaggttacatggttatcctgggatcatccagccagtcatgtggcagagctgaccctctgagtcctaaccgttgtactgtctgcccaccagcttgctgtgtgacctttggaagtcagttgagctctctgggactcagttttctcatctataaactgcaggagattgaccatataatttctccatttttattctgttctacgattttatggttctttgattctctgaggttgtttcttggtcactgctttatggagatcgtaaaaatgtcacttcttcaaagggccatttttctttttcctaacagggtttccatctcaggaacttgcctctgcaaatatctcttttatacctacccctcgtcacttccattctgaattaattagatttctcagtagcatctgccacctttccagtaattacatcttcagtcaattcatttgggaaattaaccgatataaaaatgcttgaggcaaaaaagaagtatattctccaatgtaggacagataaaataaggcgtacagtttaaatttcagctatttgtaacactgctttgtacagtttctttacaaaaataatgtagaggagaagatgaaatttttcttccaaaatgaatacttttaggtatttttagaatatgtacaagatatttggatagaaggtgctcaaatacttggtggatattcaagtctgaaggagtcttctgagttctagcaacgagaatgccattagtactcatgaccccttcctgccaggccttacctgggggcctcacccacttttgtccttaggcgcacagactcacagcagttctgccagggtctgccgtccccacccagctaaggagaggcagaaccctgggtttgctgctgtggtggtagttttttaaaagctttattcagatagcattttaaataaaactcacccattttaagtatacaattccaggaattttaatttattttcacagttgtacaatcaccacaatcttaatttcagaacattttcatcgccccaaaaagaatcctcctactcatttacagtcattccccattccaactatagccctcggcaactactaatctactttcggttgccttcttttggacatttcatataaatggaacatacagtgtatgtctttttttgtatctggcttctttcaccaagtcctgggttttcactttttaattttgtttgggcaaagcccaagttttttttccaccatagctacattgtataacatagatctccatgaagacctcgagaaacttgtgtttaactatagaatccttacaaaggcagctgtcctagaatattaatcactgagggtcaccagaatctggagaaaagcaacagttccgcaaatctgcttatttcctttcctggagatataagcaggcagacccaagggcacaaacactgggatgtgagtcaaaaggcttgggaaagattctcatttatgtttttctttgaattactgtatacatctgtgattgcacctgggtgctgttgtatagatgaggaaacttagaactgagaaccttatccaaaatcaaaggccctgcaagatgccagctttgagattggtaagcaggtgctggcaggtacttcagttgtggaaagttccaccccacctgaggtgaggcaaatgaaggagtgaagtagggatgatgatttcaagaggggtgatagggcctgtggtcctgtggacagtgggggctgggcccacccgtctcacggcagccaggaccatccttataaaagcgctgctgccagtttacagcctttggaatcaagggaaagaggagagtacgtgtcccctgtgtccctctcatgctcgttacatagggatgcaggtatgctggcccccctattttctccctggtgtgcttagtcccccagccagtctgttgtgtggtacttatgcattcacactcctgcaggtcccagtattcatgcaaacgcaaaacaggctttctccatgcacctgctagctacctcagatcccttacggaaaggtaccttacatggtgtcagaaggaaatggaatatgtattacacttctgatttacatttttttttttagctggaccccagcatttttgaaagtttgcagaaagagcgagtagaagctggagatgtgatttacattgaagccaacagtggggccgtgaaggtaatgccttccttgggacacagcattgtccctgatttgtttgccatgagaagacctaagtgacaagggagttgctttcttcagagggtgtggggtgtgtggggaggggctggtgtctgttatgaggctgatggaaggtcaactagtggccctttatgtataataaagtttgccttccctttatcttcattctttaaccttctcgcgattaaaacagatagtctgttagaaaaaatactaaaacctgttcagagggggaggacagggtgagaaaccaaaacaactttagtcactttcaaattgaaatgtgcagtgtatttaatcttccttttatctctttggtattttcttcccaagatatatgcatgtgggaaggaacgctgcattcgttggcattcttttctatctgattttcagggtcctgtacagtgttcctcactgtttaatggatgggcataatacttcatatcatacaataaatcatccacctacaaaagagtctgagcagctcctctgcctccagttaatctactggatttggcctttatcaggaattgcatacagttaaaagaaagaagggaaaaaggattttgggagaaagtatcaggtgtttttcaacccagtttttggagcccagcgatgagcagatagctcccttctcttggcagcaggggagtggggcatatttggagtttgtcaagtaggctgtcaggcctgcagtgggaactgagacctttatctcacttagccctgtgccatttggggacttggcagtgaaaacttaccaggcactcatgtttctctctttttgcagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggtactgcctcgatgcctgggtgatctggcacattagcccttttgtatgtgtgtggagatctgggaatgaattgtcagagtcttgctgcctttcttgaggtagacggtccttttctatctgtaatgttcagcaattaacatcgacatgagctacgagggactcctttgttcccattcaaatgctctagtcacagatgatttcatgtgtattgtttcttatcccagccaagcctctggccctgagctagccagcttcctccatggcttcactccagcagtgggctcacgcctgggattttctgggtgttaatggcaggagggcaggagtgttctatgagccctttacaggatttcagaaagcctaacaaagctctttgtttccccctgcttagcaaaagccacagtgttttagctttgagctggtactgttgtctgcttctcatacagatggatacttatgccttggctagtaaagtgcaggaaaggatgttatcactatatgacatttctaggaaatagtgaatagtcactattagggaatagtttgttttctgacttgaaatttgatccgtgggtgttttgttccttggagctttggtcaagagattactgaagactcatcttggaccaacaggtccccttggttggtgaaatggccatccccaaactgacctcctgggagcccttgacctgagaagagtgctgggctgggagtcagaagtcaggaactgtgttgctccatcactgaccagcttggttaatttgtcactttgggtctctgggttttctgtggtttggggttcggttttgagttccctcctacttggcaaggcagttttgaggaccagacaggaaacatttgctgcctttagctattcagcatttagtgagcccttctgtgtctcagggcctggtaaccaacaggtgatcactaaatgctgaataaatgaccaaacaccagcctcttcctcttgctgactgcactgttaggagcccgcaggaggatgcaggtgagtggtgaacctgttatggagtcagccatgatcagctccaagttaagtaaggactaggctgatgcaagcctgtggtcaaatctagtgagaggaggcacagcaatataatcatggtatatttatacttgctctttatacttactcttatagtccatgtgtccccaaaggcacaggaacatttggaggaagtcctgagtccggttagggtcagatgcgccctagagggcatttgacgtgaactttaatgactgggaacttctaggaaggagaatggcattcctggcagatggaatagactcaaaagcattgagtcataaaaaagcttgggggtgtccagggcagggctggtagtcttgtgtggctaatcaaggaacaaggggttggaaaaagatagggctggaaaaggaggctgggcaggccccacggagcttatacttgccatgaaaggattttgtttgattcttacaggttaggggaacctctaaaaattcctctgtgtttagaagctcctcaggctttgaggaggggtctccatacctcaggatcccatgttgagttgatgagtgggatgcagggggatgaggcttctgtagtcaccttagaaagcagcactgactctaagtcttctcttatgcaggggggacaagatatcctgtccatgatgggccagctaatgaagccaaagaagacagaaatcacaggtaggagaaccagtgtgccctgtgagcaaggggcagggcggagggccccacattctgagatgctcttgcggctctgtgagcacagtcgccctgaggaaatgcctcagaacagttctttcttcctcatagcttagagcttgactctagcctaagtttctggcggcatttaggcagccatatagcacactgtgtgctatctgccccactgcagtcacaatttctggcccctatgaggccccagaaatagggatttgtgtcgcccagctctgctggagcacaggctctggagccttggggctgtcagccccctccctagtagagcacagggcagctccacagaccagctccacatactgccctgcccagtttgtgggcacttcccagagctccacaggggacactgctgctgctcccctgtgaacctttatttaacctgctgctcttcccagctttcctgttgctgttttttttctaattccacctacagtttcgtcaccttaagatgttagttaaacattaaagcaaatattgtctttaaagtttaagccagggcagcaatctgagacctttctgttcgagttgtcagaagcagtttctttcttttcacacggttttcggtgtgcatcctctttggacaatccccgcctcttgcctttggtggaagacgctgcctcagatcttccagttttctatttgtgagctgctccctcctgatgataacacaggagctggtttggaaaatgagcactgagaccttagctgggttatgtaacttttgagagactcatccctctaggagctctgagattgggcctttcttcagagcctttcattcctcaaaggtttctgctcaggattctaaaagcacccacttccttagtccaggcacttgattgaaagttaattaacctaagcattgttgtatgggaccaaaagaaagggtcatttactgagtatagaacaggtaaatttgcatgtgaaaactcatttcacccagggctcccaaactccaatgtctcccagatcagacagagctagattgggtatgtgggaagtgataaggcatggtagggagtgtgacagcagtgagcgtgtgctgtgaagggattcccatgcagaacacctgtgcaacctttttacatttaaccaaacccatcttttgggggaggctgccaattttgtgaccttttaggtgtgattatcactgtgttcagatgacgacactgaaacctggagtggggacacaccctgtctgggatcacatagctagtaggaaaactaggctcctagcatgggtttggattgaattcaggtggaggagaaaaggcgatagtctcccccagccctgtgctgaccttgcctgcccatccttgcatctcctagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcaggtaggatggctgcctgccagccacaaggcttttttaacttccatctgggctcatttgttcctcaggatctctccaaaccccatgaggtgggacagggatgaggggaggtcatgttgtttttgagggaaaatgtgccaagtggcttgcctctggcctcatttccctagtcaccaaaggcagcagctgtcctgtcactcatgaggagggtctcccacgtgatcttttgggtgtgatactacaatttggtcgttcaattggagtgtacaaaggtgagatcagacagggctagcctttgatgacattatacacatgaacgtcttcagtcttcatctgcgctctgagaggtaggcattattggcgtcatttttcaaataaggaaactggaatcataacttgtccctcatcgtaaagacaggataagaacccagctccttctgataacaaaaccagcattttctttcttttttttttttgggacagagtctcactgtgtcgcccaggctggagtgcagtggcgcgatctcggctcactgcaagctccacctcccgggttcacaccattctcctgcctcagcctcccgagtagctgggactacagttgcccaccaccacgcctggctaatttttttgtatttttagtagagacagggtttcaccgtgttagccaggatggtcttgatctcctgacctcgtgatctgcccgcctcagcctcccaaagtgctgggattacaggcatgaaccaccacgcccggccccagcattttctttctatcccagacctctgaaccacactggtgtctttccatcctcccgctccactccttcccatccctttggcctgcctttgggaagggcagatgttgacccctggaagacaagtgttcatacggtgctcatcctgccaagattggcccaaagctgggccaggaactttcctgcggttgctttttctcctaagcactctccacgctcgtggtcctggagaacaccccatcttcccatctctcaagcccagtgtcagtattcccagtacctggtagttttattgctcttttggttttctgtgatcttgtttaaacattagtgcctggtctctgcagtgctgggggcacaaaggtgggtgatgaggggcctgttttcaagcctgcaatagagtagtgtggggacaaagtccctgaggctgcatgctcagggcagtggaggcagtgggagttagaaagacaccctgtggcccatgagtatctcaggacacagctggagccaaactgagtttgaaataaaaactgctgatttgcctaactcagctctgaatgatggtgggccctatctaagattttagtttgcttttaatagagaagctttattattaagactgtccaagctgggcacagtggtatgcacctgtagtgtactctctgggaggctgaggcgggaagattgcttgaggctaggagtttaaggttgtagtgtgcaatgattgcacctgtgaatagctatcgcactcccacctggacaacagtgagacctcatctctaaaaataattaaaaaaaaacaaaacatgcaaactctggtgttgctggctctgggtaagccccacaatgggggttctgtagtgctgtgagcactgcagtatagcaacagcccttccccctcaggcggtttctttcacttgcaattaggaatcgaatgcgtgattcaagtccatgtggcagcatcttgtagctactctgaatccccgtccgtgatgctctctagacaagaccactgtcataagtgcttcctaagtcttggagagaaagtgtgtgccagatccagcatggctacttgggcagcttctggagacagatgcatgtgggccttatggctggtatgcctggcatgcctgtggctgtctggacttgcttagccttggctaggccaggctgaagcctgacagtgcagttggtgaaagggctcagccttggacagatggtgccccctgctggggagctctgctaataggcttccctccctccacagtagggaacccagcccagcccatacctgcagagcctggcatctctcgtctcagaagtaaggtctctcagtcccatcccactcaggactaaggtgcacagaaaggtggccttgatctcagaacctgctcagtggagacaaagctctggtcagcctgagacccgggagatttggccccagccccatctgggctgatttgatcaagggctgctagaggttgtggagactccttgctagactgtagttactcaagtggaaggaagacactcagaacatggatttttaggcaggtcggctcaggtaacgcagattcggttgtttgctttggaagagaattttggcactatgttctagtaggaaatttgttgtagtggtgataataatgtcaacatggtaatgaaaaaagtaatagccaacaataatagccatctgatatgcttcccacagactccacccctagaggggaactacagggcttccttaccccccagaaccacatctgatctctagagctccgaaggaaagagagggggaagggaggtgactaactgagggcttcctgtgtgtcagaaactatacagagcactctacatgggccatctcatgtcctcccaggacaccctgacaaccctgtgagcagttgaggttatctccagactcaaatgggaggttacctgcccaggccataggctagaaagtgttgccactggaacctgagcccagaggaacgtctgggtccaaactccatgctctcactgctctcccacaccgcttcccagtggaccctgggctgtgagcggggatggagctttgacggggtgctgcctggaggtggcagtggggaactgttggatgctgacaacagattgccgtgaaaatgcagcctcctaggagtgttctttcccaggtagtgtacgctccctctcggcttcttgccgctcacccctccctgtgtaaatgacccttgtggattgagcctcagaagtgagcccactctctgatggccattgtgttttatggagcatgcatttcagcacaagcctggttcccacatggaaaaattacaggcattggagtcacgtggaagctcatgacccaggcgagttccttgacctctctgaatcttaccatcctcatcaggaaatgggaatatcagcaccttttttgcagaattatgtgaagagtagaaaaagtgagtgcaaagttatcacccaggccagccctagagtattgccctcttggaagctgatttcatgcccctgcctggtctgctctgtgggacatggcttggcctcagggatctctgagaacccagcaaggcatgaagcctcttcatagcccctcctgaccttgacaagcagcccccaagtcctttaggtcacctctccctgtggacagctgatgtgggagccgttctagaagaagcacctgtccctggtcctcttgatgctccaggctccttctgggaagggtccatccatggatgacagggaggcaaagctctgttgccttcttgcctggctcctccctaacttgccaccataagaagtccctttccttccaggctcaggatcctgaactgttagatgagagcccagcactgatcccagcttgaaaactgggagattttctcttcatattgaggtatagctccctgggattaggagttcttgtaggagtttctcactgaaagtcactttgttgcaccaaaacatcaagacttaagaaacagtatggactctgctcagtgtaaccctgtggcagatagtgttccaaaaaaaaaaaaaaccaactttatggagacataattcatataaaatacagtttttttttgtgatttctagtgtattcacagagttgtgcaaccatcaccacggtcaattttagaacattttcatcaccccaaaaagaaactatacccatcaatagtcatcgtccccttctgcacccttacccccatccactggcaaccattaatcaattttgtctctatagatttgctttttctggaaattttgtataaatagcaccatataatctggtcttttgtgactggcttctttcacttagcatgatgctgtagcatgcatagtacttatttctttttccagctgaatagtattctattatatggaatatttaatagtgtatcttatttaaccattcattagttgatggacattgggttgttgggttattatgaataatggtgctctgaacatttgtgtacaactttttttttctttctttctttttctttttcttttttaaagtagagatggggtctcactttgttgaccaggctggtcttgaactcctgggctccaaggatcctcctgcctcagcctcccaaactgctaggattactgtgagctaccacacctggcctatgtacaacatttttaagtggacatggtttttatttctttcggttatgtacctaggagtggaattgctgggtccagtggtaactgtttaacctttcaaggaactgccagctgttttccaaagccagctgcatcatttgacattcctaccagcaatggacgaaggtcccaatttctccacattcttgccaacacttgtctgtctttttgattatagatattctagtgggtaatgaagtaatatctcattgtggttttgatttgcattgccttaacgactaaggatgttgagcgtcttttcatgtgcttattggccatttgtatattgtctttggagaaatgtttattcacatcctttgcccattttttattcaggttctttgtctttctgttgtcgaattgtaagagttctttatatattctggatactagatctttatcatttatatatgatttataaatatcctattctttggattgtcttttcagtttcttgatagtgtcttttgacacacagaagttttaaatttcagtgaagtccaatttatgttttttcttttgttgtttgtgtttctggtttcgtatctaagaacccattgcctaatctaaaatcacaaatgtttatgcttgtgttttctcctaagagttttatagtttcggcttttatatataggtttatgatccatttgtagttaattttcatgtagggcataagtaaggggttggtccaacttcattattttgcatgtgaatatccagttgtcccagaaccatttgttgaaaagactgttctttttttattgaattgttttggcagcctcatcagaaaatcaaatggctgtctttttagcactcttactgtgtgtccactgagccaaggttaagtggatattaggtgagttacccatcacattacccagagaggtgtttttactgtgctttctgtcagcagaaaagctttgtgttatccgtgtccctgtagttacaggattacataaagcagcatttatgtagtgattcttaaccaggggcaaatttgttccgctggggacatgtagcaatgtctggagacatttttacttaacatgactcagaagtgctgctggcatctagtgggtagaggccaaggatgctgctgaacatcctggagtgcataggacagcccttcaaaaagagttaatttggtccaaaacatccacagtgtcacagttattgtaagaggaaagtagtcacaaatgagtcagccatgttgcacatgtggtggtatatctataggatacttttccagaagtatatttgtcttgcttttatagatacgctgtattggattccaaggagatttgggtctgtggcttcatagctccaaactgtctatctggaggaagctcactaatggccgagtttggacaattgctgaatggtaaaatgttaaaattaatagtagactgaggccaaagccagaaatgaacttctaagatgcaagaataaatctgcagattgaccaaaatgtaattattatccagcttcttattagcagttttataacattaccattatggctgccttgttaaactgtgatcctccccaccccccgttcccccagctcctgctgaggtcagcacatggcctagcaccgctgctggcacatgagggctccactcagccagcccactcagcagcatcactgactagaaccgtctcccactaatatggtttctagaagaaactttctacttcagattcatagcttggacaaatctcagaaatgtttggtctttaattcctgaaaaatgcttagcagtcctcagcagccttttcttttgtttttctcctcaaattcctttttaccacttggtagccttttaatagactttaaaaactataagaaatgttattaatgcatttctataaattctgttcttgtgaagtttgatttgggagtactttatttttctctaaccttttcttctttaaactttttatgtttgttgtgatttatcatgggtggtgtagaattttggatatttttgtccttgggatattttaatgtggcaaaattgagatcttaggatttcctcaaaattaccaaaagaattctcaaataagacttaaaaaacacttatggcctaaatagaattaaaaaactaaaaattaaatgtagttttaaaaggttattttgcttaatgtgaaggttccaggcacaccaaatactgagatttgaatcatgatagaatttcatctttataattcttcttaattttaaaaagacattcgttgctggaaaaagataagttttctctaaagttaacttaatacttgtatttcctattagtttgtttccatatttactttgaagattttaatttttttttgttttgagacggagtctcactctgtcacccaggctggagtgcagtgacacgatctcggtacactgcaagctccgcctcccgggttcacgccattctcctgcctcagcctcccaagtagctgggactacaggcgcccgccaccacgcccggctaattttttgtatttttagtagagacggggtttcaccgtggtctcaatctcctgacctcgtgatctgcccgccttggcctcccaaagtgctgggattacaggcgtgagccactgcgcccggctgattttaatttttttacattagatttaacaattcattaatgtagcattttattctctttttgaattgtttttattgtggtaaaatgtgtgtaacataaaatttgccattttaaccatttttaagcatacaattcattggcattaatgacattcacagggtggcatgaccatcgccactatttctaaaaccatcaccactatttccaaaactttttcatcacctcaaaaacagaaactctgtaaccattaagcatgaagtcccaacccttcctcccctcagatcctggtaacgtctcatttatttctgtgttttttttttttttttttttgagatagggtctcactctgtcacccaggctggagtgcagtggcatagtcttggctcactgcaacctcttcctcctgggctcaagcgattctcatgccttagcttccggagtagctgggattacaggcatacaccaccaggcctggctaatttctgtctctatgaatttgcctactatagatatttcctataaagaaaccagaaaatatttgttcttttgtcggtgacttatttcactttgcatgttttcagggttcatcctgtgctagcatgtattttgtttgcattttatttttgcagtcataaatatgcatttttatacctcaactggatagaatttaaacaggtagattttatttttactaaagttaaatttttagcatgcttacttgtttttgaaaccaaatattcagatactaacaaatccagttgacatgactaattctttgttatattgattacttataaccatagactgtacaatcctgcacaagtttaagaatgccagaagtgtagcctttctgctgttaggacccccagaggccaaggcagaagcctacagcacttgggccctccaaacactagctgaaggctggccccatgtgccaccagtggctgcgcagggcacctcagggtctggtgggttggcaaggttcctccctggggtgttattcctatggcttggctaagggttcaagagaaaaataggcaaaagatgggattggacccttctcaaaaagaagtaaaataatatatataagggaatacattcaaatgcctcattagtaatcaaagaaatgcaaacttaaggtgttacctttccctctttttctaaactgttgaaatagcaaaatatttcagaatgagaatactcggtagtgctatgatcctgtgagattagataactcatgtgtagctgtataaattaggatagttattcattcaagtagctattcagggttctgtcaagcactacaacagttgctaaggaaatgcttatggctgtatgcatcaaattatcaaaatatcaataaaaataatagcaacaattggaaactacctaaatgctcaacaatttgggttaagtaaaatatttaatggattgttaagtaaatattaaacataattattaagactgttgcaagccaggtgcagtagctcacgcctgtactccaagctactcgggaggctgaggtgggaggagcccttgagcccaggagtccagggctgcagtgagctagaatcatgccactgcactccagcctgggccacagaacaagacccagtctcaaaaacaaaacaaaacaaggagactgaagcaacatgaaaaaaaacaaaaaaaacttgcatacttagtataatttgtaaaattatactatagagtataattagtatacactatatattatactatagggcataattagtatatactatatattatactatagagtataattagtatatactataatatagtatatactatatattatactatataatttgtttatatatgaatgtttggcaaatatctagatgattatttttgagtatgattttagttatttttttcctccttcccagttttgctatgatattgatgattaccaagataaataagttggtttttttttttttttctttttggaacagagtctcactctgtcacccagggtggagtgcagtggtacactctcagctcactgcaacatctgcctcacgagttcaggtgattctcatgcctcagcctcctgagtagctgggattacaggtgtgcaccaccatgcccagctaatttttgtatttttagtagagacggggtttcaacatgttggccagccgttcttgaactcctgacctcaggtgatctttgggaggcctctgcctcccaaagtgttgggatttacaggtgtgagccactgcgcctagcctgaagttgtttttatgccactggaggttagtctgtttactctggtcctggctctgattcttaggctgcctagccagctgcttgtggtgtgagtgttggatctgtatttccagtgtcgtttcttgtctaacagaggcttaggtgatgggattaattttgccccttacagaggcactgaggacatcacatcccctcacggcatccctcttgaccttctggaccgagtgatgataatccggaccatgctgtatactccacaggaaatgaaacaggtgagcctcccttcttccctcctgctctcttctctcatttgctcccagtgttcactggtggctgtgcagaaaggtatctgcggcttggatctggctgccattcaccatctcaccacttagctactggcctcgagcaagtcacattactccagagtctcagtctccccatctgaaagatggattggtctaactagacattgccccaagtgtcaacagaagctcagctccctgtcttggctgttcgcttttctgctgttccccctttgataagctttaggaaaaggatagtgaaaaaatcaacatgatgatagccattagggaggctaccagctctataaaaaggaagcaataaaatatgatttagtgatagccttttggtgaccaggccagaatatgcctgtggccttttctactcagaggacaaggccaggctcgctgttccacctgaaccaacagcaagccagctccagcagggtacagaatgtagccaccctgacctggaagaggccagtgcttgtgtcctagcagagcctgtctgctgtaaacagcatgacaagtttctcggcagctttggaggccgcccctgggcaggtctgtggctttgcaatagagtccttgagggcttctgccaagtccacagaggtgatggcgagacagcatcatacagcttagaagagcacctgaaggagggagtttgtgaaactgatcatataataagaggcttcattggaggacccttggaagcatctagctcagtggctggcacactgtgcatgccctgaagtctgcgtgagctgaatctgggttaggctgagttgggagacgacagggatgtatgagcgtgggctttatccaaagggccacagtcccagttgtccctgtaggaattgcctcttgcttggtttggagctagagcacaactatgtgccaagcataggaataccattggactaggaatttctagtcaccttcatggtatttccaggtattccatgtgatcaccatctattttattttttacatttgagtcatggagctgtaagtgcaggatgcaaagccaggcagtgccctgtagagcccaggccatcttcagtggtacataccctgaattggtgtctccgaggcagcatgtgctgtgctctttcctctgccctgcccacctttgccccaaatgttctcttctgatgggctctggcatgcagccatggttggagatgctgagcagactggggctgcagtgacgtctcgatgcgctttgcctggaccttgtcttttcaccagagcatggcatctttgttgagcatcgtgttgagcaggacatgcctggccagtttgattccatttgatccccagtaacccatgaggcagggagaactactgtcattgccattttaaaagatgaggacattgcccaggcatggtgactcacacctgtaatcccagtactttgggaggctgaggctggagggtcacttgagctcaggagtttgagaccagcctgggccacatagtgacacccctactcaccaaaacatcaaaaagttagccaggtgtggtggtgtgtgcctgtagtcccagctacttgggaggctgaggtgagaggatcgctttagcccaggaggtcgaggctgcagtgagctgtgatggtgccactgcactccagcagagtgagaccctgtctcaaaaaaagacagatgaggacactgcgacctagggtaactaattcgcccaagttcataacattagtcagtggctagcaggtaatgggactggctgtaatccaggctttctgattccggaaacccgtgttcttaatcactgtgccacccagcttccctcctgctagaaatctctcatctcattgtcattaggattcatgaggtggctttcctctggcagtttgtgagcaggacctttcccttggagcagtcagggcctctcctgggcctttcctggcacttctgctgctctcctgtggctggaggcccagcctgggcctgccagcatctcttaccgcatgcaggagtgctgtggggatgcatcaggagagtcacagatctccctttgtaaccagcattggcaaattactgaagcagttatggttcatagtagcaattgtatatgttacctaggagatggtgtcaatggccgggggcctcatcgccacgtaagggtgtcttgtcaggtgacttgcaagggtgactgccaggttgaagccaaggcattcactgaacggaggcagaagcagaaacagtcccaggcaattcttggaaaactggcccattcttactgcgggacatagcaccttactgttgggtccaaaaccccatgtgtcctgccaaaaaaggcagcccagcacagatgtgttcagggccagagacaccatttgcctactgaatgacttgagcaatttggtgcatctcaccgagccttcaccttctctgttaaatggaacatctcctccctcctttgcaagattgtcattaggatttgtgaggtattggcaataacgggccctcccatccttcccattgctgttgttattactgtattcatagctttgtgtgcttcataggtaccctctagggtcctctacgtacaacatacaacagcttcgcaatagccagcgttggaggctccaagaacgagggtcctgtggctatgtggagagtaagcagcagagccaggactgccactcagagctagttcacccttgctgccgccattcgaacccagagctcctggcccaaacagtctggaatgttctgtactgtgcttctaggacagtgacttgccaggccaactctgggctggggctgtcttggctctgtcaggagggcctctcctcaggctttctctcaggactcgtggctttgttcccgctggcccaggtgataacctcagcatttttactggagcctggggctaggtttttaaacaaactcaatgtaacttgtgtactctgcaatccaagccgacaccctcataaactatccctgcaggttattaaatgattaaagatctcatttatgaactgtccattttcgagcagcctgagacagacgctttcacgattgctctgacctgctgctctctctagtgagagagagagagcagagtgtccctgacattctggaagctgagccacagattcagtgcatctcactgaaggcgaggcacttagcttaagctgtctcctatgaccaggctccaggattcaatatttacatctccctggagtttcagaaggtcatctggggacatttttcttggcaagacctggtggtttcctcagtcccagctgtgagtgagaagccgtttttaccttgaagctgtgttcaggggggagttctgttgtgagtccctcccagctccttttcttggttgtccttgtaccatccagtaacttcagagggcccctttttgcccagctgcatttagctttggatttcagacagtgaagcccctcctgcataagctaagattgtttcagtggagctcacaccctggcagttcacccatgagcccagcagatacgtttcatgtggcctatgcagtgtttgtgaaatgtttgaacaagttgctgacatctagacatcaggacatttctttctttctttctttttttgagatggagtttctctcttgttgcccaggctggagtgcaacggcccaatctcagctcactgcaacctccgcctcccgggttcaagcaattctcctgcctcagcctcctgagtagctgggattacaggcatgtgccaccacacccacctaatttttgtctttttagtagagatggggtttcgccatgttggtcaggctggtcttaaactccagacctcaggtgatccacctgcctcggcctcccaaagtgctgggattacaggcgtgagccattgtgtcctgccaaaatcaggacgtttcgtacaaggatctgagttctgagcctgtcttgagaaaagggaagactgcagacaacaccttgcagcagtggtggccgcgggtggaggggctgcctccccagggtgtttgctggccaagcatttcaccctcacctggctcatcgcagccgctctgtcctgctggggctttccaaggcctttcccatctgtgggcagccaatgtgctgtcccccaagcccaaccgcgatcatcagagactgggctccccctgcagctcctgcccgcagggtcccagcctggagagctgacaggcgaggcttgatgtggccacctcagtaaacctctggctctcctccctcctggaaggctgaagctgggactcagtctttcccagctcctgtgcctctacactgggtgtgcttttatggctttaatttcaacaagggcttcttgatatcttgtttacgaagctgccaaagtgaaaaattcctgtattatatgcggctcgaagtcctgcagttatctcagctccacaacacacaacatcattatcctggctgccccttatcactcagtgctggtacgcctgcaggatcctggtccaccgtgttacagcatccccgccgccagcctgcctcccctccaactctaccaagatcttcaaactgcaacaagcgtcagcctcttcttgatagattagatatctcccggtgatgttatgaggcctggtaaatctttaaaagtaacttttttgatttatttaaccatcatatttatcaagcaaataaaaaatgtcccttcttgcctgagtgcttgtaggcagtagtgcccatgctggagaggaaggttagagcccttgcaggagccccgggtaggttagaagaggccccagttctctgcctggggacaggggacgggaggacatggaggcaagagtgagccacttgggaagctgcatacctccttgggcaccagccacacttgagtcagttgaatacagcacactggccgtgatgctattcatgcatactgcagggccgcacatgcctcctggagggtgccgggccggcagtgctgggcaggcgttggctccctgcccaccaacccaggtctcagtttctcttatgctgcacagtgagaaatctgagcaacattgtctttaaagcactttagaaatggggcacttgaggtcagtcaccgttgatcatgttttttatcctttaaaagatcattaaaatccgtgcccagacggaaggaatcaacatcagtgaggaggcactgaaccacctgggggagattggcaccaagaccacactgaggtgagctggtaccctgggcccgccggggcctccccagcacagccagggccctcgctggggtcattctggacaataaaggcaggtcccttcctagggcatgggactctatccatccgctcttcctggcacgatgggtgccagggcacttgagtttcaaatgcagaggatctatctgatggtttttaacaagctagagtaagggtgaagtccccatgtcctgcagcagatgctcccctctggtggagagtgctttgaccctgggccttcttgtggcagagaagatgcacagaactagagagcagggaccatgtggtagctcattagccagggccctggctcctgttctcccggtggtgttatgaggcctggtaaatctttaacttttttgatttatttaaccatcaagcaaataaaaaatgtctgggtggtggatatggagagccagggaggagcgcagacatagacagttctcctaattgttctccagcggctcaaacacaggaccggcagagcatgtcccttcacagtggcctgactcattgtaaaatcattgcttcacagtcctcagcccttccctacatcccttgagtcagttcttgctcctgaggttgaaggcagaaatgcaagctgtgaggtttggatgaaggggtactttttaaaacggcagagtcttcatgcctttggatgggcatgtacttccagctggctatgttttcatttccctgccatgttaaatatccctatctgtcggacacctgtatacatataagtttgcagtccttttccagtagcagtgacattacttcctactggaggatttgtagactgtactaaagatttggggaatagcacttatgtcttcttggtggctcctggaccctctctgatgggataatgactgcagctctctgagaagtgacaactttgtctccccttttctgtgttcgtagcagctggcacaagcccagcactgggctctgctcctggtgccagtgctgcctactgatgtggggggaaggtgctttcttcggtggccccagtttcactccagccctggcccctgtccactctaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagcaagagactccccaggtgtgcctggcctgggtccagcctgtgggcgcttgcccctgggcttggggctgccgtccccactcaggcgtgggctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagttttagatgtacagagtcattgtgaacatacaatagggagttcccatgtatcttgtacccagtttcccttcttgttaacgtgttacatcagatagcacatttgtcaccgtgaatgaccaatactgatgcattattatactgcgttcacattttctcagttttacctaatgtcctttttctgtcccaggatcccatccaggataacccattacaactagttgtcatgtctccttagatgcctcttggctgtgacatcttcttagattttccttgttcttgatgaccctgacagttttgaggaggactgatcaggtatctgtagaacatccctcagttggggtttgtctgatgcttttctcatgagtagactgggattgtgggttatggagaggaagactagaggtgaaatgtggttctgatcacatcgtatcatgtgtggttctcatcacatgctagcaacatgactcatcgttgatggtgagcttgaccctttggctgaggtcatgtttgtcgggtcttctcactgtaaagttactctctgctgcctttccatactgaattctttggaaggaagtcactatatgcagcccacacttaagtggcaggggttatgctcacctctagagaactgagtatttaccaaaattatttgggattctgcatggaagattgtatcagaatggacttacggaagttcattgtatactttagtagatttattttgttgctcaaattgagccagctttggccagtgagagctcttgtcagttggctcgtgtgtccctatctctgaagtgtccctctgaagtgtccctatctctctggccgaatctctgcgttcgcccactaagtaagcagcaagggcaagtgcagcactgggcagtgcaccttactggaatgtgccttcccagtaggatgagagctgcgttcttgcccttgccaggcctgtccttccctgctggctccgtggtgcctgaggtggggctaagtacccggacgctgttcccagcacttgctccttgtgctagttcagactggatctccgtgctgtaatgatatgggaggcagggctgactaggatggtcatcttggtccagtgctttagttcagactaactatgagctccttgtggggcaagcagcattgtccttccattagggacagtcccctgtagtcatgtcaaggggacagtgggagggggcggagatgatgctggggattccatctagcctgagaggccccagccgtccctgctgccagagtgaatcttctccctcggcctggcccctgaggagacactggcatgcacagcagtggtggtgggacccttcatgaagtcagctgtgcatgtggcccatgccggctgccagtgtcctctgaggctgcgcttgtctttagcctccccactcgagccatgttagacaaacagaagagagatgcagcaagagcttattgcaccagggactgtgttcacactctgcgttccatgttgccttcacagtagcctgtgagactgggataggtgtgctagcccacttccaagaccacttccacagaggaggcaagtcccttggccagctagtgagagatggaaccaggatttgaaatcaggctgcttggaacctgtgttcctaactcctgggggccatactgcctccttctgtgttggcatttagcagcagctaggagctgtcaagatctgacctttgtaccagccaggtgaaggaagcggggtccggtgtggggaaggtgacccacctagaggaccagaaccaggcctctgccctggctgggcctctcacttgggctccaagcctttcatgctgtttaaggagcaagatggaagtggcgctgacagcagatctcacagccgcgggtggggacagagtcttcttcggctgcccaaggtaccaacatccagatcagccaggtgaggaggggaccgtggtcttgctcttcctaggccacagacccctggttcctgcccctcaaatatcctagctgaggtg

SEQ ID NO: 16521 - DNA, 29720 bp, Human
actgtctgaatttcctgaatttgaatgttgacctgtcttgctaggttggggatgttctcctggatgatatcctgaagtgtgttttttgacttggctccattctccacatctctttcaggtacttcaatcagtcataggtttggtctttttacatagtcccatagttctggaaggtattgttcattgctttttatttttttctgtaatcttttctacctgccttattttagcaagatagtcttcaagctctgatactctttcttctgcctggttgatttggctattgatacttgtgtttgaatcatgaagctctcacgctgtgtttctcagctccatcatgtcatttgtattcctctctaaactggttattctaattaacagttcctgtaatcttttatcacggttcttagcttctttgccttgggttagaatataatcctttagctcagcaaagtttgtcattacacactttctgatacctacttctgtcagttcatccatctcagcttcagccctgttttgtgcccttgctggagaagtgttgaaatcatttgaggagaaaaggcattccagcttttggaattttcagcggttttgcgttggtttttcgtcatctttgtggatttatctacctttaatctttaaagctgttgacctttggatgggatttttgtagggtcttttttgttgatgctgtgttattgttgttttatttttttttgtttttcttccaacattcaggcccttcctctgcaggtctgctgcagtgtgctgaggatctactccagacactgttcacctatgtatcaccaatggaggctgcagaacagcaaagagtgctgcctcctccttcctccggaagcttcttcccagaggatcactgacctgacgcctgttggaactctcctgtatgaggtgtctggcaacccctgttgaatggtctaacccagtcaggaggcccaggatcaggaactcacttaaggaaagagtctggctatcccttagcagagatggtgcactgggctgggggaatcccccttgtctggatcgctgatactcttcagagccagcaggcaggaaagattaagttggctgaacctgagaccgcagctgcccctctccgcaggtgctctgtaccagggaaatgagagctctgtctgtaaactctaggtggagttgctgaaattcctgcaagcatttcttgccgggagaggagggatggatcccggtcccacctaaagaagcagtctggccatgatctgccacagcggctgtgctgcactgtgaagactgctgcccagtccaatctgcccagcctccctagcactggtagggaaaaaccgctgactagagctgcagtaatggcagtcgcccctcccctggggaactcggtcatctctggcgtactccaggctgctatgctggctagtggggattctaatccagcggatctaagcttgcaggcttctgtgagaatggacctgctgcaaggccattttgctccctggcttcagccccctttccatgggagtggacgggactcctgcctcactagagttccgggagctgctggactatgtaaaaactcctgcagctcagtgcctgcccaaaaagctggaaatatgaactattgggttaattcttatcaggaaatgaaaaagagttgttagattaaacttcttcagtcattgtcgttctttgtaatcagagaaagaaaaactgagagatcaggaagagaagagacagatggatagaagaagtttgggtggccacaggaaacaagaaaagaaacaagctgaggtgtcaacccacaggataatattttgtcattttcatttttttcccccaagtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcaggtgagtccttttctgactaggagcttgggagtaggaacttagaaaacacttgatttattgctctgaaataaacacaagaaaggaagtgagccgatagcacacatgttgaattccttttcttactgattgtgtgtagtttgaatcatgggacctggtgttagagatattgacggaggtcatatgttttccagatgtctttgagccagaaagaagttaattcctttctttcagcttctggtaatcaaagggagggtaaagaaagccagaggaagttatttgtgtgagacaattctagaagtttcgaaatgcactctgaaatctttcttttgattccaaattaattgcccagatcacaaacctttttcgcagaatcagatctgagagcctctgaattgttatcttcttcgacatctcttattgtgaattacattcttggtctgtttaaagtgattcaattttttcctctttctcgttggtcctgatactgactactttaatataatatttcatgggttaatatcacagttgttttgttttgccgttgttattgtttttaactggtatccttccctccaggacttaactctccaatccattctgcacacaacttttaggtcacctgtcttatacacagaagctgaaaaagcctaagggatagagttacttaggcagctagtattccagcaggtcataacgcttctttggcttcattctcctcacaggaaaaggaagaaattggactagatcagtgaattctaaaccttataacatatcgcagcaatctgtagtcatataaaaaaagtcagatgactacccccttcctcaccgcgaatagctcaatcttaaataccctgcaggcatttattacctttgaagatcgtcacataattcttatgaaactgacttgacataggtttgttctattaggaaagttgaccagttagttaacactctctgcttatctgctagtgatctattaatgtaattaactttgctcagggacatacagtggctccctattgccttttctcttttttactatctgaactttcagacaattttttctaccttttgaaacatgtgtatccagtttttccattaatctttgtaaagcatgatttcaacttcataaaaaaatactgtatttacttcactcatattaccttgttgttgtttctttactcctttgattctccctatagaacaattctctccggggtttatgtctaacttcacaacatttaacttaagctctggaatcaagggatcattagataaagatagggtaaattgaaagccactagtcaaaaacaagtcgtggtttgataattataaacaaccaaatgtagacagctattattaccttaaactcttgaggaattgtatcctgtaatgtgtttaagcattacatcactttgcctggaaccaaaactgtggtcctgataagttttttcctctaattgattcctgccatttttattatcactgcagctttcattcagtgattattataataacaaaaaataatctatagtaaccatttctttaaaaaatacttaccatatgatagctaattcatgcactctctctgatttaatatttaacatcaatcaatacagttgtgctattatttccatattgtagttgaaggggatacttagagaatgcctccaaaatatgctttaggtcaaaagtctgttgagaggagtggtctcaggttggcatgactctcaaactctgccattaatctaactttctgcaaacatcttcaaatacttgccctgtctctgatcactgccacttcagtcctggcctcacatttctattccttctaaagcccagctctcccagttttctggttacacgagacaccctcaagcctttgtgcttttttccttactgctctctgccaaaagaccagctcctagttttccaggggacaaattcctaccagtccttcaggtctcagtgccaagccctcccttctctggacagctgtacctgagacacactttgcttatgcttttcttgagcttctgctaattatttacattcttataatatttttcattttacttatttgcatatgtatttttccacttgactgcaaacttcaaagtgtacagacatgctgccaaagtggtacccccaataacagcagagtaagtttcaagaatttatgctcattaaatatacctgaatggataggggaatgaacatgccttccttctgttgaaatatccaacatgcaactatcatctattaaatgaaatcaaacttacctggtttgctattaagaatttgtaatcaccaggtgggttcaccttgcccactgcttagacagagccaatttatcaagacaggggaattgcaatggcgtaagagtaattcacgcagatccggctgttctggagagggtagtgttattattacttaaatcagtctccccgagcattcagaaataagaacgtttaaagataatttggcagctaggggcttgggaagtaggaagtgctgattactcaggtgggagatggaatcatagggtgtcaaagtgaggttttcttgctgtgttctcttcctgggtgtgatggcagaactggttgggttagattactggtttgggtggtgtcagctgatccattgagtgcagcgtctgaaaaatatcttaagtgctgatattagattttataaagtgatattatccctgggagcacaatggggacattccaattctaggagccagaggctgcatgtcccttacattgtaatttttagtcttgtagctaatttgttagtcctgcaaagggagactggaccccaggcaagaagagggtcttttcgagaaaaggctgttaccggttttgtttcagtcaaaccatgaactgaattccttcccaaagtcagttcggcctatgcccaggaatgaataagaacagcttaagggatagaagcaagatagagttggttaggtcttatttctttcactgtcgtaattacctcagttataatattgcaaaggcagtttcaatccctctgtttgggttttctaatagcttaatcttaaggtgtaggctatgaagatgggaaaaggctgtcgatcactctggcttcttcctgctgacaggagacatagtggaaattagagtgaaccccaaggtgagaagaatgtaaccactttgcaactgtctgagcatactcatgcaggactggctgggcttccaatgcttgcaatgcaaaaacattagtactctcctctgtagttttgctataatatttaagccaacagcctcctgtaaggtaaataacaaatcctaggatgaggagtacaattctcaattttaaaagcaaagattggaaagcattaatttggggacttctaatccacaaagaatttaggatttagtccaaactgtaggaaaaaactcaaacaaaactaacaatgggtatattatatgttttcttttgaagcataatttttctctccagaccctatttttattaaaagtaaattataatagaactaatctgtttaccaaaataagctttagtcttactgtacttggcctgattatttgcatgaagtgcaacaagaataattattttttatttaggctgttttttgtttaaattggctttgatggaactctgttccatgaggaatctcagataagactttttaagagccaatcccagccatgcatttgtacccttaaatacctatgagttgggtaaattcctctcctctcaaggtcccaagataacttggagctcatgaacctgttagaaagtgatattctttacttactacagatcaagaaccttgtacaaggactctgtgtagacaaggtatgaagccagattccccaaggggcttttattggctctgtaagtcaacttcgattctttaagggaagagtgccattccagtcaaagccttggtaaaataaccaatttctccaattgtgtcatgttacaaaagaaaacagatttttattgtgcttatggaattaaccatgctgccataaattgagaatacttacaaagagtttccaaattctggagaaatcaggtagagagaaacaaatatgcttcaaaattttttcacaggagtgtattttacctacttgttaaaagttgcaaatatctctaaagaaataagttatcttgactgtgaaaactgaaggattggtgacatttaagacatcagctcttcatgagagtcctggaagttttgtttttttcctctattccaatagcacaatttttaaagttatctgagacctgcactcagagtcctatacctgattataaactgccttttgaaaacgaccaaagcaagacaaaatgtctgtggatgacaaaagtctatagacactattaaagctataattgactaggaattttgcttacttctgtggcatccaacaattttgtataacaattataattactaataatgtacagtaaattttatcagaattatagaagtttatataaatacacagacagacagaaaattcagcacttgtaagattttttatttgccagttgttaactggactactggcttcagagtggagcccttggaggaacagggccaggaaagcatgcattttttttccaagctaaataagcaggcacagctgaaggcaaagacagatctccaaaatgaaggatgccattttatactggatcccagatccccaaaaggaaggaaatactactggagaagagagtgcagtgcttctaacctgcattttattgcaaggcaacctaaagccaatcaacccattttgaaatcagcccatcccccatggaagtctcatctctcagtcaggcatggggatgtttccgtatcttccaggtggcccagagcatgcttctctgacccaagtgtgcgaagagccaagtttccctctgaaaatactattagccatcccttaaagtatatttcctacctagttattacataccaaagctatctcataatgcaaagtaatttctgatatccccaaaattcaaactgtcagataacacaatgcaaaacagaacagagcctttgattttgagagtgatccatctacttttaattccttggttgtcatgaagaaaacagagggttttttgtttgtttcttgttgtttgtttttcccaaaatggggtctgtggtgcttcctctgtttttctcaaggagtctcaggctaccaaaagttatcttagtgcctcttatgtgtgcattaagagtggcaagacaaaaaatggagaaaaataattcagtttactaagaagaaaaaaccctcttttacagaaaaacgagatccaagaagagaaaaacataaaggtcttttaaatgtatccataacttgtttattcacttttaattaagctgacttttaaccttagtgctcttaacaaaatccttttaaatttcgtattacccaactttagccatgcggccaacatttctggcttttgaactttatcaaaagtaacttcccaggtgtttcaaaggtgtggtaagcagtttctttttacaagatttagaatttccccaaggtagtccagagaaaggaaaattcaagagaggaaatcagaagctatccatggggttgtgggggaacctcattaaatggcaaagttatgcaaatagcaaaccagaaggaaattgttccagaagccaagaatagagcctgagcctctatgtcaaaaggcaaagtcttagctactgaattacagcattgagcagtttctattgctattccaagaaggagactagagaagccacttttaaccttgccaaggcttttaactgctcaagaaaaatttttagggctggatggtataaaccaaaaggaagtatccacatatggtcacaagattaagctcttaaggaggccaaacaagacagagaaatttcatacagtattggtttcagggacccattataattggccagcctgctgagctggcttgaaaagcaggcttataggggtcctaaacccatgttctatcttgtgatacccctctttccattacagaacactgaaagacaaattcttagcaaaaatacaccagatttgctataggctaagactagtcttgtaaattcttttttctattaatcaaaactttacagagaaacatatagtgatgtttactgtttacacagatggagaaagagagagagaccagaaacctagctggtaagaatttcttacactttttgctggcataccagatttctgggtgccttttctctgtaacttccagaagaacggaacggcttctgatcagcctgctcacctcaccatagttgtggggttcaagccactttacaagaaaaaagtcaccattttctgttttatggaaacataggcaagattcttaaaatgcaagatgctgcccaaccagctgcatggggaaccatttaacattttctatcccagcagaattcacataacaaaacagacactagtcacctcgttcagcacccaatatcaacctggcaaagctcagacttttttctgttcgtccctgttgtctttgatccactccaggtggggagggacgacctcagaacagtaattcacaatggggtctctgggtaaggcaaagagcagatagtcaccatgagacaggcctattgaactttctccagggctcatcgaatgtaaccaaataagaagagtcctctgagttaggcctgctggacttccttcagcaattccttctgagattccctccacatatacaaacacacacgaagatgagacagacagaaggccttccaaatcagatgatccctaaacaggaactccaagagtatcccttccaaactatcctcctattctctgtctgagaaatctcaaaattgtcctgattgaggacaagtctcctgaaccaagactcttcctactagttagagccaaccaagaccccagtggagccgaacagataccccgtggtggagctacaaacagacaccctgcaatggggctacagacaccctgcaatggggctacagacaccccatcatagagctacagacaagtcgagagaaggaaggaggcattagcagtgcctagtagattcaccaatcctaacaccctgcaatggggctacagacagacaccccactatggggccacagaaccagtcaggagaaggaaggaggcattggcagcacctaggatactcaccaatccagacacccttcaatgcagctacagacggaaaccctgtgatagggccacagttagaggacatctctccaggattatttctccgttgcaattaaatgcatgcacattgggttggcagtgcctgccagtggagagagtaccagagccagcccccagtccaagagaactaggcggctacttgggctagcttctggatccatcgctggagcgggggcaccaaaccacaagcaggtagccacaaaggctttcccagtctgatttcgttcattgttgtaatttcctcagttataattttgcaaaggtggtttcatattccttaagagttgagccacacataagttttattcatttgttcctacatggacttgactactgattcagtaaataattagtaaatattcagtaaataactagtaaaaagaatgccaaaaatagtgcagatgtagttcatggcccctgtcctcacagagcataaattctaacagtggatagagataagtaggctgggaatcacaattaaatggaaaaataaaaaaaaaggctggatgtggtggctcaggcctgtaatccaatagcagcaatttgggagaccaagatgggtggatcacctgaggtcaggagttcgagatcagcctggccaacatggtgaatccccatctctactaaaaatacaaaaattagccaggcgtggttgtgtgcacctgtagtcctagctactcagaaggctgaggcaggagaatcgcttgaatccgggaggcagagattgcagtgagccaagatagcaccactgcacttcagcctgggtgacagagtgagactctgtctcacaaaaatatataaatacataaataaataaatggaaaaaaaatgctactctaaggagatacaaggtgccctaggagcatatatctctgatgctgtctcctctggaagaatcagagaggattcccttaagaaaataccatctaatctgatacttgaaggatagacagatagacagatagacagagaacagttcaaaaaccagaagaaattagaagcgggggtgctgaaactatacagatccctaagtagagacttgattccctgagaaaggtgccatctaatctgagacttgaaggttagacagacagcagtaggaaaacaagaatgaatgagaaggtaggggctggaaatacagagacccctaaatagaatctttctagaaattaaatgaaggcagaacgttttgaatgtaatgagcaaggtgggaacagtatcagaaaatgagtgaatgagaaggcctagattagaataggctgaaagttttcatggtcaaatctagatattggaacactcttcgttgcaaagagtagaatagagggacggagagtagattgataaagttcttatgaatttatttcttaagaaagaaaggatgttggcccgaatagaagtaatgaacaattagaattgagagaagtggtcagattctgaaaatgtttagcaaataaaatcgatgcaatgtgaattaagaagggaaataagacatagagaaggccaaagaggttgaatatcaccaggtattgctgctcttttgtacttggagtataggtattatttactagtatatggaaaagagaatgaaggatggaaatgaaaaaatgaacagttcatctttgtaagttgagttaaatgaggttgtgagatgtagttgagatatctcattgtctattgaatgtataggtttcaataccgacatccacatctgggctgaatccataaatttgagaatgatttatttattcttttaagcatataatggatgccatcagaatgtgtagattatacctcaggccatacttttaatttacttatttatttatttgacaaataaacattgtacatattttctatgtacaaccttctgcttttatgagtttaacctgtttagagtctatgtataagtgagataatgtgatattttgtgttttggtgcctggcctggcttattttacttaatataatgttcttcatgttcatcaatattgtcagaaacgataggatttacttccatttaaaagctgaatagtgttgcattttgtatataatccacattttcttcatctattaatctgtccacagacatttaggttgattttatatcttggctattgtgaataatgctgcaatggaaatagaagttcagatatctcctcgagacactgattttccaatttttgatatatacttaatagtgggattgcttgatcatatctttagctctatttttaactttcagaggtgtctccatataggtttccataaagaccatgctaatttactctttttttttttttttttttttttttttgagacagagtctcactctgttgcctaggctggagggcagtcatggaatctaggctcactgcaacctccgcctttagggttccagcaattctactgcctctgcctcatgagtagctaagattacaggcgcccaccaccacgctcgggtaatttttgtatttttactaaaagcagggttttaccatgttgtccagcctggtctagaactactgacctcaggtgatctgcccgccttaacctcacaaagtgctgggattacagtcgtgagccactgcgcagggcctaatttacgttttaccaacagtgtacaagagtttctttttttctacatcctctccaccatttgttatcttttgtctttttggtaatagccattccaacaggtgcaaagtgatatttcattgtgacttcaatttccctggtggctagagaggttgatcatttttcatatacatattctctgtatgtcttcttttgaaaagtgtttattctggtcctttgcttatttctaaatcagtttattttctttctattgaattgtttgtgttctttgtattttgcatattaattctttatcagatgtatggtttgcaaatcttctctaccatactgttgattatctctttaatcttttgattgtttctttgactgtgtaaaagctttttagtttgatgtaatttcatttgcatattttagcttttgtttcctgtccttttctgtcatatccaaaaatcactgtctagaccaatgttatgaagctgttcccctctgttttcttctagtagtttcacagttttggttcttacatttacatatttaactcattttgagtttatttttgtatatgtttagagatttttattcttctgcatgtggttttacaattttcccaatatcatttattgaagaatttgttctttcccagttgtgtgttcatgaaacctttgttgaaaagtcaaattaatgtaaataattgggtttatttctgggttttctgtcctgttcatttgctctctgtttctatttttatgcaactattgtgctattttgatgactgtagtactttgtagtctattttgaactcagatagtgcgatgcctgcagctttgttccctttactcaaaattgctttgcctattcagggtttgtttttttgtgtgtgattccatataaattttaggatttgtttctatttttgtaaaagctgccattagaattttgataggaattgcattgtatctttagatttctttgggtattagggacattttaataatagtaattttccagtccatcaactcaaaatacatttctacttatttttgtcttcttcagttttccctatcaatattttatagttttgagatttgttattattgctgatatttttgagacaggatctcattctgtagccaagactggagtatagtgtcacaattatagctcactataatctcaaattcctgggcttaagcaatcctcctacctcagacttccaagaagcaaggactatagacacatgctactatggccagccaactttttaaatttcttgtagagacatagtctcaccatgttgattgggttgaagttttatacttttacgtgtacttgttttttacctactcggttaaattgatttctaagtatttttgcagcaattttaaatggaaatttatttattttttaaagatggtttattgttatacagaaacactacagatttttgtatgttgattttttttatcctgcaattttcttgaatctgtttatttgttctaaaagatttttggtggatcctttagggttttccgtatataagaccatttcatctttaaacaggcacaattaaacttcttcctttccaattttgatgccttttatttctttttgttggcgaattgctctggtcagaactacgttgaatggaagtggtaaatgtgaatatctttgtcttcttcctgatcttagagaaagggttttcaacttttcaccattgagtatgatgttagctgtgtgtttgtcatatgtgactttttttgttaaaaactcttcaattttattgcttattatatttcttcacatatcatttattcagtcaacactatattagtttactgagcacacaaataaataaaacagaagcccagaactcaggtagtttggatatcccacacactaatctgtgtactgtttgcaaatcacactgtgttgcaacatctgtacctgatgttgcaagactaacatttttgctacctcttctcagaagcctttgtgatctcacctgttggaatgcactaatgttttctgagccccttaaatatcttgtctacattcttttaagaagctcttcaccaactgtcaggtaatgtagtttgatgaattaagaatgggggctctggattctgaacccctagatttcaattcttgttcccagttactatatactcggtgttcttttacattatttgagtcaattacttattatcttccattttccatataagagaggttaatatatgttttatatggaatttttgtgaaatttcagtaatgcacttggcatgatgagggctcaatgaatattaactattttaactgaaccatatcatgattaactatatagactatggtgaaaaaaacaagatttgaatcctaattcatgtgatgtgacataagttattatttaaatggtgaatataaaatagggaatataataactaccccactggcttattgtgagggtccagtatattaacatttgtaaaacctttggtacagtgatatgtaaatgataatgatgattataataatgatttaaattgttttatatgcattcattttttatttataataagtacatgggagatattaccctttactaagttaatttatattatgtaacttttttcctggtttgtaatgtctaatgtttttctcataatagctgcccaataagcacgtatgaaaatattaattcaagataacccagacaatgaggctggtgcttctgtgccaaagcttttgtgcaatgtcctgacatgatttctttagatgtcattttgtgtcagcactatccttacacctacatggattgtataattatctttgtagcattgattgagaattgataagatatccagcatttctgtgtacaatctgccgaaatcatatctgttgtattgaaacaaaggatgtattactttggtatctatatttccttataaatattcaaattactctaaggagtaatacattaacatggtgtcaaattaaactaatccaccacactggaagattaggaatcaggttactttcaattttaaattttcattgagaacaagatttgaaagaattataaatatggatgcactcatccatttattctttatgtatttagcaagcatattaagtacttttaaacattttgaatacaaagatgtgggtataggatgtaagttaaaaaaatgcaaattcaaagatatagttctttcaccaagaaaactaaatacagaaaagagtaaaaatcatataggaagtaaaaatctagtaggaagaatttatattctagacaagagcattgactttcccgggaatatatattttaggcagatcattatcactatgggccgtgaaccagtaaaagagaaaaatgaatacagtggatgaccaggaagtttgcattaggtccaatgccacagaaggaagttgagaagctaaaagaaaagaaaagaaaaaagaacaaaaaagaaaataaaaagtatttagtggcaataaattgttaaacaacctggtaggaatatgatgaatgacagaactctataggtacaagaagacagatggtgaagtaggacatactttcagaagtatttcacattatagaactatatctaaagtgagggtgaaactctttaagctgtgcccatagttaaaggaatctttctatttctaacagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtaagactggattttttacaatgaatgtctcaattttccctaaatctgtttaactccaaggcctaagcagtgtcttctgtgattcccctatctttcccttcctaaactatcattttcactaaacctatctttgtccttttagagaccacttcccttttgtggggtggaatccagtttacaatcagctaaaaggctgagtccttgtgttcagactgtgtacaaaaatagttaatagttcacaccttgtagtaagggacacatagaactaaacctagattctgccacctgtgacctatgtgacatcctgtaagttgcttaacttccctagatccttagttattagtcttaccatctgtgaaatgaagacaattccagtactttctcacaagatcgtctaagcctagaaacattataatgacaggcaccacacgccaacaactctcaagatattagctctcatccggaactctctcctctgaactccaggatcatttagctctagcaacatattcaacaggtctacttgagtgttttgctggcatcacaatacaaatacagctaaaatatacactttgttccccagaacaaaactgttgcatttttattcccttttcatctcagtagacagaaacaacatctaccaagtttctcccaccagaatgcaactggtttcttcaccaattaataacagtaatcagtagttttcttggcacatagcagatgcctaaataatgtaggatgagtaaataaataaagtatatgcattcaataaatactagttttcataattattatgtggatgctatgaactagacttttccagtgcttacttacttctgcgaattacaaaatatgataaggagaatctccataaaatgtctaaaattttaaaacttctttttggaacttttgacccagattgaattacgtattattaaaggttaaatattctcatattgaagttcaccagagacagactcaataccccccagaatttaagctgaaatcttgagccatgaagtattacagattaccaataatgataaatagtgataaacaaaaggaaatataaattgttgagacctcactatatcaaatgagctttttcaatcagcactcctctatgaagaaggggtgttcctaccaacagggagcacatgatagtatgatagttgtccaagattataagaaggtagcattctcattaatatttaaactggtccctttgcaggtttttagttttttctcaaacctggatggcatggaaacaatctccattttcaaaaagtcagtgatagtgcaactaatgggaattagaatagaagtaatagaggcttcagaatggttttagcaaacccagatatcacaatgagcattcaagtctaaactgaagtaatctatctgattagcagaggctgtggcaggaataaggcagcggcaacccctcacaggaggggtctagtgtctccctgggctctatctgcagttggagtctccagagcaatcccaggaaactttaggtacactgccagtgtacctagagtgtatccagctctctttgggcagcagtctgcagtataatatgtactatcttctaatgaaatgatttgctttcatgctaattttattattggatgtaagatagaaattctatctaatttctaattttacctgaaaacactgtatctcacacacacacataatgatcattaggagatgactaagttatgaagttctctaaacctgtaagtgaagtggaaacaggaaactttggattagaaaacataccctctgaccagggaatatccaggatccagcatgtcttcacattggcagaattttctgaaataggaccgaaggtcatatatcactgtgtaatctatgaaaagagatgctcagaaggtttgatattcatacacactcttacaacttgttacatctccagagctcagactggctggctttacaaatagctggctttacaatttgcacagggataattgaagttcatttcttctagaatcattaaaaattaacagtaaagttgctaaaaaaataatgccttgaaagtacaagattcaatattctgtgctttggtgtatgtatgtatttatctgtatgtgtagtggggattaggaggggacgattactccaaaataggattttgttccatcctgtatgggataactattaagcatttggcttgtggctaaaaatacatgttaaaataatactttttgtatgttatgttaaataaatgttattagaattaattttacctgtttaattttactttttacatgtgatagtagaaattaaatattggacatggaacacacattaaatttgtagtagatagtgttctgacaactatttactcagtatactcttgcacagacacaatagaaagtccacacagataaatgagtatcctggagtaaaacctttggaaaaatcaaattcttttgacggtataaggaaaggccaaatttaaccccaacatcattgacatgttttccccagaatgatcagaatatatgattacatgtttgggtggatctgcttttctatcttttccagtaacaatacatctcctgatgtagaatactagatatgagatacaactaaaacccctatatgtgaagaaatcttcccaggacgtcttctctctcgatcttcttaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagaggtgctatgctatctatatgaaatagaaaaaaaagaagagatatcattgctttccttcagtgcaccatttcttacagcactaaatgattgggggtggggatgacagtaaccattttcaataatgcttttactaagggaaagattatgtgacttcacaatgataccaatcctttctcaatccatgatgcagatcattttatcatgagttgaaagaaaattggtatttctattgctcctgtatttattcttgtaattatttggattttatggcaattgtagcattagccatggaataaacatatttggaggataatatagctgacttgtaattggttgcactctacttgaaaagtctagacatgaaggatacttgggaaatataattaaagcttgaaaaacattataaatttatgtgttaaaaatagtaacaaaatagctatgcttccaaaggcaaagacttttgctgtattcatttttcactggagtcaacgacaacatctcgttttgtatgaaatttgacctgaactttgaatgctaagaaagattggagtaggtgaagaagaaaagggagaagaaaaggcataggaattacctagtttcctcaagattcttaataacaatttcagatatgtccggttctttccctgggttcttgagagagagaaagtcagtgtcttttgatacaagttagagcagagaggagctgcatgaagacttgaaaaagcaacactgataggcataaggaggctgaaaggagacttgagtaaattaaatttattgcatctccatatcctgcagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggtaagaatccctcagccgccacaaacacatacatattcaagacacatccttctaataactacctagcttcaaagagctcaacaaggtttaacaacctttgggtgtgtgtgtgtgtgtgtgtgtgtgtgtgtgtgtatacaaaataagagtactagactggtaaatctatgtctctttggtcctccaaatatcctcaattctggaaaactagactaaacatgattgacacgtgttttcacatttcttattgaattccaaaatcatgtgattgggatgcagccccgagaatccccagaaaattgtagagtaatgaatgttaaatggcagtatacttataaaacaaatattgaatcctaaacttggtgctaagagctattcctaacgttgggaataggtctgtaaatgagacaggaagttcccagccagcattcatctaggttacagtagagagaaacagtgaaattgtaagaaaaaagacaacttcaagcaccaggtgtgcatatgtgtgtctacaaaacagcgacaagacagccaaaagtaagtaaaaagaaaataaaaaggaaatatgagacagaattgtagggtggggagcaacgtttttgggttggttggagatggctctggaaagacatgaatgcagcgccttcaaagtaggagacgccacctgtgaaagagctgagctgaaaatgaacctggcacatgagaagcacaaagagaagaccagtgtgactagaggttgaaggagaaggaacatagtatgagggtggtgtatggtcaggccagaagtttgattctattctaagcatagtgggatggattttacaaagaacatggtgtgttgcatttataacacatgacttgctaggtaaggagatagaagattgagatggaaaagaaaaagtaacatgagtaacacatagcaatatacaatatactaagaagacagtatgtcagcaggaagagaaaatgggaatccacggccccataaagaaggaaaaataaaaccattaaacagctgtcatgactgagtaagcactaagtgaagcaccacgacctggatgttacatatgtttcttgtttcgctcatggtaaatctaggagtcccctttaattgtgatgcttctctgactgaagttagacattgctcttttacaggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaagaaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtgtgtgtctgtttctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacgtatgtatctttcagtggcagtaagggatttgtgggcctgaggccatctttgaatgaatctagaaaatcaagaatccctatgaaacaatgatctgatagaatgttgtgtgctctccacatattttacatgatcttatgtgtgccgtgagaacagattcctaaagcaacccgatacatggaaacccattcaccactcaccatttaaacagatgatgaattctgttttttttattaagcccatttaacattttacatagtgtttttatggattccaggaatggcttctctttctcaaatgatcaacttcaagtcttctttccatatttcacatctgattatacaatgagcagtgccattgcatgccctgctagaactgtggataccctttaaaacaagtagaaaatgatagggtggggctgattaggtctaatctcagggaacactggttagtatttcatgtctaggtaattatcttaaggagcgtacatttaactgtttttgatttgtatatttttaaatcttattttttaaaaccactttattgaggtatgattgacatacataatgttacatatttaatgtatacaacttaatgagtttggagatttctatgtactcctgaaatcatcaccactatctatgccataaacatatctctcttctccaaaagattcttacacttctctgtttattattatcatcattccgtgactgcgtgtgagaagtatacttagcataaaatctactctcttaacaaatttcaagtacataacacaatgttggttactactggcaccatcctgtacaatagatttttatcacttttttcagcttctatcactgaaacttgtcatgtgttcatctatttctattatacggtgaaagacagtgtggcataatctgcaaacaactttggagcctggtggcaattttttgttgcttactcactgtgtgaacatggggaagttccttcatctttctgtgcttctatttcttcctctgtaaagtgggataattctagttatttctcaagcccctataaaagctgagagaatgaacatgagttttgtagtagaaagccaatcccaagaatcaaaatttcttcaatacacaatctcttgcaatgcttaccaactgcaacttttgatcaccttttgctaggttttctgtttacgttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctgggtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtgataggatccataaagacatgtgagagggaacaaaaaagaagtcattctttcaataaaaaagtgcagaaggaaaggtttgctacttcttgcccaacttgggacattccttattcccactacttcctatgttatttttctccatagctcgtacatctacccactcagcaaatattaatagtttatttatgtgtctggttttttacttgtatttactcactaacatgcaaacttcgtgatggcagggatttgctcagcaattcaacaaacctggcacgtagcagatattcaattaataattattgaataaatacatgcataaatacacagataaatgcaccctcttgtttaaagagaaaatgggattggtattaacacagaatagtataattattaataaagtaaaaattgtagagaacagtaaaactcctgcgggaaaagaaagatacacctctggcgtttatagaagaaagccatccagaaccagcacagtcactcattcctgtaatcccagcactctgggagtccgaaggagggtggagtggcttgaacccaggaatttgaggccaacctgggcaacatggcaaaacccatctctacaaaaaatacaaaaattagccgggcatattgactggaacctgtaatccgagctacctgagagctgagatgggagaatcgcttgagctcaggaagcggaggttgcaatgagctgagatttcaccactaccctctagcctggatgacagagtaagaccctgtcttaaaaaaagaaaaaaaaagaaaagtagtgaaataagaagaaggaggaggagaaggaggaggaaatgcagcataaattgagacagagctcctgtgaatagagatctgggaagttaaatcttttaaatcttcttggataagtgggagttagacattgtactttcaaggatgttcatagaaaaaggaactaaaaattctggatttaggataagtagacttaccaattagttgatgcaaaaaaactacaagatcagcttggtggtggagatatgaaagttgttcagtgtttgggtcttaaagataagatactggggctgggcatggtggctcacgcctgtaatcccagcactttgggaggcagaggcaggaggatcatgaggtcaggagtttgagaccagcctggacaacatagtgaaaccacgtctctactaaaaatacaaaaaaccaattagctaggcgtggtggtgggcacctgtaacctcagctacttgggaggctgaggcaggagaattgcttgaactctggaggcggaggttgcagtgagccgaggttgcaccattgcactccagcctagacaacagtgcaagactccatcttaaaaaaaaaaaaaaagaaagataagatactgggattaaattctccttcaattgaggaatcagccttggtgagtgttgaaagtacagagtccttccttatctggttttcatgaatagttttcaagggataacttattgtcagatctgtaggtcagaaatggaaaatagaggaaatgaatgttgaaagaccttggattagacatgaggtgtttattttgatgtaaagcgtacagtctgacatggagtggcaattctaagaggtagggtacaatgttgaggagttagaatgcccatgggcttggttctatgaaacctgcaagctcacttcattccaggtgttgtctggtacatggtgaaagatgctttctgagacttgaaaagagtcgtatctcatctacagcctattttctttttcaggtacagcaatcatttgaaactccaagggccaaagctcaaatgcccaccatagaacgactgtccatgacaagatatttctacctctttcctggcaattgaaaatggttaagtattgagagttgttggtggtatgtgaaataaataagagagtgatattggtggttaagttcaatgacaaatgacagctgagtacttggatggtcaaattggtgtttttgttgatatagtctggtgattatctgctacttctttccgacttacatgtatttggattcctccaactctacaattaatcaggcaatcaatcaatcaatcaaggaggtaaggaaaaccgcagcagaatgtgatgatgaaaaaccaaggatagtaattattaaaatagaaacatgctcatgcttccattactatttatattcatttatctctcatagtctttctcttttattcccctttcttacacacacacacacacacacacacacagagagagagagagagagagagacactaagtagccaaacattgcatcaaaccctaaacaaaacagagtaaacaaaggagctaactctggagaaagcagcattttgatcctctgagtgaggatgtcacagcaaataccacattactgacatccagataccattaccagatggtacagaatacatcctacactgtagagtttgtgttgatccaggctctggttctcagactgttctcacaatgcagatcaccaatcactcagggttggcttttgaatcttcaatcacagtccagaagttccttcaagctcccatgtaacttttgttattattttgaccaaaatattatagaatgggtacattgagtctggactaaatgattactttcttcactcataatagctttatttaacactagactataagactattatcaatctccctctaagatacatacttaaaattatattttatagtgaaatgtataaagttgttctcaatacttccaacatttaccacataatttttactcttggtttctgacacttcagtcacaatattgcatcatttcagcataacagctttcagtgcctaatccatccagtggggctgcatttggacattgaattgtttgttgactaatatttgccaacactaactgtgcaccaggttttgttctagatgcttggaatatgccaattaacaacgtaaatagatttcttacactctgaaagcttatattctagtgagtagaaacagactctgaagacataaagtggtaaatatatcacaggccagagagcaaaaaaaggtaaaaggaaaaataaaggaagacaaaggaaaacacagaatgatggatgctgtactcctatagatatttcactcaaaagcttttcttgaaataatgaaatcagaacaaagaatggacagagttggggagtgaataatgtggttcttatgcaggaaaagtgttccagcacagaatacagccagtgcaaatgccctgggatagcaatgcactaaacatgtttaaagaactgcaatgagacagtgtgaccaaaagagaacgtgagtggagaaaatggcagagacaaattaggagaagcagtgagaagccagatcgcgtggttctatgttatcacatggtaaacctttaaaaattattatctgagcgagacaggaagcctttctagtgctttagaaaaaagaaataatatgctttaaattaggttttacaaagatcacattttggtgaatagactaagatgtcacagatggaagtcaagggaagtggcaagagcacatggaagaggatgcaagaagaatcatgatgagggatgggatgaaggcagcaaggggtaaccatcttgaccttctgttttttctctcccctgcaggaagccacaagcagcccagccctccttaatcaacttcaaggagcaccttcattagtacagcttgcatatttaacattttgtatttcaataaaagtgaagacaaacgaactgtgtctttttctaatagagaatataatctcaatgaaaatggtgggtgagtggaaatgaagtggaggaagctaactggattttcgagctttatggctcatgaaatatctatacttggctgatgaagaaaactgactgatttatccccaacaataggatgaaagatgttgccgaaaactatagtgagatactgcctcatacccatttgaatgactcccaccaaaaaaagccccaaaaaacagaaaataacaagggtttgaagggatgtagaataattggaatcctgtgctctattggtgagaatttcaaatggtacagccaccttggaaaacagtatggtattgcctcataaaattagaagtagacttaccatatgctccagaaactccacctatgggtacataactaaagtaattgaaagcagggtctcaaagatatatttatacacccacatttatagcagcattgttcacaatatctaaaatgtggaactatctgataactgataaatggataagcaaaatgtggtgtatacacataatggaattttattcagcctttaacgagaaggaagttctgacatttgttacaatatggatgaaccttgacattatgctatgtgaaataaggcagcaatagaaaaacacatactgcatgatttcacttacatgaggtacctagggtataaaattcatagagacagaatgtagaatggtgatggccagggactgtggggaggaggaaatggggagttattagttaatgatatagaatttgagctttgccagacaaagaggaattctgaaggtaaatgggggtgacacttatatgactttatgaatggatttagtatcaaacactacatttaaaaatgttaagatggtcaattttgtggtatgtatttttaccacaataagacattggggacaaaagggataactggagatgagaaaagatggagtaaattgcacccgggaaactctgatcaacttacacagaagagaattaagctactgtgcaaaactgatgaaagaagaaatgagagtaaagtatattacttattatttcaaaatgaatcaaggaaataatcggaaatctcaccaccatcaaatattatgtagaacaagagagagatctggcagtgtgaatgagctatatttcatttttcatataagacagttaaccacttttctactgtgataaatcttagcaaaactaggggtccaagcatatacgtctttttctcccccatatggttcatcaaactgagttaggcaactttactttcacacacctgtgatgcctcaggagccaccttgacatacacatgtcaagaaaattattaattctatatctgatgatgtcttgattccactttcaccatacaaagcagagaccaaaggtgtcactcacagatactcatctattctgccttagttgttaaataactgtctagtcattcatgtgaagaccctcttgtttcccaagtgatgtgcatggtttcaggtgacttacatctttaacaggacttattatcaatcagtcaagcatgtggaaaaaaaattcagtaaagagtatccaacacattggggtaaagttctccagagaaggtgaggctttttcaatgtccatctttctttaggttcactatttggaagttaccttaacacagaagactctcaagcagtgtattctcccttcctaggtaacagtgcttctaaaaaaatagcattgtttgaatcccatcttccttggtattaattacataggataaacccagggtgggagggctatgggtaattctcatagattattaaatctatgagagtatatataatagagtaacctatgagtgtatatataatatatatacactgaattagtaatcattgaattcctctatagtacaaaacattttccttaaactgtgagcaataatagagaattcagtggaaaatgatctatgctggagtacattagaatttgactccacatagaaaa

SEQ ID NO: 16522 - DNA, 13364 bp, Human
  misc_feature (1)...(13364): n = A,T,C or G
acatacattttggaaacatacaatggttaattatagcagtaagtcccttacaatgcattgtatatgttctcttacatgcatttgttcatcaaatcttgtgaattctaccctttaaaagtttgtcaattccatccatacttcttcagccctattatgtcctactgcatgaccttaacctcttccaactagactattgccataccccattaattggctttagtcccgtcttctcaattccaatccatttccttcattcctgagtaatgttgtttttgttttgagacagtcttctctgttgcccagactggagtgcagtggcagcaatcagggctgactgcagcctcgacccctcaggtccaagtgatcctgctgcctcagcctcccaagtacctgggaccacaggcatgcactaccacacatggctaatttttctacttattgtagagacgaggtttcattacgttgcccaggctgacctgggtgctgtttctacacacaaatctaacctcactctcctagttaaaacttctggtgactccaaaccctttagcttggtgagaccctttcgaatccgccccatggaagctcagtaataatcaatcaaaataaaaaagagcggcagcagctgttgcgccagttcgcctttacatagattcatctcaaccagttccccaacatgcctgtgcataattttcccattgttagaaatgccctgtttctctttgcctcatgcacgccccctcttatttcaaggtccagctcaaaagtcacctcctgtctacaacttcctctgatgctcctgagcagggatggctgaatctctgtctctttacaataagaaaatacggtctttttttttctttttgagactgagtctcgctctgtcacctaggctgaagtgcaatggcgaaatctcggctcaccccaacttccgcctcctgggttcatnnnnnnnnnnnnnnnnnnnntacaggcacgcaccaccacactcgcgtgatttttagtagaaacggggtttccccatgttggccaggctggtctcgaactcctgacctcaggtaatccacctgcctcggcctcccaaagtgctgggattacagacgtgagtcaacgcgcccagccggaataatattttacagcaattacactgcactgtttagatcattattcctatgccgcctcctcccccaacaaagtgcgtgccttcagcacacaacggtcttgtttctgcttattccgtagccccgcaggcaaagccagagtctggcacaagccagggaccgagtgactacctgcggaacagaatgattagaattgcgtctggggttcctggagggtgggccttggctgggcggatcccaggagcctggcgtctcccaggggaggcgctcacctcagatcgggcctaagagggccctgcttgccacactgaccgccaagcctggccaaaaagctcagggaagccgcggagccactgcccgcctgggtcagggtggtgacggagcctgactgagaataacggctgaacttgactaatagactgaccgagggttggagcgggtcccaaccaactgcctgacggcccaaaggcaggaagaaacgatggtaggccttgtcatcttcgaaggagaggaaggacagcaaacgaattgctatagcgtccccatgcgcacttggcgcttctcctcaagcggagcaggaacggaactgggcggacccgccggaagactcggcgagtgcgcgcgcgcaggagcccattttcccgcccgcaacgtggccccgcccttttacccaggccctacgcgagcttcgccgagtacgcgtgcgcagcagcttcccctccctcgccccgcccctcacgtggccccaccctctcaccctagacagatgggagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtaaccggggcgggggacgtcgcgcgcaggtgccgccggggcgcccggaagagcgcgcgcccgtggggagacgctggattccgggagctgacgggaggtggtctgtagcaacggtcccagagcttcccggcgtcctacaggcctagtggactctgagcggagaatgttatgaccaccgggcatgcacgcttcagggccccggcgcacccttgcttttgcagcatttatacttgcatccacccttgcaaagatgcagccgagggaactgggtgccccttcccttcacctgtggggagagggcggtgcctggcgagatccaaccctcgagtcccaagtgggagaaccggagggcggtgcgaggtcgacgccaccgggctcccggctgtggaagctgggaggggttggcggggggaaatgcaggcgcgttagcctgcgtgtccgcgcccctcttcccagggttggattgcagcctgctttgcagtgtgcaaacaatgatcagatatcatacatcttgaatagtgcaagcgtgaagaataagcttcagttcagccaccctgtaaagcaggggtccccaaccaccaggcccgtcggtggcctgttagaaaccgggccgcacagcaggaggtgagcggcaggcgagctagcactacagcctgagctccgcctcctgttacatcagctgcggcattacattctcataggagcacgacctttattgtgaactacgcatgtgagggatccaggttgtgtgcttcttatcagaatctaatgcctgatgatctgaggcgaaacaggttcatgtcgaaaccacccaaccccgtggaaaagttgtcttccatgaaaccagttcttggtgccaaaaaggttggggatagctgttgtaggaaacatcttggggttggcaacaaaatcagtaaaattgggtcaaggcatggaagaatttgccactacctccgcctttccccccttccatttttgcagaattagggatcctggcctgagtaaatggacggttggaaatggtggctgaatgcaacaccgcagtcccagtcccctcctcttgcacctgtcttcacccacgagcagcttttaacttcctctaggagatgggcaagcttagtgttgcgagagagccagtcatttcattttcaggttttgtactcattgtggggaagtgaaaccaagaagtagttgtctccagtggttgaagtctcctattttcaagcgttccctgtcgtggatttggcacttgcagctcattcaaggcaaagtttcaagaatttaaaagtgtaggccgggcttagtggctcacgcctgtaatcccagcactttgggaggctgaggcgggtagatcacctgaggtcaggagtttgagaccagcctgaccaacaaggtgaaaccccgtccctactaaaaatacaaaaattagctgggcgtggtggtggacacctgtagtcccagctcctcgggaggcttagacaggagaattgcttgaacccaggaggcggaggttgcggtgagccaagatcacgccactgcactccagcctgggcgacagagcaaatactccgtctcaaaaaaaaaaaaaaaagtgtgggctgggtgcggtggctcatgcttgtaatcccggcactttgggaggctgaggcaggtagatcacctgaggtcaggagttggagaccagcctggccaacatggtgaaaccctgtctctactaaaaatacaaaaattagctgggcgtggtggcgggtgcctgtaatcccagctactcgggaggctgaggcaggagaattgcttgaacctgggaggtggaggttgcagtaagccgtcatcatgccatgacactccagcctgggcaacaagagcaaaactctgtctcaaaaaaaaaaaaaatggtgtaggtgtggctgattggttgtcaggcatgctcagacacaccctacagcaccctatgctttgggggcctttactggcaaaatgacacccctaccccaccctgctccatgggaatcagataatatcacagaacaagtgtgacccaaagggaaactttgcgccataaagctaacagtgttttctactattaccaccctagtctaggtcaacattacaatagcctcttctctggtctccctgcttccactcttgagtctccacacagtagcctaagttctatatgacctgactcctggcttccctctcatctcccaaccattctcctactgtcttttgaatattccttgctctttactgccttaggatatgttgcactagttgttccttgtgactggaatattctctgcccaaactttgaaaggctagttagttacttctcatcattcgggcttaggttaagtgtttcctccttagagttcttccttgatttatcttccccccagtctaaagtgccagtcacattaatctgttttatttctccatacagcactcatcactgattttttaaaaatctattttgccatctttctctctcactggaatattatgtgctcatgaagaagctccttgtctattttgttcctgatcgtctgcgctgcataacagattacctgtctcatagaaggtgcacaataactattttgttgcgtgaatgaacaaacgttttctccagtctcttttcaaatcttctcttccatcacgactgaaccaaaaggaaatgtactagtgttctgtctggcagccttgttccatgctttgcctttcagtgatttccagtatcttttttgttgttgtttctttcccttcaccatcactagaatgttagtttcatgagctaagagatgccattttgttccctgctgtgttcacttagtatggtgcctggcaggcctttagtaactttttactcaatgaacgaatgaatgaataatgaacttatctatactttaaagaagtgagttgcctgattataggtaatggtagagctgattcccactagcccattggacaccaagggctggtaggaagtagatgaggaaaatagacttctaaagctatcattaagagataacagaccacttcgggaggccgaggcaggtggatcacaagttcaggagatcgaggtcatcctggctaacacggtgaaaccctgtctctactaaaaatacaaaaaaattagccggacgtggtggcgggcacctgtagtcccagctacttgggaggctgaggcaggagaatggcgtgaacacgggaggcggagctgcagagagctgagatggcaccactgcactccagcccgggcaacagagcgagaccctgcctcaaaaaaaaaataaaaaataacagactaagataacaagagaaaattctttatgcaaatgtttgccattcaaaaccattctgccttacccttgaaactaagaatggtgaaagtagaaggtggagatctctgaattctattttaatgttagaccactgtataattattaatattattccataatacaagtgcaggcccttgaaagtaggtatcccgtgttttgctttttaaacattctccccttccccaacatgtagcatctgctacaaagcctgtcagagtattgttcattcatcagatattttcagaacatctgccacattccaggcactgttgagcactagggatacagcagaaaacaggtcagacaaggtccttattctcataaatgtattctagtggaaaggatggaaaacaagcaaataaggatttcagagagtgagtaatgcactgaagaaaatacagcagggtaatgatagcagggtatgatgaaaatgaagccatattagatggtctgattggaggagtccccagtagcaggggacatttgaactgagccttgaacgataaagagataaccatgaaaagaactggggaaaggacattccagccagcagagagcaaatgaaaaagctcttgagtgggaataagtttcatgtgctgaagtgaaataaggccagttgggccagagggatgtgatcttatttgtattttaagtctttcctgcttttaggcccccagagctcaggctttttggcatttaaagatgacttgttctggtgtcttctcctccctcctttgtgtccctaaacagtgttaaatatttttaaaaaccaagaggacatcagtacactgtaaaggacaaagactaacaagaacattgtatctttttttttcttttttttttttttttttgaggtggagtttcattcttttcgcccaggctggagtgcagtggcgcgatctcggctcaccgcaacctccgcctcccaggttcaagcaattctcctgcctcagcctcccgagtagatgggattacaggcgcccaccacaacgcccagctaatttttgtatttttagtagagatagggtttcaccacgttggccaggctggtcttcaactcctgacctcaggtgatccacccatctcagcctcccagagtgctgggattacaggcatgaaccactgtgcccagtccagaacattgtatctttgccttcagccagaattatgtcagcttgacataattttttttttctttttagagagagagagagagatggggtctcactctgttacacaggttggattgcagtggtgcaatcatagctcactataacctctaactcctaggcacaagtgattttccacctcagcctcctgagtagtttagctgggaatacaggtgtgtgccaccatgactggctaattttttttttttaagccagctatgttgcccaggctggtcttgaacttctagcctcacgtgatcctcccacttcagccccgcaaagtgttgagattacaggtgtgagccaccatgctcagccttgacatgattatttacagtgattgcctgtgatgaaaaaacttgatagggatcacttggattaggaaaacaaaaagttgatggaagtgaggaaggcagtgttaccctaaggtggcttgttagataaaacttgtgcattgggagaaaccatcaaaagaagtccttggcttcttcagtaagttaaatgtagacttagcatatgaccaccacagttccacttgtatatatacccaaaagagtggaatacaggtgttcaaacaaaatgtgttatgtgaatgttcatagcagcactattgacagtagccaaaaggtggaaacaacccaaacattcagctgatgagtgaataaacaaaaatgtggtctatcgtacagtgtaatatttatttggccataaaaagtaacagtgtgccaatacatggtacaacatggacaaaccttgaaaacatgctaagtgaaaaaagccagacacaaaagggcacatattgtacatttccatcagaatagacaaatctatagagacagaaaatagatgagtggttgctggggctgggaggaggaagactggggagtgactgcgtaatgagtatagggtttccttttgggatgatgaaaatgttctggcactagatagtaacctctatggttgcacattcttaatgcactgaatcatgcagaatgtacacttttaaatggttacaatggcaaatattatgtgaattttactgcaattaaaagtcttggccctgacagtttaaaacccagagatctagccagagggaagtgtagtctagggagaagacattgtcccaagcctggcctctcactagcttatctgccctgaaattgctgggttcaaactctggcctatctagccaaagcgtcctccatgatgccaactcctttgtaggtaggtttgtttatttttgtcagatttcttgttcagggtttactgcgaaaggcctcctgggatgatgagcatgacaggggctgatgtagtatgcagagggtctccttcacctaactgaaaggaaccctgaaggagaaggccttagtatgtctgcagccttgtttattctggacagggttgtgtatatctttgattagtgtgaacaggtactaatggggtgccctgcatgttgctggcactcactaaattgttaaatgagtcagtgggtgaatgaataaatattagtttgtgagagcttgcctcccttgtgggcttgtttccactctatttcttaaacaggggccccttgggaaggggaattagccccaaaagtccctggaacacccacttgctcagctctatacgccctcaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcaggtatggacaagtccaggacggctgggggggcagagagggaggaagctagaaatcgtttccctacttggaacaggaatacccagcatctttccttctgagccactctcaaggagtgtaagtaaacaggttcatggtctctaaaggaatctgctgcccacagtaggcttaacctgagcagattttgggaccatggaatctaagctcagctgtacaggtgcctgaagggaagggaacccctcttccttcacattccacccctctctgacattaaactgtgagaactttgagctctccttgcagggaacactgggcagagggggtgctatgtcccctaggggacagcatagtcagttcttctgtcttcatttcagtttatgtaccaaaactgttaggttttggtgttagctcaaatgcactgatgccaccactaatccaagggcacctcccaaccacagcgacagctttaatagtcaccagcatttagtggctgacagggtaaagatctgcacccccattgcattttaaatcttcacttgaactctgcctgagaagcaagatgtattatctccatgttatacttcaggaaaaaaaaaactgaagctcaaagattaaaggactgtgggtgatagagtggctcatccagagctccacctaagtgtttagtcccaggcaggggcttacttatttcacttccctcccagcttggatgcctccattccgtagtaagctgggaacttagtagagcgtctggtcctgggtagagatagctggcacacctctccaggacagtcagtcagatttgactcaacttcaggtaactcccttggtgcttttattagaataataataatagttaacatttatcagatgtttactgcgtgccaggccgctgtgctgagtgttttacatgtgtttcatctttgcaagagctctgtgaaggaagtcccatgtggtactattacctccattttttcaaatgaagaaatggatgcttagagtaacttgctcaagattgtggaattgttaagtggcagaactaggtttggaaccctaggcatccagtactaccactactagtagttggtcttagccgtttctcggcaaagtgtaagaaaccagttgtcacagcatcagtccttggggctgctactgctcgttaggaaggatgttgcagatactaacagcagctaccacatattaagcatataaccctgccaagtatcacgcacatattccctcatccggtcctcccaacagcccccatgtggcagggactgtgttccttccctaccacatgctcccctttctcacccagctccagccagactggtctttgtaatcctgaaatttcctgagcttagccctgcctcagagcttttgcacttgcagtcctttctgcctgagacactcttcccaaatcttcacgtagcttgctccaggacattcaggtcctttagctgatgtcaccttcacagggaggcctgccttgaccacctgaagtgggctttcttacccactttgtcacatcgcgctgttttgttttccctgtggcattcatcacctgtgtttatgtgtttgttatgtctcttctctcccttagaagaatatgagcttaatagtcttttttttttttttttttttttttttgagacaaagtctcactctgttgcccaagctggagtgcggtggtgggatctcggatcactgcaacctccacctcctgggttcaagcgattcttctgcctcagcctctcgagtagctgggactacaggcacgcgccaccatgccctgctaatttttttgttatttttagcagagacagcggtttcactatgttggccaggctggtcttgaactcctgacctcgtgatctgtccgcctcggcctcccaaagtgctgggattacaggcatgagccaccgcacccgtccgagcttaatactcttaatcacaagtagacccccagcacctagaacagcatctgacacatagtgggcatataataaatattcagaagaatctccattttttcagatgaagaacagttcagagagtttaaatgatttgcctagtgctgcatggctaggaagtggcagaggaggaattcaaacacaggtctgtatggttgctcctcactttgaaccattacacggccaagaaaattcttctttccctcagttcagctaggtcccatagcaattttctgccctgagttccttatggtcttgctttttgtgtctggtttctgctcacagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacattcacatcttttcttcagactcagaagcagttatctgcaaaagtgagcttcacgacagctctactttcatatttaaccatttgaaaatgtcatgagaccacagctcctgaaatatatctaattgcacccacacaaagaatggagttggcaaataagaccttgaattattttcctccattttatccaggttggtatatatttagttcctggaaacaaaaaatagaggaaattccatatgttgaattggatgggacaaaaaattgtggtagcttaggctaacagttcaaaccaaggaggtaaaaagtgtttaaacctaaacacccacctgctgacagcttatgtactctacatataatgaaagaatataataatatttactataataatttctacatttttacttcagttctcactgaaacttctggaagatctttttggatacttctaactggtaaatttgctttggctgttctagtgtgctccgtgtaaacgggatcacttccaaagagcaaagtattcactgttttatggaaattagaatgagacaacaaatggcaggtagggaaaggactctaatattaaatgcatccagagtccctgaatgaagactaatcttgattttcaattgtaagaagcaggaaggtgacagtacctccatgggcacggcactggatgggttctggctggatatggttatttacaaccccagggccttgagttgaagaaacctgagctattgggcggaactacattatcatatgtcagaggccctttgttacccaatagttgttttcattaaaggtgagccctctttctagagtcttaagtgatttgcatatgtcacataaaatacagtcttccctgacccaagtcaaatggattcctttacctcttagaatttactaatattgtggctcaagtgctgctattcagattctaatgaagactatggactggattcccagaatcaatcaaatacttatagttatttttttaagagatgggcatcttgctttgttgcgcaggctagacttgaattcctgggctaaagcgatcctcccgcctcagcctcctgagtagctggggagtacaggtgcatgccgctgcaccttgttaagtatttcaattttaagggaatttcctgataacctgaagcaaagcagacactggatccaacatgaattgtgtttaaggaacttgcaagttatctcaaatggtgcgaagggtaatttacaaatagttcttggtaattggcaccacaaaaaatgttggagttggaatatattagcagagattatacatagggaactaatctgggaatatgaacacggccaacaagacttaagaaggtgagggagatggtgaggggga

SEQ ID NO: 16523 - DNA, 18891 bp, Human
  misc_feature (1)...(18891): n = A,T,C or G
accaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccacatttcttgtgttgttgttttgtgacgactttatttcttggtttctgttattttacctggggtgggaggtggggggtaattcccgtatgaaatgtgtcgtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtcgctgctgcggtcgctgcgcgtgtttctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacactgtccgctccctaaggtcgcttccctgcccgtgtacccttcaccctctggagtttgctgcttcctgctcctcatccctttcttatctcatctaggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggtgtgtgtgtggaggggtgcagggcggagtactagagctcgacctcagactcttggggcggtcacgctggggagcataaagttagactgctcttcagtgaccataatggcacagtcctaagtggaaatctggcttaaatgacaaccttggccttgactttgtcttatttgaaagcagttgagtatcccaggattaacaaaccagactgttacggtgtttcttgttgcctggagctgaaagggtttgtgtgagctttggagtcagattgttcaggagtcaaattgtggggcccccacactgtctgactttagactttttttttttttttcagacggagtcttgctctgtggcccaggccggcgtgcaatggcacgatgttggctcactgcaacctccgcctcccgggttcaagcgattctcctgcctcagcctcctgagtagttgggattacaggcgtgcgccacgacacccggctattttattttttattttttatttttttttgtatttttagtagagatggggtttcgccgtgtcggccaggctggtctcgaactcctggcctcaggtgatccgcccgcctcggcttcccagagtggtgggattacaggagtgagccaccgcgcccggctgactttagacatcttaatctttcagagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttgtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacataagctacattacatttataagaaatttttttctgtgataataagttaaccttagtttaatgtaacatttttattttataaacttttaacatgttttaaatttttggactcttttgtaataacagcataaaacacatattgtacagctgtaccaaaatatttttctttatgcactttttctgtgagcttttttctgtttttaaaattttaaactttttttggctgggcgtggtggctcatgcctgtaatctcagaactttgggaggctgaggcaagcggatcacctgaggttgcgagttcgagactagcctgacccacacggagaaacctcgtctctactaaaaaaaaataaaattagcctggtgtggtggcaagggcctgtaatcccagctactcgggaggctgaggtaggataatctcttgaacccaaaaggcggaggttgtggtgagccgagatcgtgccattgcactccagcctgggcaataagagtgaaactctgtttcaaaaaaaaaaactgacaacgttttttcttgaaagtttctgttgtttagtagacacaccagtcatgcctttaaaaaagnnnnnnnnnnnnnnnnnnnnctccacctcccagttcacaccattctcctgcctcagcctcctgagtagctgggactacaggcgcccgccaccacgcccggctaattttttgtatttttagtagagacagggtttcaccgtgttagccaggatggtctcgatctcctgaccttgtgatccgcccacctcagcctcccaaagtgtcgggattacaggcgtgagccacagcgcctggccaaaactttttttaagttaaaaaattgttttgttaaaaacggagacacaaacacatacattagcctaggcctacacaggagtggcatcatcattaacactgtgttccactttcacatcttgtcctgctggaaggtcttcaggggcagtaacgggcatggacctgtcatctcctatgataacaatgtttttttctggaatacctcttgaaggacctgcctgaagctgttttactgttaaatttttttattttttatttttttgagacggagtctcactttgtcacccaggctggagtgcagtggcgcgatagatcttggttcactgcaacctccgcctcccgggttcaagaaattcagccacccgagtagtttataagttggagtacactctaaaataacaataaagcatatgtattatagtaaatacataagccagtaacatagttgttcattattgtttcaagtatcatgtactatatgtaattgtatgtgctatactttaataggactggcagcacagacgttttctttacactagcattgccacaaacatgtaggtaatatgttgccctacaatgttaggaggactaccgtgtcactagacaataggaatttttcagctccattataatcttagggaccgtcatcatatatgcagtccgtcattgtccaaaatatcgttatgtggtgcgtaactgtataaagaaaatacaactgtgtgccccatagggttgttgtgaagattagattcatccaaggcaccagttataataatacctggtatttggcatttagtggtagactgccagtaaatgatagattactttagtttctgttagagaatttagagaatcaggaaacctgagtatatcttagaactacatttagtgctaaattctgtgactttgttgtctgctctttttcctctcaatttacaggcagagatctggctccacaaggaggcccagaaggagggctggagcaaagctgccaagctccaagggaggaagaccaaagaaggcctgattgggctgttgcaggaaggaaacacaactgtattagtagaggtgagttgttggaaattccagataccaagaacagctgtcccttgggtgtaaagcttgtagtaggccctaaaggggcctgttcttgaagaagagatctgtttaagaaccataaagcgtagttgaagttaaactcatgaaaccctgggtattagttacgaattcgtttaagtatagaaatgtactggtgtgttgatgagaaatggcctgacagtctagaatattactcctgaatgtgagtctggcacaggcttacaccttgtcactgattgtttcctggaacagttagattacaagttaattatattaattgttgctgaatagagagtaggtattttagaggaggtttgggggccataattggtgaagagtcagatgtggattagtttagagtgagagatggggataaacaagataatagcataagtggtttggagttgggatggctggagaatgaggtgatgatggtgtgcagacataggtaagtggtgaacttgtggtgagtccttcaggacattattgaaccatcttctgaatatacaggctattgctaactcactggcccaacataaatcacttcattctgttccaggctaggagaggaagcgtagctttaaaattttggagtcattttttttccgttgagtctgtagcttgttctatcagtatcttgatttattctccagccttaaggcacttttggaaattatcattaaacagcttatacagctatatcaatttgttcccacaggtaaactgtgagacagattttgtttctagaaatttaaaatttcaactgttggtccagcaagtagcccttggaaccatgatgcattgtcagaccctaaaggatcaaccctctgcatacagtaaagtaagtttgggatttgtctccagtgtgctgaatttgctgtcctcattgggtcttttgctgttcctattgtagacattctcatgtctcattctgttacttcacatctctgcttaaatgctatctctttgcatagaattacccttcccccgttgctatatccccgtgtcatgctgcatttaaaattttttattatggtgcttatatattacattttaatttatctgtgtgttgtctatcttccccagcagaatgtaagctttatgaggcagggaatttgtcttttcactgttgtatctctggtgaaagagaattgggcccactacttagttggagctcagtaaatctttgtcagatgaatgaatgaatgattgaatgcatgcatgccagtgaaatggagttagccagatcaagtgaagccatttgaggctttgtgttcagaaatttggaatggtcttaggaaagaatttctaaataaagagattggagccaggtgtggtggctcacccctgtaatcccagcactttgggaggccgaggcaggcagatcacctgaagtcgagagttcaagaccagcctgaccaacatggagaaacccgtctctactaaaaatacaaaattagctgggcgtggtggcgcttgcctgtaatcccagctacttgggaagttgaagcaggagaatcgcttgaacccgggaggtagaggctgcagtgagccgttgtactccccccgggcaataagagcaaaactccgtctcagaaaaaaaaaaagagagagagattggaaaagacatggtttaggaaaataagcatattcttatccatagagggatcaaggaaaggaattatgtcattctgcctttgactcagccttattgccaaggcaaagatgaaccaaccactcacagtaatttttttgagtttattaccaactttttttatcttctttatccttctcttgagatgtcttggtaaatgttaattattattggcattacatagtcatatggaaaacaatgttgagattattttttttaattgtattgagtaggtaagtcacttgaactagaaattttagctttgattttgccagtaaacaccagtgtaccctttttttttttatttttgtttttgttttttgagatgaagtcttgctctgtcactcaggctggagtgcagtggtgcaatcttggctcactgcaacctccacctcctgggttcaagcaattctgcatcagactcccgagtagctgggactacaggcgcccgccaccacacacgcctagtatttgtattttttgtaaagacagagtttcaccatgttggccaggctggtcttgaactcctgacctcaagtgattcgcccgcctccgcctcccaaagtgctgggattacaggcgtgagccaccatgcctggccccagtgtactctttttccagatttgccatttattaacattttgctgtatttgctttatcacttctttttttctttaagagacagatctggctttcttgcccagcctggagtgcagtggcacaatcattgttcactgctgcctcaaattcctgggctcaagtgatcttcccacctcagactcctgagtagctgggactacatgtgcacaccactatgctaggctcatttttaagttttttgtagagacagtcttgccatcttgcccaggctggtctcaaacctctgggctcaagaaatccacctgctttggcctcccaaagtgttgggattataggcttgggtcactacagctggccctatcactttttatatacatgttatcatcgcccttttttttttttttttttgagatggagtctctctgtcacccaggctggagtgcaatggtgccatctcgctcactgcaacctctccctcccagttcaagcgattcttccacctcagcctcccaagtagctgggattacaggcacctgccatcatgcccggctaattttttttgtatttttgtagagacgggagtttcaccatgttggccaggctggtcttgactcctgacctcaggtgatctgcccacctgggcctcccaaagtgctgggattacaggcgtgagccactgcacccggtcatcatcactgtttaaaaaaaatctttttgtaagtatgttgcagacatcaggatcctttattccttcagcatgtatctcgtaaaaacaaggacattgttatataaccacaggacagtgatcacatttaggatttttttttctttgagacggagtgcagtgttgtgatctcagctcactgcaaccttcacctcctgggttcgagcaattcttatgcttcagcctcctgagtagctaggattataggcatgcattactacttccagctaatttttttgtgtttttagtagaaatggggttttgccatgttggtcaggctggtctcgcactcctgacctcaggtgatctgcccgccttggcctcccagagtgctgggattacaggcgtgagccaccgcacccagccaaaatgtgttagttttagtagttgtcattctactgttagaaataaatttcccttctcatttttatttagtgatttattcagcactaacattgactcgtgggttcttattttatacaataagttataactcattattcgttttgatgctcaaattatctgcggatttgatcaatgcaagctgactgtaatgtcctttgatatgcccttattattttctgagtattttcttactttttggcttttttgtttattcttatcttttgggtttatgtcatactttcctttccccaactgtggaatgggccacttcttcaaggagtcctggtcctttttagttggggaatggtttttagaaatcaagatttgaatgttaggtgtgctgatttctttctttcttttttttttttttttttttttgagacagagtgttgctgtgtagcccaggctggagtgcagtggcgcgatcttggctcgctgctacctctgcctcctgggtcccggttcaagcagttctcctgcctcagcctcccgagtagctgggattacaggcacgtgccaccatacccagctaatttttgtattttcagtagagacagggtttcaccatgttgggcaggctggtcttgaactcctgacctcgtgatccacccatcttggcctcccaaagtgctgggattacaggcgtgaaccactgcgcctggccaggtgtgctgatttctactgagatgtcatttgttcttcgagcagacagtgcaggtgtatgtgctgtgtgcgtgtggttcaatccttcctttttcatagcaacttcaatatgtttactgtttttagttatgtactcatatgtactaagtgttacaatatatatacaaaattgtttcagaattgctacccctgaccactgcaaataacaaaactactaaggagttcaagatttatttgtagttctttttgtctttacattgaagttaggtggtcaaatgactccgtttagttatttggattttttttttccttctgtgagcttatgttactcatttgaaatatagttttatatttctttgtagtcagtatttattttcaccccaagtatgtgttgatttaattttattttaattttattttttaaatgtgtgtttttttttttggctgggcacagtggctcatgcctgtaattccagcacttcggggttttttgtttgttttttaaatcttttttatattaatagagatgaggtttcaccatattggccaggctggtctcaaactcctggcttcaagtgatctgcctgacttggcctcctcaaagtgctggattatgggcatgagccacggcactgggccagattttttttttttttttttaagatggagtttcactctcattagccaggctggagtgcaatggcatgatctcagctcactacagccaccgcctcctgggttcaagtgattctcctgcctcagcctcctgagtagctgagattataggtgcccgccaccacacctggctaatttttgtatttttagtagaaatggggtttcaccatgttggccaggctggtctcgaactcctgaccttaggtgatccacccgcctcagcctcccaaagtgctgagattacaggcgtgggccaccgcgcccggccggccaggttcaattttatttttgaatacataagatacattaagaaagtcctcaaagttaaaactgtcaaaaaaaaagtatgctcagaggagtcttactgcttctctcccttctaccccgttcctatccatccctttatttagataaccagtgtcattggattgtggttatcctttcagtatttctttttgcaaaaataagcatatttatacaaatagttctttgttgcacagatagtagtataatatgcatatacacttataatctgcttttttcacttaataatatgtcctggaaatactccatagcaattcatgaaggtcatcctttttattttttccaactacatagtattctgttgtgtggatgtgctatagtttaatctcctgctatgtttgggcatttaggctgtttttaaaattttctgattagaaataattgttcaatgaataatcttgtgcagtattattggaagtatatcatcaaggtgaattcatagaaataggatttcagggtcaaaggataaatgcatatgtagttttattagatactacaacttcacaccattggatttgtaccattttgcattcccatcaaaaatgtgcaaatctagctctaacattttatgattttatgaaaatattgttcttggccaggtgcagtggctcacgcctgtaaacctagcactttgggaggctgaagcaggtggatcacttgaggtcaggagttcaagaccagcgtggccaacatggtgaaaccctgtctccactaaaaaagatataaaaatttgccaggcatggtggcgcatgcctgtagtcccatctactcgggaggctgaggcaggaggatcgcttgaacccgggaggtggaggttgcagtaagctgaaatcatgccaccgcactccagcctgggcggcagagcgagactccatctcaaaaaaaagaaaaaactgttcttggccaggtgcagtggcttacgcctgtaatcccaacactttgggagactgaagcaggaggatctcttaagctaagagttcaagaccagcctgagcaacatagggaaaccccatctctatatttaaaagaaaaagaaaataattgttcttgatttctaggaaattacattctaggaagttaggctggaggatgagagtggaatgtaattgggggtggtgcagtgatagaataaaatgtttataaagatggaactgttaccaatttttaacattcttgcctttatgaaaatattgtctacacttagttgtcttaaagaatgttttctttctttcttttttttttttgagatggagtctcaattctgtttccccggctggagtgcattggcataatctgagctcagtgcaacctccgcctcccaggtttaagcgattctcacgtctcaggctccccagtagctgggattacaggcgtgtgccaccatgcccaactaatttttgtatttcgttggagacggggtttcaccatgtttgccaggctggtctcaaactcctgacctcaggtgatccacccaccttggcttcccaaagtgttgggattacaggcgtgagccaccacgcctggccaatacttttcttagagatagactatttttgcctattcttttgataatttgaatagtacagaatcagttcatgtttgttttcttcgtgcacttagggtttcttgaattcctctgagctttctggacttccagctgggcctgacagagaaggctcactcaaggatcagttggctttagcaattggtgagtatttgtaaaggttctggaaactggaaattagggactggatctcttgttatcttgttcctccaaatctaggtcaagaatcatgtgcctacaagggtcagatgatacgaacgtgagaagtggtgtgtgtgttagatgttagggaacattaggcatcttttttttttccgagacagagtcttgctctgttgcccaggctggagtgcagtggcgcaatctcggctcactgcaagctccgcctcccaggttcctgcctcagcctcagcctcccgagtagctgggactacaggcgcctgccatcacgcctggctaattttttgtatttttagtagagacagggtttcaccgtgttagccaggatggtcttgatctcctgacctcgtgatccgcccgcctcggcctcccaaagtgctgggattacaggcgtgagccaccgcgcccggccacattaggcatcttaaagagctcatacgctgctggaggaagtcccattgccaagctgtaaccaattgttatatctagggaaacggagtcctggggtcatcagaatttctaaattccttaaaagaatttagatttgtatccaaaatctcacggattttggctgtttgcaactaattaaaattattttcatcactgtgccaacaaaacaaagcatgtctttaggcagagatggccttttgacttccagctgagtacttgagtatatgctgtagggaaaatagtacattaaagattatttcctcttctttataaaaggtggcaggacaattgaggagcattgtttttaggaatttgatctttcttttcaaaaaatctggttgtgaatttgtaaagatacattcttttagagcctgttggctataggaaccacatctggatcattgtggtgggactagcatcttgctttcttcctaagtatccttgatggagggtgggtggtagggaagggttggagcttgctgggaatttactaatctgaagtttccagtcaaggcatcagttccgtttttatcaggtcatcttgtattatctatgatgtttcaatgagtcatgggtgagaaaccaggcagacagctatgtatgaggcttattaagaaattctggaagagctgggtgtttcagccttgtcagtttctgggaattaactattgggtatatgctttgagctattttaaaatttgttttggtttctggattctcctttttcatgacttttagatatgactatggctaatccaggcatacttatacagacccttttgtttattctcctacccctttctaccttttggcttatttggacttctgttagaagagaataacatcctgagagaaaggggaaaaataagttaaaatctgtttctggttctcataaataactcttgacaatgttatcttttctgtttttgatgagaggaaattgaaactatccgatgacatggtgctttgagctgtggactttttccggatagaagggatgatcaggagttgtctgtgtcagttatggagtattcaggatggtgggaaaaagcacctaattgctttggagtcagatctgagttttaattctaactctgccttgtgttactaggtgggttacctaagttctctaagcctaagcttattgtaatagtagctagcatttgagtgctatgtgccagatactatagttaatgctttatttatttatttatttttgagacggagtcttgctctgttgcccaggctggagtgcagtggcacaatctcggctcactgcaagctctgcctcccgggctcacgccattctcctgccttagcctcctgagtagctgggactgtaggtgcccgccagcacgcccggctaattttttgtatttttagtagagacggggtttcaccgtgttagccaggatggtatcgatctcctgaccttgtgatccgcccacctcggcctcccaaagtgctgggattacaggcgtgagccaccgcacccagccctagttaatgctccatatatatatatatatgtatatatatatataaatttttttttttgagatggagttttgctcttgttgcccaggctggagtgcaatggcatgatctcgctcgctgtaacctctgctgcccaggttcaagcaattcctctgcctcagcctcccgagtagctgggattacaggcatgtgccaccatgcctggctaattttttgtatttttagtagagacggggtttctccatgttggtcaggctggtctcaaactcacaacctcaggtgatctgcctgcctcggccttccaaagtgctgggattacaggcgtgagccaccacggctggctgcttttacatatattatttatttctccccaaaaccctgaaaggtaggtggtgtcatctctattttaaaggtgaggaaacaaaggcttgataaatttagtaaatgagattatgtcattgagtcacttgcccgaggtcatatagtcagtaaataggcagaactgagacctgagtcacacatacttgtgtcaccacaacctatacaacctatgtttgttgttttttttgttttttttgtttttggagagagtcttgttcccaggatggactgcaatggtacgatctcggctcactgcaacctccgcttcctgggttcaagtgattctcctgcctcagcctcctgattagttgggattacaggtgcacaccaccacgcccagctgatttttgtatttttagtagaaacagggtttcatccatgttggccaggctggtcttgaattcctgacctcaggtgatctacccgcttcagcctcccaaagtgctgggattacagacgtgagccactacacccggcctgtttttaagtaccagagtgcctggcacatagttggtgcttcataaaggtattcttcacttcccccactcccgctctcctgccccataccccttttcctctttctacaaaaactgaaaatggtatctcttcatcttactgcatatcctatgtaaatgcaaagggactgtcttccaaactgggcctcttctgtgcatattttggtaccatcacagacatcacaatttgttggtgtgttggttttttgtttttgctttaataggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccctctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacgtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttttttggttctctttcttttgatttctccagatttatgcagttttagtgctttctgctgaggctttagctagagggccacaaaacccaaaaactatatggttaacattttaggtatataacaagcaaggaatgcaaggatgagaaaaaatggagaacatgccgtgatttgcagactctattatatctaaattaagtagctgaatgtcaggcagaaattggtggataaattatttcctgatattggcactatctgctcttttctgtggccttgcaataggtataggccttcttgctttagaaaagccccttttctttcttcatttggagctgtttccagccaggcagagctgcaaattgccctcttgtgatgccaaacacagacacaaagtcctgttcagagaggtaattctaagagagaaaacaaagtttctagttagaaggaagacatgacatcattgccaacagaagttgaggaagttggagcaagagggagttctaggtggatccttgaagagggaagtagaatgaatttctcagaaaggctgttaaagatttaaattattcattggagaggtgttcttcaggtcagggagtcccattttggcctgtggcagaagcttactggattcactgctctcacagtgccagcaagcgccagtttcttgccagaaggcaataaatgggttatgtattaaggatgaattacagacatcaaattttggcagaatgaagaactaaattgagctatggttttccttgttttctgcccgtaactaccatttttacccataaattttcaaatgcatgatcgggtggatcttattgagcataaaattcttctacacatttacttaatgatttattgaatatttatatacaagtaaagattattaatatatgggctttgctttcaagaaaattgtagtccagatacttgagttgactagataagacattgtgggaaatccagagtccagagtctgtgcctaaatcaacttcttcaaggggaaaagaaatttattcttttcttttcttttttttttttttgagacagattcttgctttgtggcccaggctggagtacagtggcacaatctcggctcactgcaacctctgcctcccgggttcaagcagttctcctccctcagcctcccaagtagctgggactacaggcacccaccaccacgcctggctaatttttgtatttttagtacagacggggtttcaccatattggccaggccagtctcgaactcctgacctcgtgatccacccacctcaccctcccaaagtgctgggattacaggtatgagccaccgtgcccggccaagaaatttattcttttaactcaaatatgttaattcattcacgcaaaacttaagaatacttgctatctgctaggcactgttgtaggtgcagagaagctgagaatatgatggtgagcaagacaaacaaaggtccttccttttaaggatattactagagggggaaataggcaatgaacaagtataaagggactggagcaggtatgggaagcagtattagggtggtcaggaaatgcctccctggggaggtgatattagagctgagacctacatgatgagaaggtgctggtgctgtgatgatttgggagaaggatgttttttcaggcacgaacactagcaagtgtaaaggctcaaaggctggaataagcatgttttaaggaacagcaaagcagccgctgtactggctgaagggtggtgagtgatgagggtattggtatatgaaatgaaatcagagagctaggcaggggccagattgtataggccttcacattctttttttaaatgtagtgggaagctattccaggtgttttaaacagggccgtgccatatattttaaagatctctttggctgttgtgtggggaacggattgtaggaacaggtggaaaccagttggattgtagtaagtagtccatgatagctg

SEQ ID NO: 16524 - DNA, 47032 bp, Human
ctgggattacaggcactgcgaccattcctggctaattgtgtgtgtgtgtgtgtgtgtgtgtgtgtgtgtgtgtgtgtgtgtgtgtgtgtgtttagtagagatggggtttcaccatgttggccaggctggtctcgaactcctcacctcaagtgatctacccgcctcagcttcccccccagagtgctgagattacaggcacgagtcatggtgccagcctcatttctattaatttcttaagcaaatcaagagcatacattgtggcattgtttgtagtggcaaaagattggaaacaacctaaatgtccatcataggaaattcatgaaataaaactacctcatgtatccagaggaataccatgaaactgttgaagagaatggggacatagtccttgtgtgctgtgacaaaacgatctccacacacagtattaagggaaaaaaagtacctggcacggtggctcatgcctgtaatcccagaactttgggaggccgaggtgggcggatcacctaaggtcaggagttcgagaccagcttgaccaatatgatgaaaccccatctctactaaaaatacaaaaattaaccaagtgtggtggcatgcgcctgtaatcccagccacttgggaggctgagacaggagaatcgctagaacctgggaggtggaagttgcagtgagcccacatggtgccagcctgggcaacaagagtgaaaccccatctaaaaaaaaaaagcaaggcgccattgggaaggggaagtggggcctgcatggctgaattcagagaaggaagggagtcttggttatcagattatctctgcagctgatctccaaacctatttcccttcttcctggcacaggggccactcatttcccagactcttttgcatggaggcatggttgtgtgattgaaatccagccaggcgagcaggctcagcccacagaaacctcccatgggccacccccatgccttttcttcctctggtttgtgtggaatggtgctgagcccccagggcgactttggtggaatctggtgttgaaatcagagtcccaccgccgggcgcggtggctcacgcctgtaatcccagcactttgggaggccgaggcaggcggatcatgaggtgaggagatcgagaccatcctggctaacacggtgaaaccccgtctctactgaaaatacaaaaaattagccgggcgtggtggcaggcgcctgtggtcccagctactccggaggcggaggcaggagactggtgtgaacccgggaggcagagcttgcagtgagccgagatcgtgccactgcactccagcctaggcgacacagtgagactccgtctcaaaaaaaaaaaaaaaaaaaagaataagcaaatcatgcaaatcatcctgttctaaactctgaaccgctgcttccaagaccgtccctgcccttgccctggccgcctctctccttgttaactgggctccattcattctttccatttctctaacacgtgccaggtggtctcatctcctggcctttgcccttgctgttccctgtcatcattcaggtctcacttgtcatttcctgaccatggtacttataaaagcagtgccgtctgccccatccatgtcacctcgttcatctccttcacctccgaaatgatctcgcttttgggtttacggccggtctcttcacctggagcatcagccgggaaggtcagggtcgccctggctcgggcctgttcacattggggtcaaaggcacacattgggggctcaaccaaggcgagctgcgttcgcggggccgggtctttccgcacaggcggagggcggtggcgggcgcggaggcgtcgcgcgagccagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcacttttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccatcggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatatagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttactgggtaactctttgtccatctcaataaccaaaggaaggtgggcatggtggctcacgcctgtaatcccagcactttgggaagccgaggcgggtggatcactcgaggtcaggagtttgagaccagcctggccaacgtagtgaaaccctgtctctcactaaaaatacacaaattaggcagtcatggtggctggcacctgtaatcccagctacttgggaggctgaggcaggaaaattggttgaacctgggaggtggaggttgcagtgagtggagatcatgccactgcactccagcctgggagtcagagcgagactccatctcaaaaaaagtaaataaatgaaatagcctaaggaaatgctggcaggcagtaatgatatggcacactggatatgatttctgcccctcctctgctgtgggtaaacagcttctgtttcatgcatttacttttttattttaattacaccaataagaatgtgcttgaatgtttcatgcatttaatttgtttcatgcatttaacttctggcctgtttacctgtagcaggctctgagatgtgctctagagacagaacctaaacatgatgcccaagagaggggagagatactgaatgtccaatgttctcaaattttttttttttttttttttgagacagggtcttgctctgccatccaggctggagtgcagtggcacgatcatagctcactgctgcctcgacctcctgggctcaaatgatcctcctgcttcagcttcctgggctaatgtttgtattttttgtggagatgggactttgttatgttgcccaggctgttttcaaactcctggactcaagtgatcctcccgccttagcctcctaaggtgctgggattacaggtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatacaaaaaaaaaaaaaaaaactagccgggcatggtggctcatgcctgtaatcccagctactcaggaggctgaggcaggagaattgcttgaacctgggaggcagaggttgcagtgagccaagattgctccattgtactccagcctgggcaacaagagagaaactccgtctcaaaatataaataaataagaaaaagaagaaatggaagctgggttcaagagggcaatcagcagtctctaccatcatgtgaaacaccactctgtgatttgagtcttgacaatgtattttctttttttttttcttcttttttttttgagactgagtctcggtctgtcgcccaggctggagtgcagtgacgtgatcttggctcactgcaacctctgcctcctgggttggagcaattctcctgcctcagcctcctgagtagctgggattacaggtgtgcgccaccatgcctggctaatttttgtatttttagtagagacggggttttgccatgttggccaggctggtgttgaaggcctgacctcaggtaatccacccacctctgcctcccagagtactgggattacaagtgtgagccaccgtgcccggccaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggc

SEQ ID NO: 16525 - DNA, 7661 bp, Human; identical to SEQ ID NO: 14822

SEQ ID NO: 16526 - DNA, 7661 bp, Human; identical to SEQ ID NO: 14822

SEQ ID NO: 16527 - DNA, 8474 bp, Human; identical to SEQ ID NO: 12567

SEQ ID NO: 16528 - DNA, 19503 bp, Human
agaaaaaggatatgaagtccttaagactaatggagccacaaacaatagcagaattcatcaaccagggctacatggatcaaccagcagagtgcatatgttctcaaagtgcccagataactctctaccttctcagcaacaagtatagaggcaggtaatagtactgacaggagcagcatcttccatttcaaagtgaacaacttgtatataagaaaaacacatcccatttggggcacatcccagaaactcccaggaacctaggacttaaagaagaggaagattaaaaaaagaatggcagaagtattcttttattaatgaattgttcttattaaagaaaattaataagctgcttctcctaggatcttctagttaggatttttgaatgcttaaactgtagtttctggactaaaacagtgaatgcttaatgtggacaatcgcataactgaagggatgcatgtgactgtgagggggtgacctgggtggtgggaaaagttggcaaggtgtacaaactgctaaacaggacaaaagggaaaattctgttcatatatcagaaatatcggagcagaacttagctttgaatctcactaattcagatggccttttgaacttatcagataaagggcttcagtagtggaaaaaaccgtaaatcagagcatcctgactgctaactgccagagaactgactgggcatgggggtggggatgcaaacacctctgcagtcagctgggctaactggacaccaatagggatggggcatgaggaaagccctaccttacagagaaccttggccatctcaaaggtgcccacagtatccatattggcagcaatgatgggaaccccagagtatgtctgctttgagttccgaaatgaaaaggatcttgtgagatccacctgcagatatgaacaggaaattgaccatttcattaatccaaaaaacgtaccatattaggacaaggacaggcatctttcttggttgtggcccaccgggagcgtggggtcaagaaacagcaagtagagaagcttgctcacctcacttcgagacttaagggtactgcgtttgggcctcaaaaggacatccttgaagtccagtttcacatcgttgtcaatatgaggcatggcgcttagcctcggggtagcgatgaatctgagggctggaaggcaggaagtcataaggaccaatcttcccctgggctttaacgccctgttacggctggtggcctctcttcgcttaagttgtggaaggtcgggcaaaggccgaagtgtggtccctgaagcctgtcacctcgacccatcccgtggctgcgattaccctagggctccatcccaggtactgtttgttggggaggagagctgggaaagggttgtgagagaccctgacggtgcattccttaccccgctacacttccttcttctacccctgcaaagagcaatggggcaagaggctgatttaggggaacgaaggaatgttggcgacggggggcggggagggttcataactagtttccggaatagaggtactcacttcctgttgccttggtccaggcggcagttgaccaaagaccaccttgcttagcaactaacctcgtgcaatcccgctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggaggggggggggggggtggagccagacagtgacccggaagtagaagtggcccttgcaggcaagagtgctgaagggcggcagcggcgaccggagcggtaggagcagcaatttatccgtgtgcagccccaaactggaaagaagatgctaattaaagtgaaggtgggagcacctccagccttgccaagacgcagtagtactgggctggcagcagtgccttacgggagacgtggggaaggaaaaccacgcctttccctagcctggaggacgctgactgcctcagggctccgcgcgaggggtggtgggaaatagggggacccagaagggctttgagagcggggcccaggtcccacctgacgaccctggggtattttgccatgcctgcttttttgccaggactgtgctatcacccagaatggggtcgcttttgtcgggtctcactgtattcgaacccccgcagtcatagagaaggcctagcagcggcttgactcccccgtctctcagattcttggagtaagcgctgctctccattcttcattcccagggtacctgcttctcccagtccctaacgtaggtcgcctccgagcacagccctaaaatcggggcctcccaagggctagactatgagcctttactggtggttgccaaggtgtggtatctcacccgtcctacaggaaccaaagcggggagtgtgttcagtcagtacctgcctttctgagcctggcatcctggaccagcctcacttccttggctgaggcaggttagttaccgctgccctagttcttggtactagccatggtttccttcatctgcatctctcaactcccgtggtggttcttcaccaatttccagccctcgttagtcctatctgctgtttcctcttttgtgccttcagacagacagagacccccccccccacgcccccctcaaaaaaacaaaactgctgacaagtgaagtctaatgctagtttggcctttttgtagctaagtaaatctatcgttatttcatcagcttcttagcatatttaccgtacataatagtcattcttaaccttctcttccccagtccttccaaactacttcttagctaagatttgaggtctagtattaaaatagtatgttaaagatgattttttttaacgttgagtagcggcctatataagagtcgtaacatcaatttaataggtgaatgggtcactggcgccattaaaaagagaaaataggctgggcgcggtggctcacgcctgtaatcccagcactttggaaggccgaggcaggccgatcgcttgagcccaggagttggagaccatcctgggcaacatggcgaaaccctgcctgtacaataaattcaaaaaattagccaagggtctgggcgcatgcctgtaggcccagctattcgggaggccgagatgggaggattgattgatcctgggatgtcgaagccgcggtgagcagtgatggcaccactgcactccagaccctgcctgaaaaaaaaggccgggcccagtggctcacgcctgtaatcccagcactttgggaggccgaggtgggtggatcacctaaggtgaggagttcaagaccagcctggccaacatggtgaaaccccgcctctactaacaatacaaaaactagccgggcgtggtggtgggcgcctataatcccagctactcggaggctaaggcaggagaatcccttgaacctgggaggcggagattgcagtgagctgagatggcgccattgcactccagcctgggcgacaagagtgaaactccatctccccctgcaaaaaaaaaaaagaaagagagagggggagaaaataggaaataatatagtgctaggtaaggatattgttttatgattttttttttttttttttttgagaaagagtatagctctgttgtaaaggctggagggaagtggagaaatataggataaatgaaatattagaataaagggggaaggaaaggagaaggaataagaataaagaggttgatggggtataaaggtgaatgtaaaaaagaaaagagaattttggtgtatttttagtagagacagggtttcaccatgttagccaggatggtctcgatctcctgacctcgtgatccgcccgcctctgcctcccaaagtgctgggattacaggtgtgagccaccctcccccgtgcctggcctttttttttttttttttttttttttttgagacagagtctcactctgttgccaggcctgaaattttttattttattttatatgtatattacacagggggtgttactagttcatactaatttttagaatggatcactgtcaaaatcttgagaaacactaactgttgaatatttttatttgagacggagtctccctctgtcaccaggctggagtgcagtggcgcaatgtcggctcactgcaacctccgcctcccgggttcaagcgattctcctgcctcagcttcctgactagctgggactacagggtgtgccaccacgcccagctaatttttgtatttttagtagaaacggggtttcaccaggttggccaggatggtatcgatctcttgacctagtgatccgctcacctccgcctaaagtgttgagattacagtcatgagccaccgcgcccggcctgttgaatacttctgttggcttttcaatgcatatgggttctcatgtccactaggtccaaagaagttaagttactaatgctaagtgttttgtacactttttgaaaatttcactccacattaagaaattttatgtcacaacccataaggcacaaaaactttgctatttgtgatatgctctcagactttcaattctaagttgatttcataacccactgatgggttgagacctgcccactgatgggttgagacctgcagtttaaaaagtactgtttgaaaggccaggcgtggtggctcacgcctgtaatcccagcactttgggaggccaaggcgggcggatcacgaggtcaggagttcaagaccagcctggccaacatggtgaaaccccgtctctactaaaaatacaaaaattagccgagtgtggtggcacacacctgtagtcccagccacttgacagggtgaggcaggagaattgcttgaacctgggaggcagaggttgcagtgagccaagatcgtgccattgcactccagcctgggcaacagagtgagactgtctcaaaaaataaataaataaaataactgtttgaacaaaaaaatcaatgctgtgtgtggaaacttgaaaatacagtgtcctatcacctgtggtcttgctaaaatgctgattatgattctgtgggtctaaggtggggcacaggtttctgcatttctcacaaactcccaggtgatattgaatgtctgagagctacactttgaatagcaagattctagattttttctgtttctttgaatccatatttatgtggtacttctctaaaattgccagtcttctttcctgcaacacccttctgccttcaaacaggcctctgtgccccatctctctctatctccccctctcgccccatcccctcttgtttgttgcatttcttaattaaatacataggaaagtagttacacatgagatagctgttaatctgatctgaagaaaatattaatttaaaaaagaaaaaaaagagctgttaattaccatataagtgacattttttattacagttcctttttttttttttttttttttttgagacaggttctcactctgtcgcccaggcttagggtgcagtggtgccatcacagcttactgcagcctcgacctctcaggcccaagcaattctcccatctgagcctcctgagtagctgggactacaggcgtgtgctaccaccatacccagccaattgttttatttttttgtagagatgcggtctcatcgtgttgcccacgctagtctaaaacttctggggtcaagtgatcttcccacctcatcttcctaaagtgctgggattacagccgtgagctaccatatctgacccctttttgaattattattatttttgttttgttttgcttttgagatggagtctcagtctgtcgcccaggctggagtacagtggcacgatcttggctcattgcaacctccgcctcttgggttcaagcgatgctcctgcctcagcctcccaagtagctgggactacaagtgcccaccaccatacccggctaacttttgtattttagtagagacggggtttcgccatgtttgccaggctggtcttgaacgcctgacctgaggtgatccacccacctcagcctcccaaagtgctgggattacaggcatgagccaccgcgcctggcctcattttgtttttgttttgagacattcttactctgtcacccaggctggagtgcagtggtatgatctcggctcactgcaacctccacctcccaggctcaagggatcctcccaactcagcctcccaagtagctgggactacaggtacatgccaccacacctggctgattttctgtatttttagtagaggtggggtttcaccatgttgcccaggctggtcttgaactcctgagctcaagtgatccacctgccttggcctcccgaagtgctgggattacaggcgtgagccaccatgcccagccgaatgattcattttcaactgctgtctctgtgtagctgacttcttccatatttttctataagattttacaattaaattcttcctgatttaaatcttgttaccttgtctctatggttctaaaattaaatgcatcatcttctgtcataagccatatcccaatacccatctcgtgtattaatcccatcaatcattcaggtgtctggaatacaattctttagagtcatttaaaattacgtggtccttttataagatctaatttttcacttaaaagctctttctgtttgatttttgtttccatctccattaccctcattctggtctcgggtcttactcatttatatgtttatgtctctgtaatacatccaaccaggttttcctaccgtcatatcccctctaaagtgtagtctaaaccaagacatgacgtacaaaaccataatgtgcaggtcttcctttagcttctttttcattatattactccctaaccccagatccttcattgatttcctcattgcagattactttggcaactgtctttactgtgtgaatcagttttctcattcatgttttttaacatacagtaaaatgcacagttcttaagggtttagttcagtgagtttttgacaatagcatacgttcatgtaattacaaaatctaaacatttgtattcctaccccctcaagagtttcataggttagttttgcttgttttagaactttatataaatggaattattgaatgtacaatttttgtatctggcttctttcattctgcataatgtctactgtaatctgtggtttattccttcttattactgaatagtattccattggatgaattatatcataatttgtttatccattctcctgttgatgggtgtttgagttatctccagtttctggctattatgaaaaagtcttctatgaacattgttatacgagtgtttttgtaaacatatgtttttatttcctttggataaatacctaagaatgaaattactaggtcatgtggtagatatatgtaactttaaaaagaaactaagggtttgtaccattttatattcccacctgcagtgtatgagcattccagttgctctgtacccttactagacggtacccttgtagcaccataaaaatgctgatgtcagtcatttttattttggctattatagtgttataatgttatataaattaaaacactatatctagtgttatataatgttatctcattcaaggcttaaattgattaacattgattttcattcaccatagcacttagtcattgccccttgtgtttggacaatatagtacttccttttgttttgttttgttttgatttgtttttaatttttaattttttttttttttttttgagatggagtctccctctgtcacccaggctggagtgcggtggcacgatctcggctcactgcaacctccaccttcgttcaagcgtccaccatgcctagctaatttttttgtatttttggtagagacagggttttgccatgttggccatgctggtctcgaactcctgacctcaagtgatccacctgcctcagcctcccaaactgctgggattacaagcgtgagccactgtgcccagccagaacttccttgtatacagccttattctattaattttatgtctaattgtttcttggttgtacatcttcgcttgataaagattgttggcagggctggatcacatttcttttgtatttcctccagtgcctagggcagtatgttaggtttaggttcatcttttttttttttttggagatggagtctcactctgtcacccaggctggagtgcagtggcgtgatccctgctcactgcaacctccacctcctgggttcaagcatttctcctcctcagcctcctgcatagctgggatacaggtgcgtgccaccacacccagctaatttttttgtatttttagtagagacaagttttcatcatgttatccaggctggcctcgaactcctgacctcaggtgatccgcctgccttggcctcccgaagtgctgggattacaggcgtgagccaccgcgccctgtctaggttcatcttatacttgtttaaatagcattgaatgtattgtcaggttacagtgtgatatatcaagaatatcttctaaaattgttcaactgctttaaaacaacttcatggacaatttcaaagacatacatcaggaaagagaagggtgtatgcacccttcatccagcttcaaaaattatcatctcatagccaatcttatttaatttaaactcaccaactccttttacctgatttttttaaagcaaattccagctagcatagcatatgttattcctacatatttcagtgtttttctgtgaaagataaccttttttctaacataaccgtaatttttacatccaaaaatttaactgattgcttactatcatcaaattaccctattgtctctctctctttttttattaacagtttgaatctggatccaattaagatccatacattgccattggtttatgtgttttcaatttctttaaatccgtagattctcctttttcccatttttttcttgttgaatagagtttcctgcagtttgaattttgctgattacattcccatgtttttctttttttctttttttttttttttgagacagagtcttgctctgtcacccaggctggagtgcagcagtgtaatcttggctcactactgcaacttctctgcttccagggttcaagtgattcttgtattctcgtgcctcagcctcttgagtagctgggactacaggcatgcgccaccatgcctgactaatttttgtatttttcatagagatgacattttgccatgttggccaggctggtctcaaattcctggcctcaagcgacccgcccacctcggcctcccaaattgctgggattacaggcatgagacaccacaacgggctcccatgttgtcttttgacgtattcctcttttcctctgtatttcctgtcagctggtaattagatctagaggcttgattaatctttgtatgttcatatgtgagaagaattcataggtggtgatgtggtatgtacttccatcagattgttttgctttctgtgatgttagtcatttcctagatacattgtttcattgggggttacaagctggaggtactctaatattcttgttgcttcatatattagctggaatatttgaacagtgtccaaaatggtagccattagccacatttggctattgagcacttgaaatgtaactagagagactgaagatttgaaattttgattgtacttgattttaattaaatttaaaaactgaaacttagccgggtacagtggctcacacctgtaatcccagtgagttaggaggctgaggtgggaagatcacttgaggccagaagtttgagaccagcctggacaacatttcgagaccccatctctacaaaacaattttcaggccgggcatggtggctcatgcctgtaatcccaacactttgggaggccgaggcgggtggatcatttgaggtcaggagttcgagaccagcatggccaacatggtgaaaccccatctctactaaaaatacaaaaattggctgggcgcggtggctcacgcctgtaatcccagcactctgggaggccgaggcgggcggatcacaaggtcaggagatcgagaccatcctggctaacacagtgaaaacccgtctctactaaaaaatacaaaaaattagcctgggcgtagtggcgggcgcctgtagtcccagctactctggaggctgaggcaggagaatggcgtgaacccgggaggtggagcttgcagtgagccgagatcgtgctactgcactccagcctgggcgacagagcgagactctgtctcaaaaaaataaaaataaaaataataaaaaatacaaaatacaaaaattagccaggcgtagtgacacgcggctgtaaccccagctacttgggaggctgaggcaggagaattgcttgagcctgggaggcggaggttgtggtgagccagatgatgccacagcactccagtctgggtgacagactgagaccttgcctcaaaaaaaaaaaaaatttttttttttttccaaaaaagaattagccaggcatggtggtgtgtgcttgtagtcccagctattcagaatgctgaggtgggatgatactttcagcccaggagttggaggctgcagtgagccatgattactccactgtgttccaggctgggacacagagcaagactccatctcaaataaataaataaataaataaatataaaaaacttttaagtatgtttagaacaagttgggtgtataaatctactttttctattgtaaattatgaaacttaaatatatgtcaagtatttcagatgaaaatttaccatttgaatttttttgtttttctgggttttttttggagatagggtctccctctgtcacccaagctggagtgcagtggcacaatcagcccactacggcattgaactcctgggcttgggcagtcttgcctcagccttctgagtacccagttgctgggactacaggcctgtgccactatgcctggctaattttattgtagagatggggatctcactatgttgcccaggctggtctcaaaactccaagcctcaagcagtactcccacatccccttcccaaagtgttgagattacaggcatatgctaccatgcccagcctaccatctctatttttttttttttttttttttttaatgcagaggcttgctctgttgcccaggctggagtgcagtggcatgatctcagctcaccgtaacctccgcctcctgggttcaggcgattctcctgcctcagcctccccagtagctgggactacaggcgcccaccaccatgcccaactaatctttgtatttttagtagagatggggtttcactgtgttggccaggctggtctcaaactcctgacctcgtgatccgccccctcggcctcctaaagtgctaggattacaggtgtgagccaccgcacccagccccatctctacatgtgatgtaaatatgaaatacaggatttttaggatttggttagaaaaaacataaaatatattaatttttatattgattacatgtgaataatattttggctatgttgggtttaaaaatattaaaattttacctcttaaagaacttttacaatatggctactagtaaatttaaaaattgcatgtatggcttgtattatatttctacaaggcagtgctgctttacaaaatcttacccttatcaaggacattgttttttaaataatttgttctcattacagcatattcacatttgtggtataaaaaatggaaaatacagaaaagcataataatgtaattaaaatcacccataattccactgctcaagttaaagcattaatatactgtatatacccttccaagctttttggagagcatatagatgcatgtgttgtttttacaaaattttaattatactctatatactataacttttttgttaaattatcagcatattgttaatatattacaaatagttatcctaaacattgtttgagggatttgtaattttttttctatgattgtaccataatttatttaaccctcaactgtttgatatttagattgtgtttctaattttacagtatcaaaaggttgcaataaccattgttgtaggtatacttttggacatagtcatgagtattttcctggaagtattgttgctgggacaccatattgccaaattgctctctagatatatttatgggcctctacagtcgatttcagaaacaaagggccagctctagacttttagaatttacaaaccaataatcctttttaaaaatataaggtccaagcattttgctcttgggagagcagctctaggtcttctctgagagtcttttttcactctttaaaaatttgtggtcgggtgcggtggcccacatctataatcccagcactttgggaggccgaggcaggcagatcacctgaggtcgggagttcaagaccagcctgaccaacatggagaaacccttctctactaaaaatacaaaattagccaggtgtggtggtgcatgcctgtagtcccagctacttgggaggctgagataggagaattgcttgaacctgggaggcagaggttgcagggtgagctgagattgtgccgttgcactccagcctgggcagcaagagtaaaactccatctcaaaataaataaataaataaaaatttgtattatcggccaggcacggtggctcatgcctataatcccagcactatgggaggctgaggcaggtggatcacttgaggtcaggagttcgagaccagcctgggcaacatggcaaaaccccatctctactaaaaatacaaaatgtagtcaggcgtggtggtgcccgcctgtgatgccagctactcaagaggctgaggtggggatcacctgagcccagtatgtcgaggctgcggtgagccatgattgcgccattgcactccatccgggtgagactgagaccccgtctcaaaaaaaaaaaaaaagaaagtgaaataatttgtggacaacacagaattacaaactttttattttgtctttttaaagttaccacaaattgtcaccaccattctctgaaaggacattaacacctgaatatatttagtttcatgaaaatttcacttttaacactgcttttctcattttaccataggctgctgaaaattttcacacagaccagcataggttagggtagaagcttgagaatcactgctgtaatttattctttcatatccaaacaggttaatccaaaggaattgttcttgtatttttggaaacatactagtactaaatcattctccttgttgggaaattttctgagttcttgtttcgtgctgttctatgtgaataccataaggagaaaccatatgttattttgtgagctactataggagtgtacattgggtcccaatactagaccagccagactcaggtaggacggagtacagaaataaaagcacaggctctgggaccagggaatctggatccaatctctacttttgattgcgtagatgtgtttttaacctaaggcttatttttctcatctataaaatggaaatagtaatagtccatatctcataaatactgggaggattaaatgtgatgcatgtaagatgctgatcatagttactgacccttagaaagtgttcaatggctgggcaaggtggctcatgcctgtaatcccagctctttgggaggccgaggcaggaggatcacttgagcccatgagtttgaaaccagcctgagcaacacagaactcgtctctacaaaaaaatcttaaaaatagctgagtgtggtggtgcacacaccctgtagtccttgctacttaggaggctgaggtgggagggttgtttgaacccaggaggtcaaggctgcagtgagccaggatcacaccactgaactccagcctgcttgatacagtgagaccctgtctcttaaaaaaataaaaggaaaaaaatagttttcagtaaatgttagctgtgattataatatgatcatcagtatatttagcccttcaaaaatattcattgactgcttgtgtgtcaaacactaggaaagtttaacacttaaacaactagctgtaattggtatattaatattggaagtattaataaagtacactgggaacaggtctacacatcatacaggaggttttatacattgctggagtgcaatggcacaatctcagctcaccgcaacttctgcctcctgggttcaagagattctcctgcctcagcctcctgagtagttgggattacaggcatgcgccaccacgcctggctaattttgtattttttaatagagaaggctttctccatgttggccaggctggtcttgaactcccaacctcaggtaatccacccacctcagcttcccaaagtgctgggattacaggcatgagccactgtgcccggccaggaggagatcttacatttaaggggtcttgaagtttggagaagaaggggaggatattgcaacaaggaaaataacggaagcaaagaaatgcccataaattagaatgagcatggtgtgtttgtggcctggatcactgtagactaatacagatagagctattaagagcaaggacagatgggagaagacacaacatttatgactgcataatcagtataattattgtatttggatatcaccagcccttaacttacggaagaagacaagagctgcaatttaggatttaggtagaagtctggaaagatatgggagatgtaatgttgacttcttgtcttcttttctcttttttcttttactttcctttttttttttttttttttttttttgcgagggtgttgcccaggctggagtacagtggcacaatcgtggcttactgctgctgcctctaatttctggactcaagtgatcctcccacctcagcctcccaaatagctggtactacaggcatgcaccactgtactcagctaatttttgttgttgttgttgttgttgttgttgttttggttgagacagggtttcgctgtgttgtccaggctggtctggaactcctaggctcaagtgatcctcccgcctcagtctcccaaggtgttgggattgcaggtgtgagccaccatgcccagccaattctagcattttttaaaaaactgctgagatgatttctggtgtccttgagaattcttcaaattatctgaatattaatttctagcattgatatttagaacaaggtccttctgactttttttaagatatctttcaggctgggtgcagtggcttacccctgtaatcccagcactttgggaggctgaggcgggtggatcacctgaggttgggagtttgagaccagcctgatcaacatggagaaatcctgtctctactaaaaatacaaaattagccaggcctggtagcgcatgcctgtaatcccagctacgtgggaggctgaggcaggagaattggttgaacctgggaggcagaagttgcagtgagccgagattgtgccattgcactccagcctggtcaacaagagcgaaactccatctcaaaaataaataaataaatcctttcattgccgtatcatctaaaataatgccaatattctcactgattttgggggactgatgttggaagatgactcatggaattaagaggatcagatggttcaaagaatcttgccctatcaaagttgtttacagcctaaaaatatttgataaatgaaggtatgttcaaagccttctcattctccaaagcagtgctgctgagaatatgcatcttttagaaggcagtagatcccaaagaccaacataggatgttttacctagaagacaaattgtacattgggctttaaggactcatgaaaccattgcctgtttcagacgctgaccggaaaggagattgagattgacattgaacctacagacaaggtgatgcatgcccaactcctcttcatgtacttcttgccatgtgtatttgtttgcatatgcttatgaacttggtccttttgctctcatgctgtctgcatagcccttgttctttccgtttccatggtcctacccctaagcagcagcccctgactacttgtctctctaaaggtggagcgaatcaaggagcgtgtggaggagaaagagggaatccccccacaacagcagaggctcatctacagtggcaagcagatgtgagtttggagtgagaatgacagcatggcgatcttatgtgaagatgagaagaggagagggggcacgtactgaggtggatcaggggtgcctcttgtttttggtgcctaagactctttggcaatctggtgaagcctctaagccccttctcagaataagattttttcaggcataaaacaaaatatatagaattaaaggaaaactaattatattgaaatagttattaaaatactaaaacaaatttgtgatatagtaatatatgtacttttttattaatgcataagatctaatggtaggtctaatatgaccataattttgaaatattttcaagatacctataaatgatcatgatagaaaatagttaattgctattgttaacaagttacctatattgctaatactactgtggtttttgggctatgtttaaagttagaagaaatgttaaatttcagttgggggttagtaaaaataaagatgggattttttttctcattcaagttcacagacccccaaagagatccaggaaactcaagaactcctgttctggccgggcgcagtggctcacgcctgtaatcccagcactttgggaggctgaagggggtggatcacctgaggtcaggagttcgagaccagcctggccaacatggtgaaaccccatctttactaaaaatacaaaaattagctgggcgtggtggtgggcgcttgtaatcccagctactcaggaggctgaagcaggagaattgcttgaacccaggaggtggaagttgcagtgagctgagatcgtgccactgtactccagcctagatgacagagcgagactctgtcaaaaacaacaacaacaacaacaacaacaacaacaaaaaactcctaagtcttctttttcttttttttctggcttccttttcctgcaggaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaatctttcttctgttgcacaagttgactgaaataaaaatggacctaatgctcactcagttatagcaggctgaaggaatcggacagtggaaggaatggtgctcttacggggattatcagactctaggaaaacctacttagtggtgtgttggaaccagttcctagtggctaatgagagccaattattggcacctttttccaactctattaagtgacttcatgttggtagcttgaaattggccatggtaggattatttacagaaactagcaaacactacagatcagttcctccccacaaactggttgttatacatctaccagtgtagtgctgacatggatggtgaaaccttcggagagtgaattctctcttgactgtggctgtactggacatttaggcctggttggagaacgccttcaagggtttggctgacactgtactctatggctggaatattactgaggactttgggttctacactgtcaggaggttgataatgcagaaagattgagtgacaagctgtgatgtatcacttgggtctcaagaagaggcaggtgctagaagaaaaggctttccttcttccctggcttcttagtataatagaatcgggcaaggctgggtggagtggagaagtagggaggatgcccgtggccaatgccttagaaagacttgactgctgtggttgcatgtgtggtcgtgttggtacctcgctgcaatcctcttccccgcccagcatcagatggcactcttgcgccatctccaggctgatgacgccccgagtggcgacgctctagtcgccatttgtctatggcaggcagggtggctgccttagctgccggaggttccgcactctctaaggccccgggtgaagccccacctctgctgcgcgcagcctgcggtgcgggtcatggcgcggctaccgaagctggcagtctttgatttgggtgagggacgggaaggggagaatttcgtaaggtgctctccttttccacatccctaacagcagctcccgaatccctgcatctcccgccccaggctgaaccttccctctccttcctctcgcagattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggtaagaagagcgactgacaactgacagtgtaatgctgaagggtgcatgcaagagacagtgaaacccctggtctacaaaaataggggcggtgcaagtttccaagtatttacatattttttcccttgaacgctctcctgtgccttttaactattaaaaagtggggccagcaggcgggcgcggtggctcacgtctgtaatcccagcactttgggaggccgaggcgggtggatcacgagatcgggagttcaagaccagcctgatcaacatggtgaaaccccgtctctactaaaaatacaaaaattagcagggcgtggtggcacgcacctgtaatcctagctactcgggaggctgaggcaggagaatcgcttgaacccgggaggcggaggttgcagtgagctgagatggagccactgcacttcagcctgggtgacagagtgagacaatgtctcaaaaaaaaaaaaaaaaaaaaaagtggggccagacacagtgactcacacctgtaatcttagcattttgggaggcctaggtgggaggatcacttgagcccaggaatttgagaccagcctaggcaatagagggagaccctatctctaccaaaaaaaaaaaaaaaaattgtagtggcgtgcacctgtagtcccagctacttgggaggctgaggtgggaggatcacttgagcccaggaggtcg

SEQ ID NO: 16529 - DNA, 10267 bp, Human
gatgacctcgcagctgtcagaggatatgaaaaaaatgggcagaaaccgcagcaagaactgaagtcagagttcaggaagggcttcctgaccgcacgggatgtgagagaatggcaatgtgcaacaaaggaagttaaggaacctctgcccagtgcatgaggacagaaagaatcccgtgaggcctgtgtttggggacagaaactccagggtcaaccagaggccccttcagacagaaactgggttgtccttgcctcctctctcaagctgttccccacccgcatctaccttgatggcctttcttccccacacccaggaccaggcactctaagcatactccctgctgttctagttcacaggtgctagttcatcccagttttggtagccctagcatgaccctggggactgggtttcttttgctgttttgacttctgtctgggaagcagggaggtgtgagcagtcgctaaagtagagcctggggtgatggtcagggtagccacttgagcggccaaccatctcagtttgttgggaaaccggcagggctgggacaaggagttttcagtgcttaaactgggaaagttccaggccaactgggatgagctggtcaccttagtgaccacagatgtgtacttgtggatgtcccctgaaaagaatcccattctacatcccccaatcaaaggggtcaggatctagaaccgtttttagacctagataaggattccaaaaggtgggggcagagaagtattggggaacgggctaggaatagctagcagcatcttagaaggagcccagacttggcaaagagaaaaagaatatgtggcacttctctgaaaaattattcctgtcctctaaatattcctgccattcctcataccccaatggccaacctccaaacttccctgactgagtgcttgctcctggctccttttcacgtcaggtggcctttgcagggaggatcagatggtcagggggcaaggtaagtctcagactcccagggcccctacaccactgtccactccttgtgtgcctgtctcatactcactggaccaaatacaagacaggcaggaaaacttccttttcaaaccccacagattcattttccccttcagagccatttcctcctcagaggcttttataagcctcagagaatggatcccattcctacccctcatccaagctcccatacctctccttccattttctcctttatttccagagtggttctatgggttggcctgtggaaccagggcacctgggctgaggagggcaggtcaagatgccactgaaggctggcactgcccagcctggcttgacccagcagggaactaggtggcttcagtacaactcaggcatgaagaaccaccaggggaagcacacttaagtcatcatctaatggcttcccagtgtatttcacaataacagctattggcaacaagtaagcaatgctggcacatgggtacatgccaacttgcaagcacacaatagtccttaacagggaccatcaccaccctcataatccctcagtttggaggagcctgggcctgccccaagtgtatagtaatcctacccagccagatccaaactctagtcaaagaagggtccccaaatgtcccagaacactgacctctggagggtgggtggggggtggaaagggacagggaagggcagcaggttgtagggtctgctgtcaaaggtcccattccggaccgtccttctccatcccaccccccgggtctccattgccgcggccctgccccaccactttcagctgaggggtagttcggagctccatggtcccttccctagagcggccgccccctcgggcctccccagagccttcgaagagccgcgtgaggaaacggggacctgcccggggcagcagatctccagcggtgaagacgtagagcaccgggttgacgctagaactgaagaaggccaaggccgtagttcccgctcgcgccgcctggccggctccgcccagcttcgccaaggccccttccggtggagccagcgctgcgaccgcctgcagaaggttgactgcgtggtagggggcccagagcaagccgaaggcaagcacgatggcgctcaccagccggcccacccgcgccccgtgccgcccggagccccagcgggcgccccgcagccgtgccagcgtcacgctgtagcagccgagcatcagcccgaaaggaagcacgaaagcggtcagagtctccaggctcaggtgggcggcggcgtggaccggcgacgggtggcacagctggcatacgcggtccctccacaggtggcggtagacggcggccgggacggcgagcaacagggcggccagccagaccgccagcagcaggcggcgggccagggccgggctgcgcagccgaggcgccaggaaggggcgggtgactgcgaggcagcgctgcaggctgagcaggccggtgagcagcacgctggcgtacatgctgagcgcgcacacgtagtacaccgccttgcagcccgcctggcccagcggccaggcctgccgggtcaggaaggccacaaagagcggcgtgagcagcagcaccgcgccgtcggccagcgccaggtgcagcacaagcgtggccgccagcggtcgcccccgtgcaggccgccagcccgccaagctccacaccacgaagccgttgccaggcagccccagcagcgccgccagcagcaggaaggctgtgcctgtggcccgcgaagtcttccagctcagcagtgtctcgttccctgggggacggtagcagaccgacatccttctgggcctacaggtgggtggaaggcgccacagagggcgttcaggggtggggcaaaaccccacctgtgatgcccgatgagaaggtgccatgcctcctccttacttccctgcagcctgcctcttttctgcctgggagtcctgacttccacgaggacccagaccccacctcaaacacaactccttcttggaacccagatcccctgctcccagtcagttgacctgccccactcctggcctccttcccagagctcagtggtaaacaggcataaagtcctcaccccaggctgtcactatctctaccaccactcctctagtctggcccctccttctttgtccagccccattctagcacatctgggcaaaactggatggtggggtgtaaagggacgtgcacagatctacttaccaagctgggagcaagcaggattgggggcctggagaagctgaaaggttaagcagcagtaggcgaggtgcctactcctgtcctgtgcctatcacatttgcagagggtaagacaagaatggggagggacaagatgaggctcatcctgggcctctcctggggcccctccctcaccctgctccttcccatcaccaacgcacccaggcgtccaggcatgtgagagcctgccttgccaggaaacagcacaagctgaagtggggcagtaagattccctggtggtggaaggaaataggaggactctgctgaatcctggtcctgcttctgttctcatccctcccccagctctggccccaatcctcccagcccaccttctgcagtgtgtatgttgcctggtctctctggcctgcagaggtgacccaaacaactcagtcccccacctgccttatccttgcctgtttccagtctcctggtccggctgagcccctggcctcctacctcctcccacctcttgcctcaggccctgccccagtcactccaccctcagggctctcaccgggctgtcaatgacagcttttccatgtaaggcatggtgctaggttccaggaggaacaggggatgcatggaggcataatggttagggagtcatgacacacaaccatgaagaggccccattaccaggctgcaccaggatacaagacaagaaaggaaaggatgagtagggacatactaagaagcagccctctcctcttggaaaagtcaagcaaaacttggaaatgaagagatttgaggggggcctggcagatggatagagctgggggaagggaaaagaaaggcctctgctcaagtaacagccagaacttgaggttgcttggggagggcaccaggagcactgtcttagtttgggttcttccaaagcagagcttgagctaagggcttgggtacaggtgatcctgtattcttgagctaagggcttgggtacaggtgatcctgtatttgggaggttaactcaggaagtgagggcataaggtaaaacaagagagaggaaagccattaagagtatgttaagtcccttcagtaggccttgggaacctctgagaaaagtatagattgcccaagacaaaagactggcagggtgatcagtccaaagcatttattaggagaatgtacttaatgagtgggctacagcgtatcctcacaacagacagtgagagagagttgttctacctgggtatatccaaaacaagggggtcagggtatggagtttacgagggttcaaggtatttggttcagggccagggccagtttttttcagtgttttgggcaacaacctgaataccttttcaaggctctggcttgggctcaagcctgcaggggaaatgcaactggccaggtcacagggcaatcaagttactctgtgtttctttgtcaggacacagaaaaaaagtggggaagctgggggaccctacaaggatccttggcaggaaagcagggattgtgttcatttgagggtttcactgtcagtgagagtctcagcttccatgcaactgtccatcacggctgcaactgaaatcagagctgggacacagcgcaccagaagctaaagtcttgatgccatcaaaggacatccctgccccattcacatctctgtcacgtccactaatcggcaaaaggagaaaagtgagagaagatgacctaagtgtgactgcagcaggcagctctggaaaatgaagccagagcagtgagccagcccctcctccgaccaaggaggaaggaaagagcaggtaagcaggaaggccagtgtcccagacaggaccctaatgatcctgaatccatgtatcaggatccatcctctccttacacccttcctggacacactctcacctctcattttccaaagccctgccatgctgccatcccacttccccacactctgccccgggttcccttttcctaaagctgcagcttatggcttctccagtaggtggcagcacacacagagccactcataaactgcagcttctcagagcctgagagccagaaaccgtccccagaaagtccctccatagaaataaaaaaacaccagaagtcacatttcatccttttacatggttcccatctaccctcacaacacatgtcatcaccaaagacacacatacaagctccaatggcttttgccaggcaattcttcctccaggaccccatctggcccctccctcatccctccccttggactttgcccttcttactggccaggcaggggggccagagtccaggcttgactcattcccaccttgtcctgggctgagatcccaggtttgtaacagaaaacaccactaaagccccagcacaggagagaaccacccagcccagaagttccagggaaggaactctccggtccaccatggagtacctctcagctctgaaccccagtgacttactcaggtgactgctaaccctccgctctaccctccacctttaggggatataggcagggcaacaatactccactcagcccctaggagactaaccagtaccccttcctctcctgctccccactccacagtgggcttgtcaagctcctgagccacccgcccccacctgcactccatggtctctccctcatccctaatcgataaacctagatctctccctccctagccctctagccactctaccctcatcatgccctttacactcaccaagcccctcctcgccccttcttgacttttcttctcaactaccaggtcagtatctaatataagctcggagtttggacggagggtctggacctcagctccaccaccccagcgacctttccgtgtctgtgatcacaagcggaccatccggaaaggcctgacagctgccacccgccaggagctgctagccaaagtaagtaggccaagttcctcggttcctatagcaggggtagccaaggggctccacaacagtggcaacttgtgatgatggagcagagggctgaagtcacacagctgcccctccctctgagggctaaaagcagcggagtgggcctaatgagctctggtcaatttgttcattttccacctagtgagcttttctatgggagcaggggttagcaggagatagggagagttcgagggacggaattcagaagctagtatggaaaggtgatttgtgtgacaaatcaagttcaaattctgattctgccacttcctgcctgtcaaaccttgggaagttgttcaacctaccaaaacctcagtttcttcaactataaaaaggcaataataatacatcacctcctagggttgttgaaaggagtaagaggataatgtaggtaaagtcctcatacctggcacagagtaaggactcaaaaaggttaaacactattactgaaaacacttctggagaactcttgagggtgtgggaagtgaggtgcagcattgtagataagacagaagggtggacttcgtgagaacctggcttgctttccaattccaaaccagaagtgacttggaggggagcaaggggagatgccaatgacatggtaggagcaaagaggaaaaaggtcagcctctagctaggatcccccaaaaactgaagaacacggagagctgcaacctttaggaggtatcaaagtgccagaaagtcaaagtgggacatcgaccaatgtctagagccaactgatggatgttgggcagctaaagagggaaggggcatgggataagacctgcccttcttgcttcttgccattgggcaggcattggagaccctactgctgaatggagtgctaaccctggtgctagaggaggatggaactgcagtggacagtgaggacttcttccagctgctggaggatgacacgtgcctgatggtgttgcagtctggtcagagctggagccctacaagggtaagaggcctatactggggctgcttccaatgcctgtcctttagagctttcccgggcttcctctctagcttaaccctgatcctggggaccaggtgcaggaggagttgtggaattgtcaaggatgtcacacagtggacagaaagtccaagcgagggagggtctgacccagtgctgatggagattagtggtgggtgtctggtatgaggatctactgcactgacaagggtgtcctacagagtggagtgctgtcatatggcctgggacgggagaggcccaagcacagcaaggacatcgcccgattcacctttgacgtgtacaagcaaaaccctcgagacctctttggcagcctgaatgtcaaagccacattctacgggctctactctatgagttgtgactttcaaggacttggcccaaagaaagtactcaggtcagaaatcaacatgtcatactgccccatcccctacagttggatagtccccataattcgtcctcttgcacccacctacccctagttagctcttgcttgtggaaagtcctcatctcccagcttgatggcttcctcccaagttttccaaatcatctgatttcctcttgtctctgccattcagggagctccttcgttggacctccacactgctgcaaggcctgggccatatgttgctgggaatttcctccacccttcgtcatgcagtggagggggctgagcagtggcagcagaagggccgcctccattcctactaaggggctctgagcttctgcccccagaatcattccaaccgacccactgcaaagactatgacagcatcaaatttcaggacctgcagacagtacaggctagataacccacccaatttccccactgtcctctgatcccctcgtgacagaacctttcagcataacgcctcacatcccaagtctatacccttacctgaagaatgctgttctttcctagccacctttctagcctcccacttgccctgaaaggccaagatcaagatgtcccccaggcatcttgatcccagcctgactgctgctacatctaatcccctaccaatgcctcctgtccctaaactccccagcatactgatgacagccctctctgactttaccttgagatctgtcttcatacccttcccctcaaactaacaaaaacatttccaataaaaatatcaaatatttaccactaagacttctgactccaatttaaaccaggaaagggatggggtggataccccattttgccctcccccatcaacacccagtcccagatccaaagcctcagtcttcaagtatggagttcaatgcccgcctccgcttggccaccgcaccctgctgctgttcccaagcctctcgccgctttaggaaggtagtcaaggccacatttcgagccacatggtggccgaaagggtctcttatcagctcctggttctgctcccctgcaaagggaaccactcatgtttagtactaccatgctcaaagacagactctacttgacgtaaagatccctccatttcccccagaccctgggactgccactgggataaagtgaacacttcactttccaaagaacagaagtcagagggcagggtgagggcagaggactacacaatcagtcagcgggagggaaggggaaagcagactgctaagaacccatgagcaagaccaccctttggaactaaagactgttgaatttcagtagacttcccagctacccagtgatctggagtaagagaggggagagtctggaaacatcaaagagaggggctggtactcaccaagctcagcagcaatttccttccgggccctcaaggctgctccactccagatggcatctagcacacggctgccatggcgactacaggccagagccacatattgtccctgtatggagacaagcaaagtaggtctccctagcaaaatccacaaaagtattttggaggcttgtggagagtgaattttctgaagagtttaagggctgaattaaaatagtctaggaattacatagcctttttgagtctgaaggtacagtccagggaaagctcatattctctaaatggatgatggtggggaatcaaggcaaaagccagaaatctaacctttaggttctgcagcacacggcggcgcagcttgcgcgtcacagaggggctggtcaggatggcatcgagcacatgagagccagcgggactttgggcaagggacagaagctgtggtcccgtcaaggcacccagacttcgaagtacaagaccaggagtggagaagtgcagcagatgctggagcagtagagacccaaggactgtcacatcccccaaggctctggctgcggccattgccacctggcagcgcagagataagaaattaggaggcaccaacaagccaggtggatgagcccatccccagaacactgccacctccacctggatgaagtcaccactctcacctcagaagtcagacgcttgctaaaccctgggaggcctgactcccaattagtcactggcttggcctctcccctacctcacctggtgctctgcaggcactgccccctcctcctccgtcagtccatagtacacctcataagccatcaaagtggcaaagagaggcacacaggccacttgccgggatgagggctctgcacagtggaatgcctaaaggagaagacaaaatatgatgaacctgagaacttctccgtcccttacctcaactttaagggaacaccttcaggaaaggaaagaaggcccaactccacaagaatgttagctctatgaaagcagatgtcatgccttgctgtatccccagcctctatcacatacaggggttaataaatgtttatcccttaaataaacttctctcttagttctgggagacaatttttgttccaggactgtgaaataacatttggcctcagccgggcacggtgagctgagattgcgccactgcactccagcctgggcaacaagagcaaaactccgtctcaaaaaaaaaaaaaaaattagctgggtatggtggcgggcacctataggcctcattttcccccattcctgtgaactccttgggcattagacttcctgagtccagaggtacaaaaacttaagattagataagtcctaaaaggtagaagttgaactgagggcataaacagattgtgggtaatatccactcacctccaacaagagctgtaggaccttggcttggtaggccccaactctgcgacaggcccccac

SEQ ID NO: 16530 - DNA, 10267 bp, Human; identical to SEQ ID NO: 16529

SEQ ID NO: 16531 - DNA, 7958 bp, Human
aaagaaatacccaagtaggctccaaaagcatgggacatctgtggtcagaggcatcagtcctcagaaaagaccagagctcagaattccaagaatcagcctctgcctaggtccacccccatacccccttgctggaagctgagggtcctgttaggcacttagtctaaggttcttctccctgctcttccttcttttaaagaggctgtttattttgagtcaaaaagtagtataggccctgataccacacccaactttgtgcttcacagtggtttatccctcattctcagggtctcatcacaatctgaagaaacccagttataacacctttccaaatcctttctgcctgttcccttcaagtggagatactgagcctgggttattctctctaaaaagaatcacaaagggagtggctgccccttttgatggctctcagcttctgactctaggcttttctgaggacctgctacacttcttgccttcttggattctgtgtgataccaccatatctctatactaaagcctacttcagatggatttcatgaactgtgcaggtgagagccctcagtccctacaggaacccaatcacctctttcctcctactgagtatggagctccatctaggatgatcagtgccttaagaaaggctcgatattttgggttgttcatttattcattcaattcaacaaatatttattgggtatctgccatgtattggcttttaaggagactacggttgaacaattccctaaatagctccaaaatagcatgaactgaccctgctagaagccatggtgtggctctccaagagttgttttagaaaaaactacagatcacttctgcctcaaccagcagagcccatggaccactgaacaaaatggaaagcaagtaccaaggtgagcacctttagtgagagccaacgcacaacccacaggattgagtatccctgtgaaggattgagtgcctagggcaggccctatcgggttcccacaacctccagtcatggtcagacctcagaaaggtaaaatatggacaccttttttctgccctaaatctttaagactctccatgcttctgggttatcaaaagactgtgtccagagcatgtgcttgtcaggaacattaattagggtatttgcatgcaagagttgtcatgcaagggagagggcaggaaagctctgaggtgtttccactgtagtgtacaccacaatgtcaccaaccctctggatgggctgatatatctagccttaccacaatgccctgggagtgggcttggggcctgccacctccaggagctcctgttcaaagggcatataagtccctatcaatgccaaagacttgcctcgcaagagcagctatagggactgggcaggaatacagatagggatccttcactacattgttggatgcttcacacctttcccagccacctgcacgaccagctgagtggtacagccctgaagcctatgtgaaaacaggataacttgatggttcagagccattatttccatatgggcttaggcaaggtacttaaactctcagtgtctcagtttcctcacctatagaaaggtaataaaagcagtatctatccccttagggttcgtgtgagaattaaataagctaatatatatacctggtgcatgataagttttatatacgtgttggctatgatcttagggcagctgtgagagagctgagccctagaaccataaaaccctcctaagcaccatctccactcatggcctggcaggtcgtggagcaggaaatcctgtgggaaaagggaaggctttgactgtaggagtgggttgattgtgggttcctggaaggtgaggactccttccctaacatcctcaatgcccagcaacacctaatctggctgcggcaggtgctcaggaaacgctagtcaaggagaaaggcactagctttcgctctgccccctgccccaccccaggggcgggactgtagaggcgcctataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggtgagtagggagtggcatgtcgatcgcagcctccgacattcacacccagagagccccacagactcgctcagagaacgtctttgagtccggggacggtgggggccggcgagggaggctggggattgcagtgagaacgccgagtcacaggggcgcggggagcagcgctgaggcacggcacggccggctagtgggcgacacccctctctcaggcccagcggtgcccccgcccccttggtgtccatcgaggaactggagaaccaggagctcgtcggcaaaggcgggttcggcacagtgttccgggcgcaacataggaagtggggctacgatgtggcggtcaagatcgtaaactcgtgagtgaccccggttgaccccagccgcaatctggccaaaaaggtggagccactgtgctctggggcctgaatggcgaagggagggattttcccacgaccccggtgcgactccagctctctcctggagtgtaggaaggcgatatccagggaggtcaaggccatggcaagtctggataacgaattcgtgctgcgcctagaaggggttatcgagaaggtgaactgggaccaagatcccaagccggctctggtgactaaattcatggagaacggctccttgtcggggctgctgcagtcccagtgccctcggccctggccgctcctttgccgcctgctgaaagaagtggtgcttgggatgttttacctgcacgaccagaacccggtgctcctgcaccgggacctcaagccatccaacgtcctgctggacccagagctgcacgtcaaggtcagctggtctacacccctctcagcctcaagacaaggccccagagctgctctagccaggcccgccggacactagacctccagagccctgtctattgaataggcgtagcctctctctctggacacagggctgccaggggacaaagcccagccaggagttttagctcctgcctaccaggtgatagaggccctgagccacacgagtcatttccaccagctgccccaccagcccctccaaagagtcatggctgacccagccctggagactcagaccttgacctagccctaccacaaggcacctagatctaccatccaagggaacctcttcccttgacctccacactccctttacaaagctgaacctgcaccttctgggggcaggggggttcctggaggctctctggcccccttgtcttccctacctcccacttctttccttcctttgcagctggcagattttggcctgtccacatttcagggaggctcacagtcagggacagggtccggggagccagggggcaccctgggctacttggccccagaactgtttgttaacgtaaaccggaaggcctccacagccagtgacgtctacaggtaaggatcccggcccaaacacacagccaggattcctacacttctctgggccctcccaggggatgatgtataggaaaggagtcttgccagtgattggaccgatcctcagctttgtgtctcctgcagcttcgggatcctaatgtgggcagtgcttgctggaagagaagttgagtgtaagactctaggaggattctgggatccttaaccccaggtgcccttctcttgaaagccccaaggcttccccttcccgctcacctacttagactgccctcctccctcctcgtgcccccacattacactccctgcctctttccatgatgaagcagataattcccttttaccctgaatgccttctcttctcaccctcctcccctactccagtgccaaccgaaccatcactcgtgtacgaagcagtgtgcaacaggcagaaccggccttcattggctgagctgccccaagccgggcctgagactcccggcttagaaggactgaaggagctaatgcagctctgctggagcagtgagcccaaggacagaccctccttccagggtgagctggccagttagctggatctaggataagcttgggtctgtcagcagggggcttttctcaggaaaagaagatttgctcacctgcactccactctgctgtccctctagaatgcctaccaaaaactgatgaagtcttccagatggtggagaacaatatgaatgctgctgtctccacggtgagtgccaacatcacccctccccaggagctggtcagggatggcacagcgtggctacctggccatccaatgactcaccactgaccactgctttttatgcgttgacctttgtacccaccgtccccagcccacccctgagttcccagacaacagattatggaccgagagactactcccttgggtttactctggctcatccaagtcatacccagcaaactcctcccatccctgcaggtaaaggatttcctgtctcagctcaggagcagcaataggagattttctatcccagagtcaggccaaggagggacagaaatggatggctttaggagaaccatagaaaaccagcactctcgtaatgatgtcatggtttctgagtggctaaacaaactgaatctagaggagcctcccagctctgttcctaaaaaatgcccgagccttaccaagaggagcagggcacaagaggagcaggttccacaagcctggacagcaggcacatcttcagattcgatggcccaacctccccagactccagagacctcaactttcagaaaccagatgcccagccctacctcaactggaacaccaagtcctggaccccgagggaatcaggtgagacattgacaggattaggggatgcactaagagtcctataaatgctgtccccttgccagtgaaaacttggggctgagaggagtgcagtgggagtgccaggctccagggcagaactggatgctctgtgctgtttgcagggggctgagagacaaggcatgaactggtcctgcaggaccccggagccaaatccagtaacaggtacccattctctacctctttcttttccctgttcaattcttccaccagactcctcctccagacctatatctagattcagggtactttgtggaggggaggggagaagatgatctaactcaaccttctcatttcataaatgggaaaaccgacaccccctgagaaaggagccctctgaggtcacacaacaaagcttggatttgtccctgaatcttctaactttccacaacaccagctctgtgagccccctaagttccattgtttcagcagtccagaggacctcccagcaaaaaagatcagggtctcaaatgtcaattgccactctctagagcttctgctaacacaattctggagaggagctctgaggggaggagcacagggcacaccttgacacagccactgacaagtagagacttcatactccccacccacccccaacttggcctttctgacagctaaaccctcctgccaccatcactatttctcttaaagggcgaccgctcgttaacatatacaactgctctggggtgcaagttggagacaacaactacttgactatgcaacagacaactgccttgcccacatggggcttggcaccttcgggcaaggggaggggcttgcagcaccccccaccagtaggttcgcaagaaggccctaaagatcctgaagcctggagcaggccacagggttggtataatcatagcgggaaataaagcaccttccaagcttgcctccaagagttacgagttaaggaagagtgccaccccttgaggcccctgacttccttctagggcagtctggcctgcccacaaactgactttgtgacctgtcccccaggagtcaataaacatgatggaatgctagtcagtctgagctcagccaggggcagggagggactgggatgggggtgggagctgccagtgagggatagggaggcaccacagctctgctatggcaggaagtggggatgctgggggctgggagtgggcaatggcctggcacacaaggtcagggcacagccggctacaacaggaaggaatcctagaggcctggttccccagaccactctctaatctcagggcagtgcttcctctaaagcctaggatggcgaccccaccctaaccctaaactctggggatagaggctgtggtcccttttcttccgggctctcaagactcacttgcagggctctggcgagggatgagttgatgtgaaagatcacagacctggccccgcacggtgcccccaggctcttagagatcatgacgccacatacctgcctccaccacacactcaggttgcttcctggacattgcttcccttttgattcccagttgctgttcgggagtggaaagctatggctcctaaagctatacacaggcgcaacccctcccacggagcatgaacagttcaaacccggtggtagtggttgccagccaagcggagaggtcaagagaatgagcgcccccaactctgacctagatccccaccaggacccacattcttccctacattctcgccaggcttcagccccccgccctcggtctccccactaccaaacgttcacctccatttggacacatcccattgggtccaccccagcccaccccttcgcatctctcccagggtccacattgcccttccctgaaggggctgaagcggggaggcgatggtgttaggagagacaaaaccaagtgcgggaggagaccaggggagtccggctttggcacaggaaggggccgggctgtcccgtcggggaagtgggagggggccgcggcgccgggagggaagcgcctgtcgcccgggactctgagccagagcgcagcggcgagcgtgactccgccatcaggtccccggctccctccccggacctagcccactccgctgcgccagcgccgcgggcagtgagttcggggatcaggggaacccggggctccctcgcaccaaccccaaatcctgccctcctggcgatgaggcttttctaggacacctctacaatccgggtttgagggaggaggaggaaaggactgagggatcccctcatcgccagctgggagcgggctgggaggccgcagggagggcctgaaaaaggagacgggattgccacgaggttgggggcgcggggtggtagcggcttggagcgggtgagaaaagctcaggtggggcccgccgggccgaaggaggtaacccggcgcccggccctagccagccccggggctcggggctggggagatcatggcccgcctcttcagcccccggccgccccccagcgaagacctcttctacgagacctactacagcctgagccagcagtacccgctgctgctgctgctgctggggatcgtgctctgtgcgctcgcggcgctgctcgcagtggcctgggccagcggcagggtgagccgagcctctgctgcgggagggtctctacctggggagcattttcggggttggggtttgtggggtcttcttttcgatgtgttttcgttgctgggagcagagaaagaaaggaccattgagcctggctaggaactgcagtgaccctgggcaagtcactctacccttctgggtctgctcagggagaaagctgagtcctggatgcttctcgtttctgtccgggttctgacagactttatgaacatccgtggtctacgggttctacaataaatccatcaccggattttccagttttccaaaggggaaattctaggaggcccctggggaattcatttcctgcctttctctccctcttaggggatgtagagcagttgtacccacagactcccagaaggcaccctccaccgggctctcactgagtcccaaagtaaacccatgtccagtttctgtttggggaggaagaaggtct

SEQ ID NO: 16532 - DNA, 7228 bp, Human
aatgtccattgacagatgaacaaataacttgtggtataaacatacaatgggaatattatttttccattaaaaagaacgaatactggcatgtgctacagcttgtatgaatctcagaaacattattacaagtgaatgtagccagccacaacaggtcatgtattgtgtgattccgtttatatgaaatatccagaggtggtggttgcagattttgaatgtgctaaatgtcactgaattgaatactttaaaatggttaattgtatgttatgtgaattttacctcaattttttaaatgggtcataaacttatgtttagcataatccccttttaattttaaaaaatgcagatattacatgagaaaaaatgtgctagagcatatttcaagacattaaagatggttatcagtgaatgatgagaaattaggtaatgtttattattttcgctttgctaaaattatttaaaaattacttgcatattaaattttttaatgcctaggaaagaaagactatagttgtattgactaagatttctacgagcatggggaaaatgcttaatttgtagggttaatcaaggataaaataaattgcattgtatgtacaatgtgatcccaagtatttaaaacacactgcttatggtaacagtcagtctgtgggagacaggttaaaaagtgatattttcccttcctactttccaaattttcttaacaaacatatattatgactataatcagaaaaaattatttttaaaacgtctactatggggcaagctaggttcaaaaaatagaagtttgataaatgtagttggcttgctattgacaaggaagacgtttacactggaattctatattttgagatataccattcctcatagaaaaatttcctcacagaaaatataaaggtggaaacaaatcacaagaatcgaaccatgtagagagacttagttgtcttttaacagaattgggcacgggctgttcagaaacaacaatctttcacatccattataatgatagcattagtgtagtttgtttagcaaatgtttactgcgagcctgttatgtgctgagcctgctatgtaagaagtgtggctctctggacaggagacagaatactaaacaacacaactactgatctttggctgcctggcatgcttcctcacttcatatggtatcagcaatttagcaccacaaacgtcctttagagaaccagccctttctcattcttggttctagtggcttgagtagactgaccccagcctacccaaagtggatttgactcctagcaattcattaatctagcccaataaaatgtcaagtacaggacttttattgaaagcattcagaaaagaggtggactctcacactaaacatttgtaactaaataagggatgttagaaattctctagaaaggaagctatgataataaatgggttgctagatgggtctagtagatggtggccatgctttgttactgccttgtgtattgtgctaccatagccctccccaaactgtactctggctcctggcatttccgtctcttcaaccagatggtcagctctctaagtgaaggagacacatctccaacatgcttggttctagcacaacagaagggctcaaacacatacctgctaaagaaactatcctgatggatttagcagcatggccatgaggcattggcggttctatcactgggaactcaggtttctggtgctccagtacctctactggctgataccacatcctacaattcacttcataggcttgggttcctgctctgggctgaataggtggtccactctgagtcatcagctgtgggtgatgatgtggtcactgcatgattctcacacaagcacccagaggacgtcatcaggcagaggcagtgggggtgggcagcatttacagaaaatctgtgatgagacaccacaaaaccagaggggaacatgaagtcactgagcctgctccacctctttcctctcccaagagctaaaagagagcaaggaggaaacaacagcagctccaaccagggcagccttcctgagaagatgcaaccaatcctgcttctgctggccttcctcctgctgcccagggcagatgcaggtgagtgaccgtctccaccctcgggggcccaaccccatcccacaggtctcctgccctttctccacattcctgatccatctatctaccaggaatgttctgaactccagctcccattctaccaagaccccccaagtgtgatgctggataagctatcagcaggaatggcagagcagcaggccattctcaagaagagccagtgggtactatcccttccccagagcccacctttgtcacctggagagtaggactttcctagaagtaaatggcagaggatgggaaactagaaaagagaaatattaaattattctagagtaggcctggcttctgtttctgggataagacaggtgcttctctcactgtctacttaggagagaaacccagagctcagctgacagcagaattggtacaatcactgtcctcagaacactgttaatgtgtttgctcagtcccattctccaactctgcttttcttccctggcctttggtggctcccctctttccaaggatgaggcactacggcaggccccagcttccctgctttctagaattccaccagcactgctctaccagccctcatccagaggctaactggagccagtccatcatgcagccatgaacatttactgggcacccactacatgtcaggctctaggaaacaggatatgacagtatctagatccctccacttacaccctggccattagaaagcagcactatcctagacaccacaggactcataagggtcttggaaactcacctgaaacaaagcaaagtcaggagaggaatgatcaggagcctctgggatttcactgtccctaagacaggtatgctcgccttcaactacatatggaagaaagatttacagaccaaagtctgctgttcttccctttttcagagcaggaaattgaagccccttcctccaggccactcccaactccaggctatcccaggctcccaaatgcccaggagttctggagccactaagcaggtgcccacccagcagattccatgggtgcccacaagcagacagacttttccttcaggggagatcatcgggggacatgaggccaagccccactcccgcccctacatggcttatcttatgatctgggatcagaagtctctgaagaggtgcggtggcttcctgatacgagacgacttcgtgctgacagctgctcactgttggggaaggtgaggagcagaaaacagcccacaccctcctggaaacactccacagagacccctgccttcttcccaaggagctccctgggctcctgtgaacacacatgccaggaggtctccttagagggtgagaaaagggcagttaagtttgtggagagaggggaaggttggttccagaggtgctgctgaagtaagaaacagcagagtgaccaagcctgccatatttagaactgggggcatactttggcatagaatacaaactgaagcaattccacctgtgtttctagggggaaccgaaccctgagaaacctggtgcaattaccagaattccaattcctggggaccgactgtccccttaatttcccctcagctgcagccctgccccagctgtcacctgctcttcactgtctctgggctgtataccctgtgactccacccccatcctcactctgctctctgtgcagctccataaatgtcaccttgggggcccacaatatcaaagaacaggagccgacccagcagtttatccctgtgaaaagacccatcccccatccagcctataatcctaagaacttctccaacgacatcatgctactgcaggtgaggcacactcctgccactcttgctcttcttggtccagttggttccactccccctggaatgccggcccttccctcctttccatcctggcctcttggttagttcctatgcctcagaggagagggaagattgtgcagccccatcactgtgtcggggcccagaagttcgttggctgacctggactttcttgcctcttccccaccagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaaggtaagactatgcacctgcctggattggctcttgggagaaagatgtttggggaatatctgagacctggagactcaagtagtgggggactccttcacccactagactgtgatatttctctctggaaagagaagaggggactagactgagctggggagaaattagggcctctgcaaacttaccaggaggcttatggtggatggtgcttctttggaaggatgaatttgcaacactccacccactccaggtcacagatattaggaaactgtgcccactgggggtgcagtaattataaccaggtgtgtcttcagaggctggtacccaacgtggttaatgggctggtcctccatggtggacatcagccctccttgcccacttctgggtccttaaacagccaacggtcccacatacctccgatctcaggatctgggggacatgacggaggctggcccctgggatgaggtgaagcagtaacaatgtccagggccagagcttggcagctgggggccaccagcggcctgccctgccctctggtctcccacatgtaggctgtgcaagttggccttttctaaaagggggcttgagatggaagagagggcaggacccggaggagcatcagctcagtccttccactctctattcacagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctcttagctgagtggaaaagctggtttcttgtttattcattgaccctcattctcaggcaccacatctgtgctatgcaggccaatgacacaattttgctgttttctgctttctcctctcccctcaccccttgccacctccccaaacccccacatgaagctgatactcagctccttcctatccacaccagtttctccagggcctgcccttctgccaaggctgaagctgagcaccatcaggagacaacatggaccactttggtcctggggctttgggtaaacttcttacctccttctccagtgttacatgacagagaaaaaagggataataccatgggacctaactcctcatcccccactggggctcctcattctcccctgggcttagtttctctaccctcctctgagctcaaggctcagctcgtcctccagcctcttggctgccccttctcttcatccctgctgagtgttctcagaatccaccaactcttgtcctctccagaccacactgatctgatctggcccctccctcatatctacccacctaagatacccagagacccatgtggttccataagggccttgccactgagacgccagcccatctcatgccctggcagagaggggcctcagaaaaaccaggcctgtgtggcaaccaggtaagacccatggaggacaaggctggcacggtctctctccaacccttggctccatctctcccctaggtagggccagctcaacccctcccatccagcccagtgtcctcccatacactcaaggttcactgcccacctgggcagtcagcaggctgagcccctttaaacctgttcctcttggtcactgctggcctctaggctaagattccctgctagccacctgggctacatcagccctttgagttcaaaaggactcctttctgcagaaggactagaaagcacaatcttttctatcaatcaacaaacaaatactcattgagcacttactatgtaccaggcatagaggatagtaagagaacacaataacagactctatcatctgaacccaagtgaaactgacaatgttgagaattttcatccaaattgtttcactcactttctgtccttcagattagttcacaagagcgagatgtatatggaaatccatgggattaaagtatttgtatcttatttttatttctggtttttctgaggcccctccctgccagggcatgaggtgggctggcatctcagtggcaaggcccttatggaaccacgtgggtctctgggtatcgtaggttggaagatatgagaaagaggccagatattcacacagtttgtataagtattgtcacgtgcgaccccagaacagcaatgtatgggatttgaaaacaactttaatcatttactttctagacatgaagttgtcaaactgttcaatggagcgtcatcttcacctagggggaagagtagcagggcaggaagaagacaactagggcaggcttattttcatttgtttaaaaagtagcaaggatgaatgtcattataaagattcaaattgtaggaaaaacacccatttgattggaccactcagaagcataatccctgtcattatacaggctcctgcctgtacagaatgaaactagaatcaggaaggctcacgcaggctggaaaaatggaacaatgcctcgaatgtttaggccactgattactgctacattcatagtttccagaactacctggacttgtgaatgttaggaagttcttggcttggaggccaccgatagagtatatgacatattgttgaataagggttgcccagtgttaagctcaccctgccaaacactcccagcaaccacctctccaaggtcttgccactaatatggagtactgcctgggagttgaacataagtactagctctagattaatgcttccctgtctcaaatatacacagctacactcttgtggcatggagtaaaatctccctctaggatcatgtaactgtcaaagttgcgccctttctcatctcagtgt

SEQ ID NO: 16533 - DNA, 6676 bp, Human
ctaattttcatgagattttcaagagggcctattatactccataaagactgggaattgtatctcacaccaatcagaatggctattactaaacagccaaaaaataacagatgctggcaaagttgcagacaaaagagaacacttatacactgttggtgggagcagttcaaccattgtggaaagcagtatggtgattcttcaaagagctaaaagcagaactaccattcgatccagcaatcccatcactggatatttacccagaggaatataaatcattctaccataaagacacatgcacgcaaatgttcacggcagcactattcacaaaagcaaagacacggaatcaatctaactgcccgtcaatagaccagataaggaaaatgtggtacatatacattgtggtacatatacatatgcagtcataaaaaagaatggactcatgacctttgcagggacatgggtggagcaggaggctattagcaaactaatgcaggaaaccaaataatacatgttagttagcaaactaatgcaggaaaccaaataatacatgttctcacttataagtgggagctaaatgataagaactgtgaacacaaagaagaaaacaacagacagtggggtaagaggagggagaggagcagaaaagataactattgagtgctgggcttaatatctgggtgataaatatgtacaacaaatccccgtaacatgtgtttacctatgtaacaaaccttcacatgtacccccaaacctaaaataaaagttaaaaataaatacctaagtaaaagattttcaaaataaaagacagaaaaaaagagattgggaattgtattagtcttcaattctgctatttctgcaaaaattatactggattataacggttttctgtgcatacacagaatcttctaaatattttaagtgtttttaataatccattgtgttactctgcagtaatttgctgttcttttctcccattgttgagtatgcggctctaattcttttataggtagcacagcaatgaatgtacctccttctcagaagcttttgctcctgggattaggttgatgggcctctaatgtcaccagtgaaatgggatattagatattttccagctaggatacgacagctcccaataaaaccaaattactaagccttttctgcaagcaaggagccgtctggaacataaggactttaaccttgggtaggagacaggcaagcagaagtcttcaattgtgtcacaattttcactgaggactcaagtgacctaagaaagtaattgtgattgtcagagccttgttcttccttttctttctccagccgcacgcttcacctactcaggagagtgcctacgcaatctgacttgacagcttctagaaagaaattagagcaacaggggtctcagcagggtggtcttgggccaaacactgaaagcaggcaggcttaccctttcctcttctgcccccttcaactttttcctgatgttcttacccacatccctcaccacaccacaccctttcattcatccttgtcccagacttattaagtatatacagataagcaatccagggaacttgcattcattaggagaaacccagaaattcaaaagcaataatgatctaatcccagaggagtagaaaacaggaagtgggcagctgccagctttcttgctttgctggagtattctggaatttgatgggttgagggttctggacacaatgccccaagccccttccttgttgtgctgggttcctatttctgctctcggcactgacttagcagctgctcaagagctcactatgttggcttggattacacggtctcacccacatctccggcagtttgtgggcaaacttcctgagcagccttgggtgatgaaacctttcatggtagcaggagaatgggactgtgaattctcaatcccctgtccccaccccttccttcctctctcagggccttaaagtctaggaggaggaagcacagcagcaactgactgggcagcctttcaggaaagatgcagccactcctgcttctgctggcctttctcctacccactggggctgaggcaggtgagtgaccatccccaccctcagaggcctgacctcatcccatagattcttgagccaaattgccttggtatatcctaattctgtactgttgagcaagttatttgaatttgtgtttcctcatctataaaatgagaataatattaataccgatcttgcagagttgccatgagagttaaataagttagagtatttaaatgtcttggaattgcccgcacactataagtgctataaaaacatgctttgtgtaaataatttggcagcatgtgtcagaccctacctaggaggtaagaatacagcaataacagtaccatcagctcatgtctagatttttaaacaccagtcccacgtggtcttgaattggactcagagggctctgggaagctccatgaggataaaagtataagggaacttcaggaacaatcctgtacttacagcaaagcattctcctcaatacctgaggctgaagctggccttgcctggaacaagggttgttctccctcttttggagaggaggagggaggtgaggcctaggatggggaaaagggctcctttcaagacagcagtgtttcctgtagaaccctggagccccctcccaatctgctgccccatagactccaagcctcagcaccatctcctccctctcctgcaccctctctcctgccatccccatcttccagcctttctggagccaccaatctggtacccacattgcaggttcagcaagcatagagctaagtgccaaatgcttccttccaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaaggtgaggagctaaggaacttcctggccagccaggaacacagccctgcggagctcttcggtggaagagccatctgaaagaagagttgtagcaatgaaagggtgaaagaaagaccaagtgagtctttgcgggagggaacaggccagtgtaaatgaggaggaaaggaggataagatcaaaaagagcaagaggaagagatggaagacacatattggggctcaaaatataaactcaggctatttatcaacttaatctggggaagcaaacctgaaggcaagtaccaccctgtcatccctagctcagagctgctgagaaagaggatacagctgagccccagggccctcccatcccctcgattctggttagctgcagtcttgccctccccgtgctgtctgcctaccctgcagagctggtggaccatagctcctgcagcccagacctacctcttgcttttgcagcaatataaatgtcaccctgggcgcccacaatatccagagacgggaaaacacccagcaacacatcactgcgcgcagagccatccgccaccctcaatataatcagcggaccatccagaatgacatcatgttattgcaggtaccacctacctggccctctggctccttcctagtgtgtccggggacaatggaggaggaagtgagggcaaggctccggggtggcggggagggcatgggatgtgtactgcaccagcgacccccgagccttggctggaggccccagctgagcgggaacgcctacattcttcctccagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaaggtaaggcatgggcattggccaacacaccccgggagagaggggcccgtgcagagccaggcagtgcgaacagattccatccccacagcctcagcctggcagccagaccagggtgggctggggattgttttccccatcaacctggtctctgggggaataggaggaagacccacaacacatacataggcaacattctcctggagaagggagaggtaccttgactcagattgggctggagacagtaattaaggcagagctgaagtccagcgaccgaaaagatccagaggcttggctcctgtaccccaccgatcttccatctcacacacacccagcaattgaaggggcccacccacccctgccttccctgagagcccggagctcagggaagcaggagcagggaggcctgtctcagtctcccttctcctctctacctacagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtacttagtttgtttggattgctacaacaaaatagcacaaattgggtggcttataaataacaaatttatttctcacaggtctagaggctaagaagtctaagatcaagtcactagcagattcagtgtctaattagggcccattttctggttcacagacaaccatcctctccctgtgtccacatatggcaaaaggggcaagggaattctctgatgtctcttttacaagggacctagtctcattcaaagagctcagcttttacgacctaatcacatcccaaaggccccacctaatgccatcacattggggattaggtctgggaaacatagggaaacactgtctctacacaaaaattttaaaattagccaggcatggtggcatgtgtctatagtcccagctacttgggaggctaaagtggaaggattagttgaacccacgaggttgaggcttcagtgaaccatgcactccagcctgagcgacagagcaagacaccattccaagaaagaaaaaaaaaaagactggcaggccaaaaagacagaactgaaattccaaaaaaaaagacctactttagtgtatgaaaaaggtggcatctcaaatcactgggaaacaatggatttttaataaatagcattagaacaactagatagatatttggaggggatggaagctataattggatccattcctcacaccatacttcaaaataaacctcaaatggatcacagatctaaatgcaaaaacattaaaccatacaagcactagaataaagaaaaattaaagagattttgcttctttaaaaatagctaacaaacacccatgttagtaacagcattaatcacaatagccaaggatggaagaaccatagcgtccatcaccagcccgcatggttgtcctaaaccttgtgaaagaaaatagaatctcaggacccaaacttcactattccaaagggaaagttaagcttgggaactgacccatggggggaaaaaaactgctttctatttatttccaaacagctataatccacaatcctgtggcatcacctcatttcctctacttgcttttccacatgtttactttatcttgtgtaagatgtagatttactgaggctaatcagaacctcacaagaacataaccatctgcctgaagtcctactctctctcccatttttaccttcctgcttgctctttcccctttaaatactgaagttcctaaaaccctttagggaaaagcacaggtcatagatgctcctgtggcttgtattttttccccaggtgcatcttcaaccttggctaaataaacttctgttagattgagacctatctcagtcactttgtggtttatagcccttccttgcgctataccaaccccactgtacttataagccagcattttcctcaccaatgtgatgaagatctgtctgagaacttttgatactctgaaggtatataaaacacctcacaaaatgttgacctaaataacaatacatttgccctgaagattagcccatgactgtctacatcaatattatattcaaacaaaagattactgaaatcacataatttaaaattaagctttaaacacctgctgaaagtaactacacagaatcagtcaggaggttttcctaggtaagtagaaatgttaattactcctttcagtgtgacatttaccatctgaacttttgcagttttcctaatcttaaatgaaataatccctgaacagacattttatcaaatccaacaggctatatacagaaatgctttgatgaatttgaccattattttatgtgtatctcttatcagaaagttatttgtctaatattcagtgtaagccatttatcaacaaaattttaatcaataatacatctttaacaatcctcagtcattctctctgtatttactaactgcctacccataagaattatctattactggcatgctctgggggataacagtctcattattaaatgtttgc

SEQ ID NO: 16534 - DNA, 9505 bp, Human
acgctttcccaaaccactttccctagccactctcctatgtcatctggatgctccccaactcccctagagtattctgtgcatatctccctcttataatttaccatattcacattacattgaagtgactgctttctgtacctgacttcctgttggaatctatcttcatttttaattaaaatttttttttttagagacagggtctcactgtcaccaggctggagtgcagtggtgcaatcatagctcactgcaacctcgaactcctgggctcaaacgatcctcctgcctcagcctcccaagtagatggtactacaggtgcaggccactgtgcctagctaattatttaaaaaatattttttgtagagactgggtctagctatgttgcccagactggtctccaactgctggcctcaagtgatcttgctgccttggccacccaaagtgctgggactacaggcatgagccactgtactccaccatggactgaatctttgaagagcagaaattagattttattagtcttggtaacttcagtggtttaccaatgcctagcaaatcatggatactcaaatatttatttaactgaagtctagtaaataagtaaaaaatgtgcagttcaataaagtcttgcctgaaatagaggaaagcacaggtccacaaccctttagttgcaattccaaaatctctactctcaaacaaaaagttttttacttttctttcttttcttttttttaatacagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtttttaatttccactttgaataaatattcacatcttgttgagtagtattatagtttcaggtaagggattaggaaaggagctgttaagtggaagggctctctcgggtggtttctgcaactgtggtcccagaggaagcactcacctcctgagcaacaacgcgaagggtgtccagatggcggccagtgatgtaaactgtggcgcctgctttgcagagctgcaaggcaatgccacggccaatacccctggaggcaccagtcaccacacacacttggccattcatgggagctgccatgactcacaggcaaaggaggcaggtctgtggaagcaaagacttactctgagggaagcctggagactgtgtgtgtgttggggcgaggttggggggtaggggagaacctcactagggctaagaggaggagccaaggtaagaatcctttgaggggagaggagtcagaggctgacaactgggtgcgggcctgaggacaaggctgactgtcttttgggaggcccagatagtgaagaaggggctgagtgggactgtccagaggtggacaactactacaaccctctgagtgtggctgcctggatatgggaatctggcgcggcagcccctcggggcgcgtccacgcagagtcctgggctatctgaagctccggtccctggcctgacccagtccggctgagccagaggcgcagcttccgggccggggatgagcgcgaagcctggagatcctaagccctaagtgggacgagcgtgcgccgcttacctgccacctgcgctgccgctgaggtctgcagattgcggggctgcggtggaagtctgggttctcgcccagattgagccggcgacgtggaggcagtgttcaaggattgattctgtagtaggacccggggcgattctgtgctgaggtagaggggcagagtcccaggccaaagttagaacctgcggatgggggcggagcgatctgggtgacacacccaccccgcccggctggggcggcgcggaactatgacgtagtagctgcgtcaggagcgcgcccgcgtttctaaactttgtctggataaggcgcacgcttggcgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatatttccgccgggcgctgtcagcattgaaagaggctcccgagactggggaagaacgaggtaggcagcaacttcggggtttagaccaagagcatcaaatccagggcaggcaaggaaactttctagggtcggcagggcgtggggacttagtttcatttcccatgtcctcttcctcggcctccgacccacgacccttggttaagcgagggtacataactgtattctctactaagtctcttcaaagtgtgtctttcttcccttttcagatctgatggtgcacaatataatgaaggaagtagagactcaggccctagcgttgtccacgaacaggactggcagtgagatgctgcaggaactgttgggattcagtcccttgaaaccgctttgtcgcgtgtgggctgctctgcgctctaacttgcgcactgtggcctgtcaccgatgcggggtccatgtattacaaagtgctttgctacagctccctcgattgctggggagtgctgcagaggaggaggaggaggaggaggaggaggatggaaaggatggtcccacggagaccctggaggagctggtcctgggactagccgctgaggtgtgtgatgattttcttgtctactgtggagacacacatggcagcttcgtggtcagaactctgcttcaggtgttaggagggactattctggagtctgagagagccaggccccgtggttcccaatcatctggtaagtattacaagaggaaagtggacctagggggaagaagaatttagaaagttcagaatgagacagtaaacagaagagtaagtcttcatgggggagcttgaccgggaagaattagcttgacctgtcctaatctgaacagggcttagcaagccaaagattagtgtgtgcggaggcccagaggtagggatgtacagttgtgtttggggaaggctattagaatggacgcaggaggagaattttttttaagcatgacttaatatacaaatggacttaagcaaaagtaacatacacactggactcaagcagaagttcaggaaactatacccttactacatgcagcccactctgttatttttttttccttttcaaaactattctgctctatttcatttaaaaaaaatgctagttgagaccactaacttgatttcatggtacagtcttgagctgtgatccacattttgaaaaactaggaaataaagttagcgagtttaaatgaggctttattttggaatggcttgaatacctggctgaggaggttgaactgtcttctgtggaccatggggaagctggttgaagtttcttagaaaaattaagacagaaatgtagtctcagttcagtcatccagaagagacatttagttgtactacatctgttctgcatctccaagcggaatccttgttcatctgtgaaatttttctctcctggatggcagtttgtgatctccccactgcacatgttcttaatcttccttcagaagcacagaagaccccagctcaggaatgtaagccagctgattttgaagtccctgaaacctttttgaatcgccttcaggacctgagctcctcctttctgaaggacattgcaggtaaggagggaagtaggaggatggtctcgtatctacttgtctggaggtcatcttaccaccaagcaaggcccttacctcaggttattcctcttcttttcaaacctggtctggtttgacgttcagagcactttgtatagtccctttgtgtccatagtgccctgtatcttgttgcctaaagtttgaggttacgcaggttgtctggattttgagaaagccgctttatttctgccctctctccacagtgtttatcactgataagatctccagcttctgtcttcaagtggctttacaggttttacaccgcaaacttccccagttttgcgctcacctctgcaatgctgtgattggctacctgagtactcgcggttcctcagtagatggcaggtatggtcagggcctcaggatcgacccaagttggcggggctgtgtgaaatgaatgaggtgatgtagtgcaactgtattttgcatgaaatggagttaagactgcctgatgcccttcttgtccctagtcccctactgctatttctccgagatcagacgagttccagactcctggagcaggtcctgctggtgttggagcccccaagactccagagcctctttgaggagcacttgcaggggcagctgcagaccctggctgcacatcccattgccaacttccctttgcagcgcttactggatgcagtcactacccctgagctggtgagttggaaacctgagctggatctgtttctgctaattcttgatcactggaccttattttatggtctgtctgcctctatatacctttgacattgtgctggccattgcccttgaaaagctattctttgaggttttccagagcttaggataaaggtgcccaccttctagtgaggatttgttttgacttctctcaggtatgaggaccagcaagagactggctttattcaggtttacagcttgaggttccatggcccacccagactctggtacttggctataagcccacatgagtgctagagctgttgccatagcttctcttttcctttgctgcttaggactaaggtgggcttccctgtggtctcatgcattgggtgttagagtggaagtgcagtttaattttagtctccccttgctcctagtgctcccttacacatagggaagagccacttaaagttccttcctgtgaggtggcacctctaagactgcccccttatcctgggccttatctagccaaacaaaagtcctgatactggcaatgctttttatgttttatctagcatttttagttgttttcgttgggaagatttctctgaataatgtggtccgccattaccagaatgccagagttacattccatgtttcccatcagctgtcccctgtgtttgaggagctgagccctgtcttggaagctgtattggcccagggccacccaggggtagtcattgccctggtgggggcctgtcgcagagttggggcctaccaagccaaggtcctacagctcttgttggaggtgagtggatattacccacaatctgtttatgccctcagttcaacttctaccttttaggacttatctaatcttaagtttttgtacctctggactcaggaagtctaatgcccaaggagttcacaggaatgggggaaaatgaggcctataggtgcccgccaccatacccagctaattttttttttttttttgagacggagttttgctcttgttgcccaggctggagtgcagtggcgcaatctcagctcaccgtgcccggctgaggccaaatgttatttcacagtcctggaacaaaaattgtctcccagaactaagagagaagtttatttaagggataaacatttattaacccctgtatgtgatagaggctggggatacagcaaggcatgacatctgctttcatagagctaacattcttgtggagttgggccttctttcctttcctgaaggtgttcccttaaagttgaggtaagggacggagaagttctcaggttcatcatattttgtcttctcctttaggcattccactgtgcagagccctcatcccggcaagtggcctgtgtgcctctctttgccactttgatggcttatgaggtgtactatggactgacggaggaggagggggcagtgcctgcagagcaccaggtgaggtaggggagaggccaagccagtgactaattgggagtcaggcctcccagggtttagcaagcgtctgacttctgaggtgagagtggtgacttcatccaggtggaggtggcagtgttctggggatgggctcatccacctggcttgttggtgcctcctaatttcttatctctgcgctgccaggtggcaatggccgcagccagagccttgggggatgtgacagtccttgggtctctactgctccagcatctgctgcacttctccactcctggtcttgtacttcgaagtctgggtgccttgacgggaccacagcttctgtcccttgcccaaagtcccgctggctctcatgtgctcgatgccatcctgaccagcccctctgtgacgcgcaagctgcgccgccgtgtgctgcagaacctaaaggttagatttctggcttttgccttgattccccaccatcatccatttagagaatatgagctttccctggactgtaccttcagactcaaaaaggctatgtaattcctagactattttaattcagcccttaaactcttcagaaaattcactctccacaagcctccaaaatacttttgtggattttgctagggagacctactttgcttgtctccatacagggacaatatgtggctctggcctgtagtcgccatggcagccgtgtgctagatgccatctggagtggagcagccttgagggcccggaaggaaattgctgctgagcttggtgagtaccagcccctctctttgatgtttccagactctcccctctcttactccagatcactgggtagctgggaagtctactgaaattcaacagtctttagttccaaagggtggtcttgctcatgggttcttagcagtctgctttccccttccctcccgctgactgattgtgtagtcctctgccctcaccctgccctctgacttctgttctttggaaagtgaagtgttcactttatcccagtggcagtcccagggtctgggggaaatggagggatctttacgtcaagtagagtctgtctttgagcatggtagtactaaacatgagtggttccctttgcaggggagcagaaccaggagctgataagagaccctttcggccaccatgtggctcgaaatgtggccttgactaccttcctaaagcggcgagaggcttgggaacagcagcagggtgcggtggccaagcggaggcgggcattgaactccatacttgaagactgaggctttggatctgggactgggtgttgatgggggagggcaaaatggggtatccaccccatccctttcctggtttaaattggagtcagaagtcttagtggtaaatatttgatatttttattggaaatgtttttgttagtttgaggggaagggtatgaagacagatctcaaggtaaagtcagagagggctgtcatcagtatgctggggagtttagggacaggaggcattggtaggggattagatgtagcagcagtcaggctgggatcaagatgcctgggggacatcttgatcttggcctttcagggcaagtgggaggctagaaaggtggctaggaaagaacagcattcttcaggtaagggtatagacttgggatgtgaggcgttatgctgaaaggttctgtcacgaggggatcagaggacagtggggaaattgggtgggttatctagcctgtactgtctgcaggtcctgaaatttgatgctgtcatagtctttgcagtgggtcggttggaatgattctgggggcagaagctcagagccccttagtaggaatggaggcggcccttctgctgccactgctcagccccctccactgcatgacgaagggtggaggaaattcccagcaacatatggcccaggccttgcagcagtgtggaggtccaacgaaggagctccctgaatggcagagacaagaggaaatcagatgatttggaaaacttgggaggaagccatcaagctgggagatgaggactttccacaagcaagagctaactaggggtaggtgggtgcaagaggacgaattatggggactatccaactgtaggggatggggcagtatgacatgttgatttctgacctgagtactttctttgggccaagtccttgaaagtcacaactcatagagtagagcccgtagaatgtggctttgacattcaggctgccaaagaggtctcgagggttttgcttgtacacgtcaaaggtgaatcgggcgatgtccttgctgtgcttgggcctctcccgtcccaggccatatgacagcactccactctgtaggacacccttgtcagtgcagtagatcctcataccagacacccaccactaatctccatcagcactgggtcagaccctccctcgcttggactttctgtccactgtgtgacatccttgacaattccacaactcctcctgcacctggtccccaggatcagggttaagctagagaggaagcccgggaaagctctaaaggacaggcattggaagcagccccagtataggcctcttacccttgtagggctccagctctgaccagactgcaacaccatcaggcacgtgtcatcctccagcagctggaagaagtcctcactgtccactgcagttccatcctcctctagcaccagggttagcactccattcagcagtagggtctccaatgcctgcccaatggcaagaagcaagaagggcaggtcttatcccatgccccttccctctttagctgcccaacatccatcagttggctctagacattggtcgatgtcccactttgactttctggcactttgatacctcctaaaggttgcagctctccgtgttcttcagtttttgggggatcctagctagaggctgacctttttcctctttgctcctaccatgtcattggcatctccccttgctcccctccaagtcacttctggtttggaattggaaagcaagccaggttctcacgaagtccacccttctgtcttatctacaatgctgcacctcacttcccacaccctcaagagttctccagaagtgttttcagtaatagtgtttaacctttttgagtccttactctgtgccaggtatgaggactttacctacattatcctcttactcctttcaacaaccctaggaggtgatgtattattattgcctttttatagttgaagaaactgaggttttggtaggttgaacaacttcccaaggtttgacaggcaggaagtggcagaatcagaatttgaacttgatttgtcacacaaatcacctttccatactagcttctgaattccgtccctcgaactctccctatctcctgctaacccctgctcccatagaaaagctcactaggtggaaaatgaacaaattgaccagagctcattaggcccactccgctgcttttagccctcagagggaggggcagctgtgtgacttcagccctctgctccatcatcacaagttgccactgttgtggagccccttggctacccctgctataggaaccgaggaacttggcctacttactttggctag

SEQ ID NO: 16535 - DNA, 17037 bp, Human
tctctgtccccactccccacggcacctccctgcctgatgcatcaccaaacagcccctcctggattctgtttccttgtgtcttcttgtcagcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggtactctgtacccctggaagggggactcagttcccacccaagcctgagtggaaaggcctaaacatcccctaacccccgaggctacagcgggggtgggggacgtgaaatgagattgctcctactctgatctccctaatcccaaacttgagggcagctcactcatgcctggggctgtagagcagctgagaaagaagggacagacttgggggtggagggagtcagaatatctggtagagccagcaggtcaggggttagctggtggagccagtctgagggcctggctgctgatgtcaccagtctgcaacctgggatcccaggacctccctgggcaggatgagttccaggaccaggcccctgggccaatttcatagggctgagcctggcttgggctgcacagaactcggcagcaggagcctgtgagagcagaggtaggcagcctaagcttgggaccagaaggtcggccagacagggctgtgggtggaagggcctgcctgccccactgcccttgcagcttcttcatccgggagaaggggctcctcacatgcccagtctggtaggaatcagcctggtgccaggggccatcacagcggtggctcccaccaaagcccagcctaagcccccagacctcacccctgctccctccctagcatcttctccccatttcccgcccagaggcctggcctcttctctccgccccctacagcagtttggcccctccctcccacataagtcacttaccaggtctgtccctgcggcatccagtctgtgggtcctgtcccatccatcctgacctgttccatctcagccccaggactcagtactgcggttgccaacactgctgccaggtgaggggctcccacgggtactgtggtgccgagtccaggcggcccacactatcagaggccgtgcctggatccagcaaggtggggtgtgggccagctgtgtacctgtcagccccagctaggctgttcccaacaccaagactctgctttccctgtgcacaggctccgggcacctgccatgccctacccctcctggcagccccaagtggggtcttccctgacttgggaatgccaaggaccacaggccccggggtcacttgtctgtcttgtgaggaaccttgagttgggggatttctgctaagaaatgagttctagaagctgtcagtgttgtgcacctctagactgcagagctagcaggtggacggaccaggcccagggatgctggagcactctgatgtgtgtgcagctgggtcttgaggctgggacaagtgtccatgcagggaactatgtggatttcctgggatggatcgttgagtgggtttcttcattgggcagtttttcggatgttgtttggtgggggtgaggggaaggcttttctctgcagcatgagaagcttctctgggtgagtctgaatggtcttcgcggaaggtctctggatgtgtctggagaatctctgggccaaggtgggattgtttcggtcatcgggtgggactgaatcagctgtctggatggagggtttctgggtcaactggctgggactacctgggttaaggagccaccctgcctcttcctaacaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgaggtgaggccggtctgtcctcctcagctgagagctaaaaggctttaatgggaccagagactcagcctggcatttctgggggggataggaagctaatgataagggcctgggctcctcatggggcttcactgacacggagctgtgtccttgcagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggtcagtggggcttggattgggacgggtgaaggccctatgtttggtggggagaggctggcattagggtcagagaggtctttaggctcctccctgccccactcctcacctctgccagataaggcaggtgcaagtgtgtgggtgtgcccctggggttgtgtctcagagagggtcttggtgttgcagtttttcccaagcccatcctcctcaagcctcctggggcatcggtctcagagtactcctcttcagggcctgcctcggtgcctccttcggcattgctgctctgtcctttgtgcatctgttctcattccccaggatgtggctggttctctcttctatctctctctctccctcttgccttccatgtcccccatctctgccaattctgtctctctctgtctctgtccctctgtccccatgacccaaggcaggtgcctccctcaccgcgttgcttggtgtagcttgacttctcaggctggtgattatgctgctgcctggggcaggtgactccttttaccctttgattagggcctaaccttgcccacctcatcctttaatttcccaggaacccctaccacctccaccagggatgccctgggctctggaagctgcagccccaggaagcaggcagggttggccttcaggatcaggactgccctttcatacggggcaggtggatctgcccctccagcccaggcactgtgatagtcaggcaggcagaaggtgacaggagccctcgtctctcctccccacctcagagttcagtgtcaggggaacaggtttgggatgttggactgcggcactgccctaacatgtgggcaagcattgggtggagacagagctgctctaagggagactgtcagagaataaggtgatggcccaacgtagggacatacacagtggctcatacacattgtgggtggggccgggagaagtcccaggctccatcccctctcctcagggaggccttgccagctaattgctgatttcctactctaggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccaggtgagcagctggggtctggagcagagggtagatgggagggaaagacagggaagggcttcctgccctcggatgtggcggggtgcctaggtgcctgaccccaggagaagccagcctcccattgggcagatgagaggaccgaggcctggtgcagaaaggtggccagcccagggtcacacagccagccacacctctcctggcaaaggcccctggctacagccaatctcctccaccatctgtcatgctccccgtgtcctcccacagcagtcctgtcaggctaggggcatccccgcattttcttctgtggacatgagtcctgcagaactggccagaagtaggtgaggcccagggagagaactggagggaaccagttttgtgtgttctggggacacagaggacattgtgtacgtggaccatgaggattggcggcaggagtatgttcttaatgagtctgggagaatttactacgggaccgaagcacagattggtgagcggacctggaactacggccaggtatggtgcggctggccagggtcacatacacccagaggagctggggtgggtgtgggggctggggtattggagcagggtgctggcctagggttcaggctgtcacctctgccctccatccctccttccagtttgaccacggggtgctggatgcctgcttatacatcctggaccggcgggggatgccatatggaggccgtggagacccagtcaatgtctcccgggtcatctctgccatggtgagcaccctcacatctctgagtcctactgtgtgtgtgcctgctgcctcgccacacccccaccctcctcctgccctttctggattcctcaagaacccccagccctgtccctgccctcgtaaaggatacttcaggaaggggtctccctcctcttctctcccttgcctgccccccaccccgcctttcctggctcctgtcccagctcctgtggaatgtagggccaaacccaaaacttggcacacccaggattcacattcctgtgtcagagcccgggtgggaggggggcagatggctgagggaagggctgggtggagctcaggctggtgtctggatcctgaggcatttaggggtaaggggtggttgcaggatcggggcccggctggtccccatggaccacatggcaggtcctgagcccctcctccacctccgccctatctcatcctgtcctgggcaggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacaggtagtggagggactgggacaggagtggcccgggccctacagggagaagggaggaaagccaggcttacccagccctgcccagatgtggctacagtgcagggtgcaggcgggggtgggtaataggctggccttaattatcattaattagtgttaacaacagagagaggcctaagggaaaggagggagaagggacaggcaaggactgagccaggcaggtggcctagcttcccctgaccccaagtgctctgtagcccaaaggccttgtggcccccgtggccctgaccctggcagtctatgcccagcttggcaatcctagttgcccttctccccctgatactcctgacacgatgcctcacttgcccccaacccatgccttgaaccccaaccttcgctcctccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggtgagctggggtggactgcccatctgtgctgaagaatggtgacctgagctttggaggtggagggtgggcagggctggggaggctggggaaactgaggactcctgaccctggggctcagacccagcccctcctccatgtccatccaggaacttccatgtgtggaacgactgctggatgaagaggccggatctgccctcgggctttgatgggtggcaggtggtggatgccacaccccaagagactagcagtggtaagctgggccccccactccccaccatgcccctgcttatctcccccacctgattaacacagtccagagtgtcagtgctgggccgggccggagagccaagccatgtaaccccgcggcttcttaaacgggtttgtcagctgaaccaccacgtggatgttagtttatttttaccattctatataactctctatttgcctacattttacttatttataatggtttattttatttataatggttaatatacaagggaggttcaaaattcaaaagctggaagagtattcagagaaagaattcatattcactattcttacttgctttttaacttacatatcctggagataattaactgaaggaccattttaaagtcatttttataagtaatacatgcttggaaggaaaaaaaaagtatagaattgaacaacacaaaatgtaaagcttccctattctctctcaggaggtatttgggttttttttcaaaaatatttttaaagtaaatttctaggttctactccaaacctgatacattagactttcccaggatagatgctaacaatgtatatttttgaaagttcttctggtgattctgacgatcagccggattttttgacccactccaaagggtggccagagagatggagtgacctcctctggggcacagagtggtaggtcagtgacagagcaagtccagtccttttaagcacatactcttgctttcaacgagttccttcctgtctgttccattgctcactgtgagttatatatacagcatagaaaaaaatcagggctcagataggttcaaagaagaaaatagcccttatgaccctgccttaatatataattactgttaatataaccaacgggtctcttttctgtgtccacatacatgtgtttctgcagaaattagaactaccatacactctgttctcaaacaaacccccaccccttcttaccgtgataccccagccccaggccaccaggcctgccctgccagctaccttctgtccagcctctcccttaccccaggtcagagagtcctccctagcctacattcctcccctggcctcttcccagtgccctccctctcactcagatatgtgaacacagccccatgagctgtgcaacccggtgatgcctgtgatgctgaaacagcctgtcccagacgctggcagatctgagctctggcccccaactctgggaagtggtggggtggacatcaggcagggggctcagggccagccagactggggcttgatcccagcctgatcacttctcagatgtatgctcttgggcaagcacctcgaacttttaggctttggtggtttggatgtaatttggggtaatagataccatatatggtgattgggaggattaaatgagaaattctgtatctgaagggaccagcagcatgccgggagtgtagcagctactcaaaaagtctgagctcctttcattctccctgcaccacctgtcttgtgagatcctggcatgaacttcaccttgctgtttccccgtctgtaaaggagtgtgtagtgttatgtcttgtctaagattctttccggttggatggtactcacttaccactctgtcctctcctgccaggcctcttcctgtcagcctatctcttctagacagcctcctgagtatgataagggcagactctatttcccaccagctccccccagtagaaagggcagcaggctgcagagctgagggttgttccgcatctctctggaatggtggtggcggtggtgtcctcgctctcccagccagcaggcagggccactgtggactctgggttggttatgataaaggatggggcgtcctgtcctctgggggtcacagatggtggacatccagtgtcagccagccatgaaagagtatgtcagggacttggttatcaggcaggctggtccgcacatctgtaccctgcccccatcctccagcagagcagcctgggctgaggaaagcagattgagagccaaatggagccgctctctctttgttttccatacctgtgttgcactggctgtcaactgacccccaagtgtttgggtcagggctgatgaccttgttccagaggccaccaggcagtgggaccgggcctgagtgggtggggctggggccctgtgtggaccttacccagggtctgaagagccctctccgccttctcagatctcttgcctctgtcccgcctcactctctaggcatcttctgctgcggcccctgctctgtggagtccatcaagaatggcctggtctacatgaagtacgacacgcctttcatttttgctgaggtgagggctgggctccaggtgccttcttgggcttcagtcatgggttctctggtcccaacttcaccgctgactgaccagctctgcgacccggggcaagtcactcattatacaagtcagtttcctcacctgtaaaaggggataatcaaggctgccttgcttcctatactcgggatcagaagagataacgggtatgaaactgcttcactagtcgtaaagtcagccattgagtgtgagggattactgatattgccaaagtgctctgccaggagcctcccagaccagcttcttccctgcactctggcctcgtctggctcgtcttggaaagtctccccttgggctctgccaggaagctcccacccttgggaccaagccctgtcccatagctcctgggatcaggggaaggaggccgggagtcaggccaccctcagaccctctggctcactcattcctgctcacccccaccccccacaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggtaccattcccccaacccagccagctctgggccccacaacaagtgttcctgccaagtgcttggccacccacgtgggaattggaacctcacccttgaccctcaacccccaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctgtaagtgctccttacccagccctgccccctggatggctgggcacctcagggctgtggacatggagaccccaggagcagtggggagtccctgggggaagcctcatgtagggaagcaggcctcagtgacgccatgcctcttctccacagcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacggtgaatgcagtttgctggggcatgaggggtggtcagagagtgaaggccaggggataaggacatcagaggtgggcgctaagccagcagcaggctggcctgatgagcctttgtaggagaaggtcaaggaccggctctggggcctcagtttcctcatctgtagcatgggatcttatgtctctggttctgtgacagcctttattgaggaataggttggagtttcttctctgacttctggggaatcttctctcaggaggataaatgtgggactcggggaggttttgcttctaagcagcttcccctctctggtgcagtgtacggtccccgtgtgtttggccagggtctctgacgtgggggatgggcctctttttctctcagttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgcttccactctggccttccccacaggctgccctggctcccagctttgctccctctctgtctggacaagtatgttctgtcaggacccaaccaagcaggttggggccagctagcaatacctcccggcccagctcagtcccaccagcctttagggagacctcttgggcacctggtgctatgccatgtccttgccctgcctcactatctaattagggagcagaaggcccacataggaatcattagtaactcattgctaatatttgcccagcactgaagaattgaccaggccctttcaggaatattatctcctttggacacaaaaactctaatttaagtacattagaaggccaggtgtggtggctcacacctgtaatcccagcactttggcaggccaaggtgagtggatcacttgagcccaggagttggagaccagcctgggcaacatgatgaaaccctgtttctacaaaaaatttttaaaaaattaaccaggtttggtgctgtgcgcctgttgtcccagctacttgggagtctaaggtgggaggatcacctgagcctggagaggttgaggctgaagtgagccatgtttgtgccactgcactccagcctgggcgacagagtgagaccccgtgtgtctctctctctctctgtcacacacacacacagacacacacacacacacagagacacacacacacaagcgaagttttggaatcctaatgatacgggttcagctctagcacttactggctatatgcccttgggcaagcgacttctctccttcaagcctcagtgttctcacctgtaaagcagggatagcaatagcccctggacctagggttgtttagtgcactgcttggcacaaagttagtgctccattggtagttgttatttttattattgccattattacccccacttacagatggggaagctggcggtcacatctcatatggtctcacagctcgtagggggcaaactctgctcttcccactgtggtgcataccatgcacaggctctcaaactcattgtttgttttgtgccatgagggccaagtagcagttccagaggagagaactccatccctcaggcccttacccagcccgtctgggcctgatcctgggctgggcaagcccctgggtgtagtgagggcacacacatgctgtgttcctgggcctgcggctgtcatctttgatacagacttacacgtgctgccccgtccccgcctaggaaaagcacggagggaaagcagagcaggccagagcctggccttctagatcagccttctgggacaggggcaggcttcatcttcagacagcgagttcctgagaaagaacaatggcttggggtggggaaactgaggggaggaagcagaggaccccctgcccacttgcccacccctccctcacacacagcagctctcctggtggtggctgccaccttcgccattaggccaaagctgagaaggaagctatgttgatctttgccccagcctgggcccctgggaatgctatgatgtgtcacaaagtagggctttcctcatgtcaccataccatggtctctggcagctcagtgaacagagcctgaaccccccgggtagcctgctctgctagtcttgcccagcaggcatctcttacccacacccccaccatggtggggggaggttcctcgtcctaagggatccgcagagctggacttgcctcagcagccccaccaggcctttgcctcttggccctgcctggaagtaaggaaagggccactgtgctgagtgttgggggacctgtttcctgtctttagctgtagggtttatgtgagtctccctacagtaaaagacagggttggatgatggtttcttaaggcagatcctccctggacagtctgtggctccttagctgctgtgagcccagaccagagcctccagtacaattgggagcctccagggggacatctctgagctgttggttcaggtacctaagattccaagatgggtgtactttgcctctcattcgcacatcagaggctgtggcatggaaccccattatagcataaggtgtgccacccccctgtggtgactggccacttaataaacattccagaactcactcctccagatggctgttgtcaccaccaaaagcagtcaccagagaggctggaagtctgttccaaacccttcctgggaatttccctcagagtctgaatcatattctctagaatgtcctcagagtggtcagtctgccttcttaggggtagatttgactttgcagagaaacctgaagtcatcaagagctaagactaattaataagataagtgaacaagtgggtaactgcccttttccatcagaaccgaggcatgctgtggaaggaaggacaggctgaccgtggcatcactgagcacacgcctgtgtgtatggtttaaatggctctgaagaagagtccaggaggagttttaaacatgtttcaagcccaggcaatacgattgaacaagtacacaattggacaatgctcgtttcgacgtctaagttctggtgtccttgttggggagttggtttcatgacccacactcagttccaggaacatcccagctttagcagatggcttgtactcagcttcagctcacaaaagaggtgtggtaaagtcccccacctcacaatgagaccaggggagggagagatcttgacatttccacctagaaaacagtttctcttgaaaataatccgttactgcaatgtaaaggttactttctgaaatattatagttcaattatggtatagagtaaatagacttctgagggctggtctgagcttgaacaaccttgaatcttgtatctatgaaaagttagcaaaaattaagagtgcaaatttgtaagcagtcaggacatagcctagccattaagttatagactaatttatagactcctatcatactacgttctattatatatccctgcctccctccttcagggagctcgagaaacaccaacaagataatcagatcccactcctccttttgggttcgcttccattttatgacccagaaagtgaggaacagagaagttaaatagcttctcataagcctttttttcacagctaacaagtggtagaaaagggagtagtgaggtccaggaaacccctcagaaccaggttccaagccaaatcgtttgccctgaaaaaaactcatccttggagttagggatgttggctcattctcttagagacaatagttaatgcacaggttctatgtctggaaagggtccccagcggcaggcttgggttgaatagggcaccagaggtaaggtttaggcaaaggcaggaaggacaaattcccacaggcacgagcaaatgcaatataaatgcagtcatgttcagtgtataaaatgaaacgtgcagattgctggaggagctcagagaagggtgagtttccttttcctagaggcaggaggtgctcaggggagccgtcactgaggaagtggtgtgccaggccttggaggaaaagtaggccttcacaaggacacccagggtggggaggcagagctgggtgctcattccacacaaggcaaagactgcaaagcatgactgtggaggtgagtctggggaagaaggcattcggtagggctgctcagcaggaggaatgatggggggtgatgaggctgtgcaagtagcagggactgggtcagagtgagcctgtgtgtcaagttagagagccaggatcgtgtgccacaagcaccaaaggagcactaaatccttgaaggatttagttcacctctgagtggttagcagaacagaatacaaaagtgggatgggaggcaaggagtcccgttagaggactagtgaaatcatgattcccaggggaggtctgggaatcaatttttcagaggcccatgtggaaaggagaaaatgaaaacactggttgtgtgtgtgtgtgtgtgtttgtccacccacctctctgtctctctcacacacacacacacacacacacacacacacagagacataagggtttatgtccatttaaagatgtctgttgtctgttcttgggaaggattttccttttttttcaaagataacatccttctaatgttttggtgtgtgaaaatgctcttttctctttggaacgacgatcatagcagagagtgattacttttcttcaacctatgctcttgtcaaaactgaaagtatttgaaaatattgtgttgggcccccaaagtctcattttgaagttttcttggttttggaaaccccaggtgagatgaggatgttctgtctggggcaggagcagtggtgatggaggggatggcatgagaggcctctgcggtggcatcagcagtctttgtccaggtggatgtgggagcagggagggaggagtcccagacgatggggagagttccagcacaggcagctggtgggtggctgctgagctggctatgcagaggcgccctggggatcctggtcttgggtgtggaaatttcaggtaagcctggaattgtctgaatgggtccacctcctgcttcttcctcctgactgccctggatcagctcttactccccactccacccccaattactccaggcccatgaccttgtctctgcccacagggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatgaagctgctgctctgtccatctttcagtccatgccacaccaagacggatggagccatggtttgtcccagggctgcacatggccttcctgtatcatccactgataggggctggtgtccctcaccagagagagggaaccacaagggaagttgaggctcagagagacagagtcgatactctttgtataactctcttctacctggaaattttcctgtgggtgagttttggaggattttggctttggtttgaatgaaactgttcccttacctcagggtttttcaagtgtagtctctagaccacttctattacaatcactgaaatgtttattaataatccagatagatgggccctaccatagacttcatgtgtcagaatccccgtggaagaggcccagaacaaactcaccaagagtttgactcctgtgcacactgaagatcaagaacgatgccctttcatttttcttctcagctgttcttttttctgcattcccactgcctgcattcttcttgggctagcagtagccatgagatcatgtacctgatattctggtcctgaacgcatgtcttcttgaacctttaagtttagaaggctttcaagacaaagggctcatggggcaggaaaaagagagctaaaattgagctgttcctactagctgtaaacacatgaacaaggtgcacaccttgaggcatcagtagtgtaacatgcacaagaagaaacaagcccttcccttaaggtgctcctgtccagtgggggtgacagacatgcaaacattctaaatacagtaaatgcgtatgtcacacttaccaggaaccaggctccaagcactttatgaattcatttaatccttacaataaccttatgagataggttctgcatggtagtagagggatgttcaggatgctgaggggcccagagaactgtgattctgcctgggctgatacagaaagtcttcatgaaggtgattaccagatgacccatgaaagatgagaaaaagtcaagtccaagaggcaaaggacagaggaatcacccaacacgtgtaaagcacagacatgtgagacaacacagtatgtttggaaaatgcagacagctggatgaggactggcatatgggtgcatgatgagtacaaagtggcaaaggatgtgcatgaagaggtaagcttgggccagttcattaaaaatccttttgccatatttaggagtttggactttcttctgaaagtaagggggagctttcaattagggatgatatgatcaagttttgcatttcacatgattcataatgaaagcaacatagaaaagaaattagaggggttgggctggaggtaggaagatagagtcctcttgggatgagagataggagaacctgaattagggtagaagcagtacgaatgaaaaaaaaagggtgggtttgaacgttgtataggaaatagaactgattagacttgataacagattcaatttggagaggagggagggcagagataagggtggtggcctgagtttctgactcatgggtgccacgaagagaggtgccatgcacagaaattcgaagctcaggaggaagaccatattataaaagggaaggtagaccaggcacggtggttcacgcctataatcccagcactttgggaggccaaggcaggtggatcacaaggtcaggagttcgagagcagcctggccaatatggtgaaacccagtctctactaaaaatacaaaaaaaaaaaaaaaatagccacgcatggtggcacatgcctgtaatcccagctactcgagaggctgagacaggagaattgcttgaacccgggaggtggaggttgcactccagc

SEQ ID NO: 16536 - DNA, 114139 bp, Human
  misc_feature (1)...(114139): n = A,T,C or G
aatcaaattagaagcatttttctgatagaaattctatcacatttggaggtctcttgtcttgcctcagaccctcatagatctatgattttctcacaacctttataatcttgagggttttcttctgctgagaaattcaacaatatggcaaatgtgtaacaatgcagtcctttctcagtgcatttttttccaggtgctttctggtagagctctattagggatataccttgcgagcaggggtcacaacccctgggctgagaactggtactggtccgtggtctgttaggagctggtcgcacagcaggaggtgagcaggctagtgagcattaacacctgagctctgcctcctgtcagatcagtggtggcattagattctcacgggagcatgaaccctatgtgaactacagatgcgaaggatataggttgcacacttcttatgagaatcaaactaatgtctgatgatctgaggtggaacagtttcatcccaaagccatcccccccatgccccgccccagcagtcagtggaaaaattatctgccatgaaaccagtccctagtgtcaaaaaggttagggaccactgctctagagtcttcaggtttccactcgctagttcaatccactgcaatgctgctttcagattcttatgtctttatcagggacctgggataacagaacagaggcattaattttttattaaaattcactgggtaaaattctaataactctttaatggaaggaactgaactgtacatgcatgaaataaaatttttgtaggcattttaaaaaaatgctgcttcaaagttctatgattaaattaattttctaactttagaaattagactaaatgtatatagagtttaaagccaaaccattaaaacaaaataattatatggtattcagggatgatttagttaaacctatctcttgaagtatgtgcctctgatgtgtttaaaatgacaaactggcttctaacatttttgtgcccatctaacaacagtttgtaaaactcagctgcatactcctgtatcaactatatctatataaatacataattagatgcctgggatatgtgagcagaaatgactagtcttctaattaaagaatggccatatgattaaatgtagtgatatcttgggactgttctcaattctcttttctctgccttgtacttgagacacctgaagaagttatgtttcttccttatagattccagcattctgttttccactttgaaatggaaactcacttagagtattaatcaaaagattccagagttactggagcttcagtagtatccattgtgagaaaagaggaaaatatgtatatacataagggaatctgtaggcataagaatcaagagaatggggttcttttgatttaaaactgtgatcatcataattgatgatcaaaaaatcctaacaaaaagcaattaatgaactttattaattgttaaaataaggactgccaaaggcttccattgaagtttaaagtaggaacagttcataacctctgaatttcacaatttattccacataatatagtcaccagattatagtaaagtgctaacaacatgtggttaaacaaaaatgcaagtccaggcaccatggctcacacctgtagacccagcactttgggaggctgaggtgggaggatcacttgaagtcaggagtttgagaccagcctgggaaacatagtgagactctatctctacaaaaaatttttttaaaaaaatagccaagcatgctagcatgcacctgtagtcccagccactcagaaggctgaggcaggaggatcgcttgagcccaggagttcaaaactacagtgagctgtgatcacaccactgcactccagcctgggacacagagtgagaccctgtctcaaaaaaaaaaagaaaaaagaaagaaaaaaaagcacagataaaatactaagccagaaaattttttgtactctctgtaaatgagaaaatgttgtttaattttgacatgtattttgtcacttttacgttccagatctacggaagacatttgagcaggaacccctaggaaaggaagtgtctttggaacaggaagtcttactccagtgtcgaccacctgaagggatcccagtggctgaggtgaataacaacaattctttgcatttagcaattggcactaagttattctaacagaggcctaatccatggctaatggtgcagtgaattagggtatggcatgatgaatggttggtaatagagtcctaactgcctgctgctggcaaaatagattgattgggaactgattaatgacttgggagtcaattagaatgccccattggacaaagccacaggcagcttggtttagttttgtcattctctttcaagaaatcagaaatactgctttattttgtctggcacttatcatagagagatggtatgacttaacaatgtgccatcaattttattattgttcttgctgatatgcgaaaaatgtgagtgtaagaagagagtgtgtttttctgtgtctgtgagcctgtgcaccttacatatgtattttccattccatgatgaagtcatagacatacctaaaagccatgcccacacaccttgcataaaaacacattttaggagtaaaaggtgtcaattagtttcatcctataaactttccatcaagtcctacattttccactttttgtttctgctagaacaaagcctattggttgctaatgaagtattacaaatcagatgcataccatgacttttcattagcaacacacaataccatgtcctttgaaaatatctctctttggggaagaggactctgtgacccagaagagattgcaagcactcaccatcatcttagatcacactgttgaggaaaactaatactgtgtctttcatttgttaacaaataaatcctaaactctaaaaacaggttaccctttaaatgattattaggagacatccttatatgcatctgacactattgccctaattgaccccgtgtcctacaagtccaagcacacattaatttgacaagtggcatagctgccagtttggtggtggtccttgttggcctccaaactacactgagtcatttgaaagttttactctctattgcatgtgttgaaagaggcatatttcagttgttgcaattgggacctatatatgggttcaatgtatatgaatttttaaaaattaagccctgaagttgtgcctatctctgaaacggaaaaataatactaatgagactttcaacatagtccataaagcaattaataattaataatgtacttactattttacttctcatagttttccatttttttcaagaagtaaagatggggtcaggtagttagctggtcccctgacaacaagctcaaacatctgattgttcttttaatagtaataataataattaattgaaaatttaggcagagtccttatgaaataaccccatttttctatcacagccattcatatctctatgagtcaatgcaaagaactcaaaggaaattttaatgaaattcctttttttttactttgaaagagagttatttttttgccttaatttggcatctcatgccaattgtatcagagattttgcttgatagtagctatttcattcaacagcatcaaaaccttatctcgcagcactaagacacagtatgatttaatacgactaggaaggagaaaactcttctctattcaatatttcattttgataatgacaatagtgcatatgtcttcttaatggtatttctaaaatattaatgcacacctcctccatgaaaccaccttaaaacccaaaacagatcatgagcaacatgggtatccatggcatcatttttgctcagggcttctaaaaggtaactgatccttgcaaagactttaggtggggggagatcttagtaatttcttcatttttttcagtctccttgacaaagtagttcactttgtcaaggagtaaagattcatgactgcaaactaattggctgtgaattctatttgtatcatcactagggaagagaccaattaaaacttggcaagctcaaaaatcatatacccatttgacattcaaagaactatatttaatatgcatttctttttcattttttaaagtcagaagagagatcaaacatacatgctcaagagcaggctaataaattcctgtgtagattcttttcaacactattaaaatcaccaagatcagaaaactaatgaataccttaacatgacatattacaactgccatttgctcaagaggagcagatacgttaaaaaagaaagggatgaaaggtaacttagtgagttaaaggattatacgaccattttccttctaatataaatgcattcattatttaatatttcatttatttgtttaaagaatctttaagcataaaaataggataaagtgaaatattgatcttaaaggaaaaccagcaggtaaaactcatgtgttttgtaataattagatcagtcgttgggagatgaggccagactggatttgtgctccttttgtctccaaggcaaatgattccaagaaagagtcaggcaaaatatgttcaatgaacatatggctgattgtttcaattgatctttgttgtataagcatatggctagttctattgaggaagtagtcaggtacattctttgcagaatgtcaggaagcagtaattccttttctctccaaatcaataagtttttcaagaactctagtcttagttttgatataccactttggctacaaataatggcataggcatttctaaggtaataatattttacttcttccctattttggcatcctatagtctccaccatagaatgttttctaattttcttacagaattccaggttcaaacccaaacatcaccattttttactttggccaaagtatttaaatactgtgaaccaaagtatcctcaactataaaggggagataataatagtgtctttgcagaatgtggttgtgaggtttaaatgagataatatatgcaaatcacttagaacatgtcaaaagcactcaagaaacattggtactattgttatattataattttttaattcacacaagaccaaactcaacctcttaaattcaaaattcttactgagtaccttgcccctcttcttggcactgtggggtatgcagaggggaagcttctgtcaccaagattctctcctatgttctctagtcagttgctttggctggagtccacacacgctacaaatgaagacaatattgtgagctttaaaataaggaaatgctctttcaacaacactaccaaataattggttaatgaaactatttatagcaagtcatggtgtactgctgcccttaccctgatgttttgttttgttttgttttgtttgacacggagtcttgctctgtcatccagactggagtgcagtggcgtgatcttggctcactgcaacctccacctcccgggttcaagcaattctcatgcctcagccttctgggtagctggaattacaggcgcacatcaccacgcatggctagtttttgtatttttagtagagacggggtttcactatgttggccaggccgatctcaaactccatgccttaagtgatctgcttgcctcagcctctcaaagtgctgggattacaggtgtgagctaccacgcctggccccttaccctgatctttaaagctactattgttcattcagtccttatcaactcaggacactagaccagcccttatattttctcccaaagaggaaatttagcctgaggctactctttgtaggtcttcttttcagggcccagggaaagagtgtgacaaagtaagtctcagaggaggaagaggccaaccgaggactccttatacttctttaagccctttccaataagaaaacaggggaccctagggctgaagcacaagagtttcagaactctagacttgcctgctccttcgtctgttctccctaaagtcctttctttatatctggggactttattccaaagatttaataactgcatggcttccttagcacgagagcagactcttgggggcctagcgctctatcagatataaccctttagccaccgggtcacagggtatccagaaatcccagggagccagccagggcctgcgggtgagggacactcagtaatttagcaacagatacagaactgtttccacatcgaatacctggcatggatgaaccagtgtacctggctaaattgcagcccccacatgccacaattttatatagctctgcctaccgattgtattgaaatttatctgtttactcttcttcttgcctgacaagctcatgatgaaataagaagcaaaaagttttttgttcatgttttatctctaatgccagcaggttataagtcacttagcagattctctaagtatatttaactaaatgacagaaagaggccctgctggatgtgacatggaggcagcacctcaggagatggaaagctctagaaaaagggtgtttctcgtccctgaagatgcaatcctattgagagatcttggtgtgggatgacagactccatcagtctgaaccctgagggcaaggttccaaaccactaggaccaggaaccaaggccactgggagtgggagacacttgagttccaggactataagggaggtgtcaataataatatataaattttcaagtaaaccaggtgaaagaaagaaaaacaaatcccaggaatactctaaaatgatatagctcagtgtttcctttaataacacttttgttaggatcaagccaaaaatgtgattgttttcttccatttctggtgaggcatttgcctttctttcaacagataaaccttccccccatctccctgaagaagcaagaaaattaatacacccatggaactggtgctgggttattccactagcataatagcagcactctatgaaattaatcctctttgctcattttattttatgcctagaaaatgttactgtcacatggagagccagaaatatattccgagatgctttatcagattatctcttttggagagtactaggatcaaaacatcaatggatacaagatttgttggcatggcagaaggagcaaagctgaatttttctctaaaacctgtgatttctttcacctttaacaaggggataattgcttctctaattataattgagctatttctcataggagtttaattggaggaacagggcacaatgttcaacttattgacccagttgtgcttagaaactgtcatcttatttatcaacatttgcatctctaattagcaagtaggaaaatatggggtgaggtgcaaaagaatagattattttactgagtatagtcgtgataaacagggaacagatttttttaagctgatactgacagggcagaaaactggtggcagctggaggctccgccaaatgtgcagcatcaggtggctctccatctaattgattattcatatggctgctgaacactttgtttcatgagtccttcacgtttccttgccattcttccataataggaacttcatattgatgaatttccatgcagctatattgtctccagagtggtgctttacactcttttcaggcaaaagagtttagagaggaaagaagaatctgaatactggtttggagggagatgttgctttcagtgcccagtaattacccattggaattttctgctaccacgtgtgtagctacaagacagagttttggttatgatatgattctcagccttgaagacaggttttcaaaagtattaggttcccttactagcagtcagccttcaagctttgctttggtccaatcaacattcgccaaagtcacctccttattatgatcatcccatactttttggggtgaaaaagtatgggaaaaatcccatatttttttctgatatctgcctctaatagttacacacagagatcaccacaagcccagaaacactgtaagccaaattaaaattgcaataagtttaagcaacataaacatgcattttaaagcaaaagaaataacagattttatctgacttattatacatctgtggcttgatttttgcatgtacttagtggttgctttaagcctatagtataaaatgcagatttctaaaaatcatcaattcacttatataagaaagatttactgcagatgcatggtatgccagacatttttctggttgtaggaaatacgagtcagttaagtccctcgaggagaaaaacaataagcaagaatgtaagaaaaatgagtgagatattttcagataattacaagttaaaggaaattacacaaggtcatatgagagagggtgatggttgttggggattgcggatgactttagaattcaaggaaagtctattgaagagacagtaatggagctgagatctgaaggtaaggaaggagctagtcttgaaaagatctgagtaagaaagctccaggtgatgggagcaacaaggacaagtaccctcaggaggaggtgattggttacagggttaaaaaggaggccagtgtgtctgagacccagtgagcaaggaggaaggcaggacgacattcagtcaggaaagagggaacgagggcgcagacttgcagagacggtaagtgatttggagttttctttaaatgcctgaaaagccaatggagacattaaggaattgtcgagacctgacattcacctttaaaagatcattctggttgctgcatggaaaatagattttagaagtgcaagaatggatttagggacacctttatgggtttatttaatgatgaaaatctagaaaatatttagtctttcagaagaaactgaaatgttccatgtggaagttcagcagacccaccagaatgagctttattcagatgacctaagatcaatggttaataaacctcagctgtggccgggcgcggtggctcacgcctgtaatcccagcactttggtaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgcgggaggctgaggcaggagaatggcgtgaacccaggaggcggagcttgcagtgagccgagatcgcgccactgcactccagcctgggcgacagagcgagactccgtctcaaaaaaaaataaataaataaaaaataaacctcagctgtgttcgagcacggtctctatctcagtagagattcagcagcaggcaaagacctaacctgtgcccatagtcacagagcaggagggttttcaaaaatttttgttggccttcatttgttcaaaaaaggtttttcttcaataagttcccttgctttgggatttcttccaataatttttatatgcctacacacactatcataaactcattatggagtcagagagagcaaaaagcatgtatttttctacagatggtcagacttagctatagacctgaacacttttaactggtaaataagaagaaaggctgagagttacttatcctgaaaggcaagtttatagtaaaaactggttaggaactagctacagattagtcaatttgttgcccttttgccctgtaaaagttagccttttacggacacttcaatgacattttgttcccttggatggtgttattacatatagtcattttactttaggttttggttattttattttatttggttgttgttggtattagttcatttgtcatcatgcttttatctcctcatagttgaacttaggttttagaagttttcagatttcaagacaagttcacctctgcaatatggcctatgtatgttcaaccctcaaaagcaataagctagacatatgtgcaattaagagagtgtttccccagcaggaaaacaaattccctttcttggcaaatgcctttcctttacagaagtaacaacaactgagcaaaatgccactagtttccacttggtatttttatcctttggctatattttttaccattgtctaaagatataatttcagcttgcttaaagaccaacattttttttaaagcacaaaaatacccagacttgcacaaacctactgaaaggtgcaaagtatatttcacagtggtcaacacagaagtgaatggatacttgtttttttccaaaactgagaagcaaaaatctacaaagtagcctctggtttttagcaagagagaacatccagcataattatccacagtagagaacttttttgattgtttaaagcacctacaagggaaggtgagatacctttcaccagtgggagaaataagaaaataatagtaggacttcaaactccggagcaattagagccaaacctacctgtgaaagtctacagaagagtattagctatcaatgtcttttagaattgtcaaggctttggccaggtacgggggctcacacctgtaatcccagcactttgggagcctgaggcaggtggatcacctgagatcaaaagtttgagaccagcctgaccaacatggtgaaatctcatctctactaaaaaaaatacaaaattagccgggcgtggtggtgcatgcctgtaatcctagctacttgggaggctgaggcaggagaatcacttgaacccaggaggcagaggttgcagtgagctgagattgcaccattgtactccagcctgggcaacaagagtgaaactcggtctcatttaaaaaaaaaaaaaattgtcaaggccttgctattctaactgtggtacatagattatctacatcaacacgatctaggagcttagaatctcagacccagaactcttaatgaaaatcttagcaagatcatcaaaccagtcttcaccaggcacagtggctcataactgtaatctcagcagtttgggaggccaaggcagtaggatcactcgagcctaggagttcaagaccagcctgggcaatgtaagagaaccccaactctacaaaaaataaaaaaataaaaattagccaggcatggcggtgtgtgctactccaggaactgaggtggcaggatcactcgagcctgggaggtcgaagccacagctgcagtgagccgtcatcacaccactgcactccagctggggtaacagagcaagaccctgtctcagaaaacaaacaaacaaacaaaaccactctgcagtactggttctcagaagtggaggcacagtggaatcacctgggaattgttagaatctaccaatgcttatatcccacccagagattctgatttaatagacatgatatatagccaggttatcgagattttttaaagctctccatgtgattctaaaatgcagtttgaaaagctctggtgtaaaggacaaagttaaaacaaacaaatacacaaaaacgtcagatttgtcacttccaaaccagtcagtaaaacttggcagattcccagctactagctaatgctccttggagaagcttggcttggctgagtgtacatttgataatagccccataattgcttttcccatttgtttgattaatgtacctatagacaaggattctaggctaaatctccattcttttaggtgtgcacacagttctcaactctgctatatcattttcaacctgtgctctgacttgatgggcctcagtatgagtttaacagagtaacctttctgatagacgtggagttttctagctaatgcttgctggactcacttttcatgttgggtggcatgtggcagtttccctctgttaattagaacaaatgtgccaattatgttaacgtttctcccgataccaatcagtgaataattagacacaacacatctgtctttcacaggagagtataataagaaaactgcaagatgttttgctctctattattgacatatatgattagacaattccttaaccaatcatagggttaacaagtttgtgtatcagaagggcaaaggatgccaaaagtggtttttggagctgagaacctctcattgttagcatggtcctgaccaaagtccacctatctctgaagtatctctgcaaagaatttaattggtctttccttcctttttaacaacaacaaaacattacattgcccttttggtaaaatgcagggatgttgtttatttatcctgaactaaagaaataaacaagttcttaggtatttgaaacccttaaaaagtcaactttatgtaaaaggttacactaaaagaaatcacaggccgggcgcggtggctcacgcctgtaatcccagcaccttgggaggccgagcgggtggatcacgaggtcaggagatcgagaccacggtgaaaccccgtctctactaaaaaaaatgcaaaaaattaaccgggcgcggtggcgggcgcctgtagtcccagctactccggaggctgaggcagaagaatggcgtgaacctgggaggcggagcttgcagtgagccgagatcgcgccactgcactccagcctgggttacagagcagaactccgtctcaaaaaaaaaaaaaaaaaatcacaaaattcagcctacaggatcatattgaaggtgttataaacatgtaaatcagaatcagattataatttgttataatttctacttatatgtttccatgatatatgaactttggagcattctgattgatggggaaaaaatgattttttttttgtattgttatttactggcatttgcatcccatacttggcaaggctttagaaagagatggggttatagtccaattatttcataatataagcagtgcctgcttgtattgattctaaaagtataaggaagacacttataaaatcaacacattagtcttcttgaagatagtcaaagtgtatcagaagataaagctttttgtttcatttggaattaaaagtctataccttctgccgactatggctcacattcctaaatgcttaatgatattcagctatgtatttgtatcatctaaaggtgcaacatcatcctttcttatcataatgtctatattattgtgattacaaatatattctccctcttgttagaaacagaaaataagacttgaatgtcagattataaatttttttcttactgtgacactaatttgcttattttaaaaaggaacaactcagaaaatacattaaatatattggaaaatagctatgattactactcctagtgtcagacattccaggaaacccccaaatatatgaatcaccctgggacacattccttctgcccagggcattgtgaagaatgcagcactgagggagaggccatagttgtccttttttaaaattatatcactttgccccagatatttgtcttctgttttttaatagtaaaacatgagcatagttataattctaaaacttttgatagcaaaccatgagaaaaattattggaaataagtattgtttggaaaataactgtcttatctaaatggggtcccattatatacactctaaatacaagaacattggaatctgtctttggtagcttcatttttatcatgtttaataataaagatgagaggggagtgaatggaagtgagaaaatgactacggaaagtcaagataaaactggattataacttatcccatatttagtgaccagctataaatggataatccactggaaaatttaatccatatttctctgtctttgctgatactgtaaataaataaaaatttaaactgaagaataaagtatttaggaaagaggtaacagagcatttttgaaatgtgagggttgctgaatgctggagttgctactcaaaagaaattatggaagcctgagccattgaaaaatgatctccttgttttgctacaaaacttctctttccctgacaggacttaggcagccaatggttctgactattataaaatagcagtaacagcgaaactataaaaccatgagtctaggagctataaaaagttgctccttaaatcacactgcacacaagtagggatggcagttttatacaccttttctgggaacataccatatactgtcaatatgctctagtcctaaaaattgtaatcaaattaggaatcattcatattcgttaataaaatcatgttagtattttgagaacactgtaccagactgaaggcgtcagtagaattgaatgacctcactgttggagggatttctaaacactttctccttctactgcaagagctggaattggtccccatgtagaaaggctagagatatgacatctcttctgtacatacactagcagggattgaggctgtaaataagacgacactttcctcactgggagtgttttatgtatgaagactcataaaccactacctatagtcctgtgcagtggtaaattgaaagtcagatttctttcaggtgtttttttggaagatattattaatttggtattatgaatttgaagatatgtacatgtacttcttaatagagacactaagaggcactgaatcatcattgtttaaaatacatttaggtaggtatagctttgtgtagggtcaagttagttctagggaagaggcaattaaattacacttattgactgtctcctaattccaggtgctttcttttcgtatctcatttaaatccccctacaaccccaggagggatgcaccctccatttgtacaggtgaagattatgattctgggagcttatagcctgcgcaaggctgcaagctcaattagtgggagggctgggattcaaagccaactctgcctgactccaaagcactgttttccttataacaaaaaaaagtttttttgactgtatgttttcaaaatttggttcattataatgacacaaattgtctgtgtgatctcatttgataattttcataagctaatcagataaaccccaggcaaatatgtatttggggagaagtcattcatttaaaaagtgtcacatccatctcatcaattttctaaaagtagagaaagcacatttcattgtgttgtgtgttattatttatacacacttcataaataatgaaaatttttagaaatttttgaatggaaaagagaaattcaactccagcatccattaatgattttattattgaagaagaataagactggaggacaaagtttatagagagaaggccaatgtgaggagatattgtgatggattcacacctattgcagtgtgaatcgatcacatcatattcagcacttattatgttttttttgtatttgttgagcatccagatggaattatctaaaaagtaattggaagtatgaatagagcttaagaaaagttgggactgaagataacgatttgtgagttgtcagccttgagagtgaataaagtcactcaaccagtgcatatctcattctcaaacctggctgcacattgaggtcacctgaggagtttttacactgattcttgggccctttgtctgcccaattaaataagaaccattgaaggtggggccccaggcatcaggatggcttaagcgctccccaggtgattctgatgcaggacaaaggaccatgatataaagtagaaggaggagaaaatgagagagagggagatccttgagaaggactatatgaaaatgctggatgttataaaaggaccagtgaaagaggtttgcaaaagaacagataatcaagtggcaggaaagacagcagagggaggcttttcagagggacagtggagctgtttgccatagagaagagaagatgcctttggatttagcaacgagaaaggccactgatcacctttgaaagtgaagtttgagtagagtggggatcaggaatccagacatggctaaatggaagagtgaatgagcaggtgcatagagagggattgggaatatttcactctttcaaggagtttagccactaagggaaagagaagtctgaagcatagctggggagggtgggtgtgtcaggcttaattttgttgttggtttgtttttaggttagaagagatgcaggcatgtttctgtattacttgagactcaaagaaagagcattgggggagttgatatcttttggactattcagtttgttgaaacagacatatgccatctgctcagattaaggaaaattacaaaaatattgagtactttgttggtgacccagggtctcaacaagcctacgaggacaaatattagaaagttaccagtgagtgaatttctgagtgcaagatttcaattgggcatggtcttcagagtggcatgtaaaccttcaagttcatgtcttctgaataaactttctcctttttcctagttgctaacacgtttcagctgaagtaggatgaccctatttttgttggtctttcattgattgttgaataaagactcacaatgtgaagattgttccttacagaattatatcacactgttgctcagcatcctcaccccagagcatattgcctgagaaagaaacaaaccacagtgttcagttatgctgaacactgtgagttctagcatctggaaatgtataaatagatggtgtctttaggacagaatttaatggaaaatgtatccattgaaaatatttttaagtatctcttattttatgctagatatcattcttccctgtttactaaacttttatcttagtttgtaagttatttaaagtaataaggacatgttgtagaataaattatttactatgtgaagaaatcaccataacaccagctcagagttatacagaagtcatcaaaagtgctttgacatatagtatccttttcaaacctcacaagaaccttatgaggaagttaggacagatattacttttcttgttgtagaagtagaaaaataaggttgagtgattttatgtgacttgctgaagagcatagactcagtgaatggcacagctgggtcctatctctaggcttttggccttgagacttgagtgtcttttggcaaaatctcactgggcttctgtgaaagtgcagcataaacacaactgcagaggcatccaggagacatatttggagagttccattcactgacctccaactcccactcctattaccctgttctttagtcttcccagttctcagccttcctcattctcccctggtagaatttcttgcttggtaacagaaccactatcctctcatgcctttgtgaagtgctctttaaaatttttgctagcatatccctaaaagacttaaaaaatacatatctccttgcacattttatgttggtatctaaaaaatattatcaaaaaaattaaatagtgggaaaagatgccatgtctgtgtatattataaacatttgacatctttaaaaagaattgttgacttaaagttatccaatggaatgcagacaccataatgatgtcttactcaacattaccgattaagaaaatgtaagaacaaactcttctttaatagtaggaaaacttgccaggcacaatggctcacacctgtaatcccagcactttgggaggccgaggcaggtggatcaactgaggtcaggagttcgagaccagcctgaccaacatggaggaacccccgtctctactaaaaatacaaaattagccaggcatgatggcacatgcctgtaatcccagctacttgggaggctgaggcaggagaattgcttgaacccgggaagcagaggttgcggtgggccaagatcacgccattgcactccagcctgggcgacagagtgaaactccatctcaaaaaaaaaaaaaatagggaaacttacagtattcctttttctattttaacttatatttctatgccatttcccccataggtttttactctaatagaataaattttaggcataaaaatttccattggtcatcatatttctctgtaataaaaatttgcgtataaactttatctcctttgaccatagggatcaaattgttaattttttttaaaaaacccaaatgtactacaagttttgataaataattacttggcataaagactgaatttttattggaaatacagcttttaataggagaaatgaggttttcatccctgctcgcctgtctaggtagctcatttagcctagtttgaatgctactgctgaaatgaaacaggatgaaatcaattacatttctatctgtcatttataatgaattcaaatactgagaaccttctcatacataagtaagtagaaatacgtggacttatgttgtaacagtgtccctcaactctgcacgtcttccaagttacaggtcaaaaattacatagcgatctgtcatcaaaatttatgttcagtgacccatcatttgacatattaggccctccttcagttttgatgaaagcaaagaatttaaaccacctgatttgcaaaaaggatttgtcgcccagttattacagtcccttattttctcaactacaacactaatattcccaattattcccttatctggtgccctagaggtttttacactctcatgtaatatatgatggcaagattttcatgcaaaagatgtctttcttctgaaaagcagagggcaagttcttagagatattagttataagaaggaatgcagactgggcgcagtggctaatgcctgtaatccagcactttgggaggctgaggccggcagatcatgaagtcaggcaatcgagaccatcctggctaacacggtgaaaccccatctctagtaaaaatagaaaaaattagctgggcatcgtggcatgcccctgtagtctcagctactcaggaggctgaggtaggagaattgcttgaacccaggaggcagttgttgcagtgagctgagatcgcgccaccgcactccagcctgggcgacagagcgagacaccgtttcaaaaaaaaaaaaaggaattcatatggaagttaaagatatactgtgattcccttaaaaatatttttgtttgtatatctcttagaaatttttgcatagtgctggatacttgaatccagccctatcttgaaatcctagcaccctgaactcctctttatctgcagtgttcccttagttatttatatgccatgttttaggaaactttatatgatttagtttgttatttctccaggtcatttacatgtgaagagatccttctaatagtggaatttaaaattggtctctcttaatgacatttcaagtcattgtcaaaaatttgggggagcaattttggagggtaaggaggctttcctgatgcccctaaaatcaaagcacacccaattctactgctagttctgaaagtaaacctgtattggtcctatgagtgacagggtcatgttgataacagaaagtgtgtccaatgcttcttttctaaggacctctctgcttccctggggacaccagcctgaggacagcctcaacccaagtcctggagtagctaaaatgtatgtgtcttggtgtcccagctttttccagcccctatctcgtaatctgcagcccactctgtcaaggctgaagtctgtagcactgtagttggctcctcctggttcttggttttatggacagaaaagagtccagagctcaggcggtcctgaatttggatctctgctcctttctgagcttataaacctgtgcaagctcttctctgtgagcatcattcttctcatctgaaaattgggaatgcaactacttctttcacaggctgctgtgaggaggaatcactaagtacaaagcacctcgctggggacctggaatgcaccatacaagcttcttgtttttctccttttttacccttgggcaacttctctccattcctcccaactgcttctctgtcgtcccaatttcagcacaaggaaaatgttcttcttttgaactctctctgctccctaaagccaggtcaggattctcatgatttgcattagggagtacaaggtgccctcttcccctcaaggtcacatcccctacttttcctaccctaaagaatggtcattattctttaacacagaatgtgtcccataattttcacttctcctttcccattagaccagcccatctgccccagaatcctttctgtggggagagagaaaagcaaagaagagagctcagggacaactattccatgtgtgtcatcaaagccatggatcgaaggctgctggaggtggcaaggtcaccaagtctgcccagaaagctcagaaggctaaatgaatgtcatccctaatacctgccaccccagtcttaatcagtggtgggagaatgggctcagaactgtttgtttcaattggctgtttaagtttaatggtaaaagactggttaatgataacaatgcatcgtaaaaccttcagaaggaaaggaggctgttttgtggactactttggggtttttttgtttcgttttgcatgtggcaattattcgtttttaaaatctatagtttttaatggaaacaacttgaccaaaaatctgtcacagaattttgagtcccatgaaaacaaagtttaatgaggaaaaagatgggggacagtccctttttggggaccagtgcagtcataggaccaacataggtgtactttcagggtggtagggaaagcagaggtggctggaagaaaattccatctcttagggacatggataagggtgttgaagctaatgatgtgtatgccatggtatggggctgagagactgatgtcattaaaagaacaagtagactggcttgaagtactaggagaaaagaaatggaaaacccataaaagtaaattaaaaattataaaaatatagatggtctaggtaaaaataatagtaatataaattgcctatcatttatgcctcattaccaagtatgatagtgaatatttcttttattttaataacctgtgtttcattaaaaatcttttctacttatttttttaaaactgataatgttttcttatactttagaattagaaaataatttttatgaagattaattaaaatgttaatacctataaagcaaatgcatgctaatgacatctctagaattataaactcatagagtttaaaggaaaatatgtatttagggttagcatacaaacaatattggccaatttaatactcaattacttacatatttgtagtgcaatcttgaagagttataacctaatattgagtggactttgccccacagaaatgccagcgaaggctgaaaggactcaggtgttaaatatttttcttctagtttttagattaacaccatttctcttttattttttagggttgtttggggtttgtctcaccgcttttagtatatccttaactaaatgttaataattattttcaaatacttaactgtatgccagacagtaggtgtcttgtgtattaattcatttagtttttaagaaccttataatgggttctaaaattatcctcattttgtaaatgaggactctaaggcatacagaagataagacacttgcccacgggagacataaacattagctccaaaatcgcagagttcagttttgggcccaagcagttgaaagcagccctcttagctggtactttaggaactgctccttagaataagatggtcgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaataagatggtcgattacacatagtgggactaataacaccaaacaacagcagaataggcaaacaggtcattctaatattgccgtgtaactgtttttagtacctgttaataaaatcccatgcctttataaacacttgagtaaattagttcaaatatgccccaaatcattgaaaggactatagttactgaaccacaaggacagaaattgtttgaacattattttgcatcattgcaaccatgacaacaagtcatggtttatggttgaagtcttttattgttttctgaactccaacctgtttttctttctcttggaatatttttatgtaactaaaaataatttctaactcagaaagactactttcttgtataaatcagtttgttcaatggaaggagtagagaaaagagaagcctcaggttgaaatcaacaaaaagcattgaaatgaccaaaatatgaacagaattcagtggccagaccagagtactgactcctggttaaccaagattagcttacaaataaatagctttgcaacaatataattaactacatactattcaatgcaataaatttctaacacaacaaaagattctgtattgtttcttggaattttatatacagtgtatataaggagactcattgtggaattgtttcacatggaagaatgttagtttagtagtgtgtgttctggaaatactgcatgaaaaggttatatgttttaaattgtatgttatggctcttatattgatttgctgattcagacaatcctttacatgataaacagaattattctcacacactgttttcctttccattcatcttctaagttttattaacgctttatcatttttatctaagccacaatggtaataaatgttgttgcagccatgctggccctgcaaatatcctttttatcaatatccatgttcagttcttaatgctaagataaagctgatccaaaagaagcagaagtcctcagggttatttttaaaaattatttcaaaactttaagagaaaaactcactttgttcatggaaataatgggaatttttagcaacttacctgttgtcaaaatcatgctgtgctagctggattccttgtgagatcagccaaatctgaatcattatcctttctaccctcaattactttctgcctcctgtatccctgctccgtaaatgggtccttaagccagaaatggaagatgagtgccccttgcacccccctttccacataccgtcaactcatatgtcctgtcctctgtcccttccaattattgtctgaatccattttttttttctccctgtctcctatccctatgccacttttttcttttcttttctgttttttggagacagtgtcttgctgtgtcacccaggctggagtgcagtggtgcactcatagctctctatatccttgacctcccaggctaaagccatcctcctgccttagcctcccaagtagctgcaaatacaagcacatgccccatgctctactaatttttgcatgtttcttatagaggtgtggtctcactatgttgtccaggctggttgtaaggacttcagcgctgacactgagtaagagaaggagccattaggagggtttgagatgaggtatagtgtgatggttgatagtgagtgtcaacttgattggattgaaagatacaaagtattgatcctgggtgtgtctgtgagggtgttgccaaaggaaattaacatttgagtcagtgggctgggaaaggcagactcactcttaatctgggtgagcaccatctatctaatcagctgccagcacagccaggataaagcaggcacagaaacataaaaagtctagactggcctagcctcccagcctacatctttctccctcagcagcacatttagcaagcgtcccatgctggacccttcctgacctcaaacatcagactccaaactctttagttttgggacttggattggctctccttgctccttagcttgcagaaggcctatcgtgggactttgtaatcatgtgagttaatacttaataaactcatatatatatatatatatatatttatttagttctgtccctctagacaactctgactcatacatatagtatgctctgacttacagtttatggatcactctaactacagtcttgaaaatagacagttgagttttcagaggaaaagcagaagataagacaaacagtgtttgcaataattcaggaaggaaacgatagtgacttggaccaggaagaggtgggagtgagggaatgagaagtggtccaattcctaatgtgtgctgctctaacattgaatgggctaagaaagaggaaaaaagtggtcaacactaagtcaggcttttgtctaagtaattggaaggctacagttggcattaagtgaggtgcataagactgtgagaggagcaggtttggaaaggcggttcaggaggtcattatcagacaaccaagtggagttgcatgaagacagttggatatacgagtctggagatcagcggtggggtctgggctggagataaatttaggagtcatctgtgtgagactggatgagctcaccaaggaagtgaatatggatagaaaatagaaagcagcagaattccaaggaccgagccacagggacacaaatgttagcctaaggaagctgtgaggcatgaagcaatgtaggacaaaacccaggaaagtgtgctgtccagagaaagcaagtcaggaggaggaagggagtaaccggatcacgtgctgctgtgagtcaagtaagatgagcactaagacctcagcagcacatttagcaaagagaaaggagcagctatggtgaagcagtggaagtgaacacagattagagcgggctcagtggggaattgaagacagcaaatgtaaacaactattccaaggagttttgtaaggcagggcaagcagagaaatataggtggtgggcgggggggtgagtagaggcagaaacgggtgagaagggtttttgttctaagttttgaaagctaacagcacatctgcaggctggtggaaatgattcagtatcaagggaaattgaataatttaggagagannnnnnnnnnnnnnnnnnnntgcccttgaatagaagagcgagactaagatacggagtacaaatccgaggtgacagataggaacacagagagctcccccagtgataagagacagggtgcagatgggggtgaggacacagatagtgggagagccctggaagatgtcttgtgattgtcagttttctcagtgacatagaaatcttggtcatcagctgaaagtgaggctagaaggggaggtagtggagaggagtgtgaaatagttatctaggagaaggagaaagtgaacaatgaaaacataatgtgctttcttggcagaaataaaggcccacttgtgatctgttatgaattttaagatgagcccactctccatggctatttacacccatgttccacctcaagaacacagagcggggtgccgggcatggtggctcacacctgtaatcccagcactttgagaggccaaggcaggcagatcacttgaggtcaggagttcgaaactagcctggccaacatggtgaaaccctatttctactaaaaatacaaaaattagcctggcatggtggtgggcacctgtaatcccagctactcatgaggctaaggcacaggaatcgcttgaactcaggaggtggaggctggctgcagtgagctgagattgtaccactgcacacggtgagactttgtcttaaaaaaaaaaaacaaaaaacaacacacagtggtgttgtaggcaaatagtggccaagtgaatatcttgaagtgacaaagggatgagagcattgacagtataatgcaagaatcatatataaagctagacattggaatttatacttgaaagtctgagaaacaaattggtaaattcaatagattgtaggtgctggtgaaggattattgaattcagtatcttagagtgaataggaaagacagaaaagggtaaaggaaaggataattggaactaagtttatggaggagttgtaattgatgataaggacaagagctaaatcatgcttctcaaactttagtgtggatataaccccctgaagttcttactaggatgcatattttgatttggtaataggtgggcagagccttagattctatatgtctatcaagctcccagtgacactgatgctattgatccagggattgcatttttaagggcaatgatctagactggtatttctcaaccctaacagtaaattacaacccttggggagcttaaaacacactgatgctagaccagtgaattggagtttttgtgggttggatttagcttctctgggttgaatttagaattaatatattacaaatgttttccacattattctattgtgaagcggagttgaaaacctttggcctagaatgtgtgaccttagaggataaggtcattgcaggatggagggtcatggaactgaagggccaagacgttggaagcgtcacctttgtggttattaaactcttcagaaattatgctttagataaagtgactataagcccagaggtctgtaaataactacaaacaaaaaaagagtcaaaattgggtgatataatctggtgacatgagattcaaggcaaagatgtttagagagaacagtctgaaagacacaatgctgagcaagcacagcacttacccatccccagacccagtggcacattggatttgggaaatcaacatccaccccttcagaggacttcagaagaaacaatggcatcagaaagacctagactttagtatgagaaaaacgtaaaggaaacaatctaaaaagagaccaaaatgttagaagattttcatgctgtcttccaggcggtatggaagagtgtcaggacttctggagttggtgatgtgtagcccctggtattacagcacaggaggtgaggggcggcctgcagtcctcactgagcctttcatggagatgattgtctcaaagcagagtgctgtgatatggctggcagcactggggtgttggggactgtggggtcttgtcagaagctggaggagtcctgggcccccctcttcattcccgcagctattttctagctgtaggaccctttgcttcttgaaacaaaggcgtgaaagcaaatccagtatggaaaacagataaaagcagagtttctgtgattcaagtgggagttaagggaggagagcagtgtcccccacaggggtcgtcaaacactgctggggcttctcaggggtcctgaggttcaggtcagaaccactgctccaacacaggcaagagacacccaaggcaaatgtgtaattatgtataatcgagtgaagatcatatacccagcaatcatgtctcttcaaatcttttgtcaaccatgcagattgaacactttcttccatgtaataaactcttcatacaaacaagtggtttctaatatcccttgggacttctttatgttgtttatgattaggataacatcactgttaaactgacatcatttacataggaggaaccgtagttttgaatagctatgggttctccagaggcaaaccatgaaccaaaggtatgaatgtgagtagttttttaagaaagtgcttccaggagaaccctgtaagtgggtgagcaagcaggagaggaaagaagcctagtacaggttgaatgttccttatacagaatgtgtgagaccagaattgttttggacttcaggttttggagtactggcatatacataatgagatatgttgggaatgggacccaagttcaaacatgaaattcatttgtttcatatgcatgttatgcacatagcctgaaggtaactttatataatatgttaaacaattttgtgcctgaaacaaagtttgtgcacactgaaccatcagaaagcaaagggatcactatgtgagtcactcatgtggacaatctatggttgtttggtgtcaccgtcattcccttggggatgctgaataaactgtgtgttacgcacctgcattttgactgcaaccggtcatgaggtcatgtgtgggattttctacttgtggtgtcacgttggtgctcaaaagtttcagattttggagcatttcagattccagatttttggattaggtatgctccatttataatagtgtcaattcaggtccagtctcaaggatgtagctgcagcctcatccctgcaagggacttctggaaagttacagctcagattctgacccaatgagacagaagtcatatttctgcacccattagtcaatggctaatggggctaatggggaagttataaaaaatccttggcaaaaacaatccgtgagcctgagggctgctcttcagagaagagggccaggtatgagtacttgaaagagaagcacactgagcacaaaaattgtagaagggatgcaagaacaactgagactaagggagcctgtccatgctttgtgtgataggaggctttctttagaagggcatagataacctaggtaaagattccactcaaaaactattaatttcaacttttaattatcatcaaagagatttttaacagtataaattgtgccaccttctcccgtgcacttccagcaggatcgtatttccacacatagggtgaaacgttgagaaaatccaggtcaagtgaatatgagtatatatctcagagatactcaggcatatctctgactgaatgtagagtctgtatttggaaacaaaatacatatttaaaacacccactgttgtaaatagattctattctttttctcactaccctgagtgcaaatatcaagaatgtttagctttttcagcatttacatcattacaaatagtttctctactctacaacctcatatgtttctatatttcaggattgttgttgatttttatttttctctataaatgttggcttctcttctaaggattagaggagcattatttgagagtccctgccttaagtgtaatttagagttgtgcaatgtcaaacccactgacagatttagagattaatttctagacgtcttgtggtgctagagtagctccttaaggttttgaaaatggcaacaatattgactccctaccactaaaggttacctgtatccacattcaccctaatgcaaaaggagagtttaagtgtggtaaatatcaacgttgtttgttgttttgctttatggaaaaaactgtgcatagaaaaacaaaaggcaactgccagaataagaagtagtttacctccagaagaacagcttatacaggtatgtttcctctttttattcagcaagtataacatcactattactacattaatattattcacatagaaaaaaatagttcagtagttttaaatggtcatgtcttaaggtcaggttccccaaaagcacaccctgagccaaagatttgaatgttagcattatacaaaaggagggatttgagtatgatttgtaagctattcagattgtattaagaattggtagaaaaacttaaaaaaaaatttggcttagatacatctccaactatgtgttttgctacattttgaaaggtattttcagggatatttaatccatacgtttcagtgaggctacacgtaaaccatccaaatgttattttattacagctatgtgatgtctaaaatgccttttgtgcttttaaaaatagtctttctattcttttctgaaaagcagcaggtaagttgccaagagtaaacaaatcaaatagtgaaaggtttgagttcagtttgaaacgcttatcctattattttttattgggttctgaacttggcagcacacattccccattcgtgcctgcagggcaaagtgaaaacaatttgaacactgtatttcccaactggttcactgacatttgagaataatgtagtacagacagaatcagcatgtttggcaggtgagtgatacttaacatgaccttggaaagttacttcccaccagtttgcagaagttcatggcctggaacaacattgtacatattacaaaacacaggtatcgcttctcggccttttggctaagatcaagtgtacaaaatgcaggttaggacagacagccatcaggggatccatgctgaggatttatctacttttctcatttatctttaggtggaatggttgaaaaatgaagacataattgatcccgttgaagatcggaatttttatattactattgatcacaacctcatcataaagcaggcccgactctctgatactgcaaattacacctgtgttgccaaaaacattgttgccaagaggaaaagtacaactgccactgtcatagtctatggtgagtggcccttcagggtctcaatctagttcatgtttaactgcagtttctcgttggcatcggtaaagctagaagccctttttttaaaatttcatattatttgagacagggtcttgctctgtcacccaggctggcgtgcaatggcatgaccgtagctcactctagcctcaacctcctaggctcaagggatactcccacctcagcatcctctggagtagctggtattacaggcatgtaccaccatgcccggttctagaagctccttttcaatctccatcgctgcttgcttgctgcttttcacaggggcaatgaggtttaattgctttcctcgtactgatatgaaaggataggctcagacaacctcagccctttctcagtcagcttctaggaaagcgaaggaagcctacctgagtgcctgctgcttctataagccctcttctctccagaacctgcaccaccaagatctagattgagttctaaagatgaatatgcttctgtcagcctgctgatgtttctgtggacctaacacctcagtcttatcattgcaaaccctcagaaagcgggagctgacctattcccaaaatacattagagcaattttagcttcttataactcattctactcactccatcagaggtgtgcagagtgaagataagggctgccttatctggccaagtggccctaatcctaacgatatgctaaagtccaacgaagcaacttcttaggaagattcctcccacaccctggtcctttctaagccagctcatctctaaacctatcaattctctggaagtactaagcaatttcataccccattctgatgtggcacatatgcttttatctccctgtgtggtttagcactcagttattttctagtcatttcatgagtagattcatctccccagctaaagttaagctccttgatagactgagagactggtctatatatttacatatttctcacaatgttagacctctaatagttcctcatattattgatgttttactgtctcagaggaaattgaacaacctgggaagtatttagaggttatgctacctccagaatgatgtccccatgcctcaccacctcttagaacataatgaagatttttatcactgttttagtgttaaactccgtgggccttggagtcttactgactgaaggagggggagacccactggcaagtatgtggctcatagtacagtcagtcatgtgtcacttaatgatggggacacattctgagaattgcatcattaggtgatttcatcactgggcaaacatcatagagtgtattcacacaaacctagatggtatagcctactgcacacataggatagatggtatagcctattactcctaggctacaaacctgtatactgtgttactgtacagaatactgtaggaaactgtaacaaaatggtaagcatttatatatctaaacatagaaaaggtgctataaaaataagatatcaaagataaaaaaaaagataaacctgtatagggcacttactatgaatgaagcttgcaggcctggaagttgctctgggtgagtcaatgagggagtagtgagtgaatgggaaggcagaggacattactctacactgctgtagactttatgaacactacacttaggctatagcacatttgtagaaaaagtaaagtaatacaccacaatgttacaacaactatgaggttattaggtgataggaatttctcagctttgttataaccttatggaacagaccattatggtatatgaagtctgtccttgactgaaatgttatggggtacatgataggactgaaggagttaagaatttgtcaccccaaaatatgccacttggcatattgactattttctgcattaaaggtccttgagaaacagcgggctcaagatcactctgctagtcctgtctcttaaaagcaggagaggagattttcagctgaaagatggcttccctataccagaaggaaagtaacattcttatcctcaaggacaggaagttgagaccacggggaagttacgatccagataattctgtatcgatcttattaaaataactcttaatcttcttttagccttaacacataattgactttttcataacttgctactctttgtccaattcaatatataagcattcaactataactgcatctttgggtcttcattttcttaggccatgtaaaagttatattaagtaaatttacatgtttttctcctgttgatttgtgttacaccaatttaattcttaggcccagccaaaaaaaaaatcctaaaagagtggaagtaaaatattgcctaccccacagtaccattcagatggatgtgtgtttatgagaagagaaaccactatgctgttccaaaggatgaatgtagtgctgctttaaaaatgtcattttaattacaggaaaaatggcacaaaaattttttgatcctctgattaccctgaggtttaatttcctagtccagataatggctgtgttgaattgtatgcaattgcctttcttaaatcacaataaaatgttttcttcttcttatctctttttaaactgcctgaaagacttgattaacaacatttgaaatgcaagaaagaaatggggcacaatcacagcatgtgccagtcataaataactaatgaaggcagactatatatagttgtattatatagatgtttaatgcacatgcaaatctcttcctatgtatattatgctttcaatatccataaatacaatgaatgtgttgtctttaggaaggatcaaacgcaagtaacttagtatttagaattaaggaaatagctttggactggggtcaggaatattgggtcataggagtatttctgtcactacctgatcttcagagggtcttttaaccaggattctctgagcccttgcctccttctctgtaaatgaagggacaaacctacgatcttcaaagactttttcatctctgaaaatttctgattattcatttctcattaaaatcccagcagaacagtacatatatcctaaaccccaaatatcagcttgccagtatgctagtaagcagtttatacagacaattccatggcagggaattttgtaaacttgagcaggttaagttgctttttggaacactcactgaaaccctacctatctaccatctgcttgtcctttacattaactcctaaaataacttgtccaagcctcataggttggactcaccagaactccatagaaaacatatatatctaaccagtatttcatatttagcaactgttttatatattttttgttaatgtaatttttagattgcaaatatacatccattaaagaaaatttggaatacagaaaaggtcaaagaagaaaatacctatacctataattctgccacccagagatagcatttaaacaaaaattatatgtatactacttgaattttctttcttttttttttatttttttatttgagacagggtttcactgtcgcccaggctagggtgcagtggcgcaatcttggctcctgtaacttctgtctcctgagttcaaatgatcctccctcctcagcctcccaagtacctgggactacaggcatgtgccatcacacctggttaatttttgtattttctgtagagatgaaggctagtctcaaactcctagactcaagcaatctgcccatcttggcctcccaaagtactgggattataggcatgagccactgcacctggcatatactaccagtactttatatgtatacataagatttaaaaataagcattatacattgttatattatacatcttttataatttaaaatgtataaatacatattaagtattgtatacatattatataaaattatatacatatacattatgcataatgtatccataaacattacttttatttaaaacatactgaaacattcatgtattatttatttatttggagagagggtctcactctgttgcccaggctggagtgtagtgatgtgatcatagctcactgcagcctctactcctgggctcaagggatccttctgccccagcctcctgagtaactgggtctatatacacatgctgacatgacctgctaatttttttttttaatttttgtggagctagggtgttgctatgttgcccaggctggtcttgaactcttggtctcaagcaatactctctccttggcttcccaaagtgcttgggttacaagcatgagccactgcacccagcctcatgaattattaaatagccttctacagtatcacttttaatggctgtccaggagtccattacatgaacatatgtggctggctttgccattgtcttgtttttgaacattacagttgtttccaattattcatctttatattaaataaagttgctgtaaaaaatgtttctgtctgtaaatataacattcatgattattccctattgtataggtttctagaaaacaaaatattgggcaaatgctgtgcacatataaggtttgtgttacttgaatggctaatacacttctttagtatcaggaaacagatgcatatactagttgtattatattttagctacaaggaaataattttgttagaaattgtttaattacaatattgtacagactcacattattgaagtattaaaaatatatatcaaagtattttctaaagagaggtctgcagaactgaatagtgtgcagtcttacggtgtaggttttacaatcacatatgctgacagctccatcagacatcataattggcctttatacacaaagtaagtgtttatttcaatatcaactaatcgccaagtaactcaaatagccagtcaatttgtttataaccccagtactgtaagattttattttttaaccaggttcactggtttgtgcaagtgaataaaaatccttaaaacgttgtaaagtttacatatgcttaaaaaatcaatcttttttttaaggctaaattattttattctgttcccatgctatagattgacttgcaggcttttcatagagatgtaaacatttattatttgagacgagctgtcaaaagtaattttggagcttgactaggtgaggagataggtgtattttttaagaacactggccaaagaaaagagaacacatacagtcctatttatttttctgagtaggtgagtaaatcttgacaaacttttttttttctctgtctatacaataaaactttggataaaatgaggtccatggtctcttctggctttgaaattttggatttttataatggtcgcttggaaaaataactctttgtttacatattgtgtctgttttgtgtgtccatgtgtgttgtgcatgcacacatgtttaatccactttttactgtttgcctcctttcagtcaacggtggctggtccacctggacggagtggtctgtgtgtaacagccgctgtggacgagggtatcagaaacgtacaaggacttgtaccaacccggcaccactcaatgggggtgccttctgtgaagggcagagtgtgcagaaaatagcctgtactacgttatgcccaggtaaataaaccagtcctctcattccaagtatctcctattattcaagaaacatgcttttagagaatagatacacagactttattcttgatctgaatgtgtgatgaacgttatttaaatccatcctactcactgtttacattgctgggaaatcaagtattttcctccaaaagaatacttaactttgttaccaaaacatgcaaaattgtacaaaacaggagattaaacactactggatataatccctttatattattcaacaaaactgctggggccaagattgcagattttataattcaaaggatttgaatggcactggaagccacacattttaggaataacaatccttgatcttcagaaaaccgtagaaattaattggaactgaaatttagaaaatgttttagatggaaatattttatatttggtgtcagtttctggtgaagggcaaatacaacatttgaaatgaattataaggaatgcaaagttttttggtacttgggataatggattctgaaactacaatgcagtcagttctttgttatctgtaaatgttggtcatctatttttttgttatttgctgtagtacctacagcaagagtgcatgcatctctccacctcttagcatctttctgtactatctcatattgctaccagctcttatccctaggtaaatcgaagataatatttgccaaaagcaaaaacaaaaccctttaaaatgcctcgttatacaatatattccaaagctaagctaaaattttgaaataatccataaatttactgcactcattggagtagctattgtgttttcaattttattgttcagatacacagcctccttacttctcctttttgcctaatttggtcatgtttatcctttaacctttatcttttaacctttctcagagatgggctggacaaatgaactggagagatatacataatctacactttacattcccaagtgttgatttccaaatgtcagagcagtctcccacagtgagccctttgagagcttttatttatgaaacaaattttgacacttagctagcttaaaatttcagattttgttttataggagctgactcccacaattaaaaatgcactgatcaattagagttgaaatagaaatgtgtgtgtgtgtgtgtcagtgttttggtacactggattggtgcaggtcaaagcaaatgtttttgctctaagtagttgggacttgcttatacagccagttctgtatgactgaaatattaatgcttttctcatttttcatgtgggtatgtttataaccatatccacattatacacaatatatttacataataatttgaatatgaaatcacttagatttctcaaactatgtagactattaaaatgatataatttttactaatatgtagatataaaaggttaaggtgttcaagaaatgatgtttagcattgttttacattgaatccttgatcatcataattatatatttcagggaaaattaatattttaaagctcttatttcaatatttttatcctatttttgtgagaagcttaagctgcattttgaagtgtgattgaaatttactatatcttttttcaaactgagacttaagttgtgtgcttttaaaatagagatatctaagttcattatctttgaagttgctgacaagccagccaccaaaattaggaagaaagtaagtcagttctaaatgactgaatcacaagaaatattagggacttacctaaaattttttaataaaaatagaaacagaaacatcatcaaataataaatgaaaaataatagtgttttcatgaaaacattacaggtttcagcagaatcaagcaggccagatgaaaaaagtaaaataaaaagactatataaaatgcagttgaaagagaagagataaatagatatataccaactggatgaatgaatggaaggttggatagatttcttctccaccgtaccaacctcttctctgaattctcacatgagcttactttcactgtccacatggccctaggaatgaaggaatcctggatccaaagagagccctcctaattttcaatacaaaacccagaagctcccccattaataggaaaagggaaaccatcatggcctacttttacatagctcctggtgacaactttggattttgtatgtctcagtcagcctcccttggcttggtcaatgagaaagcactcacacactctataggaaaagctcaccaaacccaaatgatgtagaacagcaattgaaatgaatacagtgcttctcagtagggcatgcttgttcttgttttgttttgttgtattatatttgagctctgctccatcccttaagcagctgcctctccctctgacctcctgctgcattttttccatggcagtggatggcaggtggacgccatggagcaagtggtctacttgtggaactgagtgcacccactggcgcaggagggagtgcacggcgccagcccccaagaatggaggcaaggactgcgacggcctcgtcttgcaatccaagaactgcactgatgggctttgcatgcagagtaagtcaatttaagcaaactgcagacattgagggggctggagattgaaccatttggagttttttaaggaaacattagaaataaagaattctttcaacaacaataaaatgcaataacatagcaatattctagcttgctctcaaaattggaaaaagcgaattttccaggaaccagaataaaaagtaactatgtccggctaacaaatggcatgcaatattgctttttcatgagcaagggttgattctatcacttatatggaagggaaccattacttagttttatcagaaagcacaaaagagcactctaaactcctcacagagtcaaaacaagacttctaaaatgtaagccgtttattcttaattcatggcaggtacctaacgaaaatgtccatggagtgtaaaatagatgtaaagatgacaaacatttctgtaggtagatttaccttagaacgaatgtttagtgagaacatctctgcaacctcttgaaaattctgggtttgtattagaaattataatgcgggtatgatttagtttatttaaaggaaataaatattgataaagcatacatttttaaaatgagtgccgaagattggctcaggaatgtaatgggtgctataagctagatattctccatttttttcacgtctttgttctttagattttcttaattaagtggtagtttgatttcatacttgcaaactctgacccctttattgaggagccctcagatgtacacagtttactatctcttttcatgaccataaattgaggtattaagaattattctgaaatcatacctattcagattaatggatcaaaaaatgtgctgtctttggatctgaactaatggttgtctagtgttgacatttctcataatacattacacattgctagcagaatacaagcagctgaaggtgtttgtgcaaaggtatttgtacttgtcatttaagaataaaatattttgtttttaccacacttatgaaatcctgtttacttttcagagtctatacacacaggaacctttagaaagatatcttacttaaaatacaaataaacaattatgttgctcacacagaataaaaatccaataggcctcttatttttatgttcagggtacactgcattccccaagaacgggctgctgctgagtgtataaagcacagcttctggtaatgatgtggggcctgccactgtgaacctcacaagtttgtactagaaatgcataaatgaaaatcggctttgctaaccatttatctagaggtacagagtttgtttgggttgaggattaaaatagcaacataccacatacaagttagtctttttaacattttcatcacttagtatttttcctttactctagaacaaactgattcatgcgattgcaaagtagaaatagttggactttttctatctttctgcctttcacgttctttctctctcaatgtactatttcaatcttgggtgatttaatgcctactacttccattgtgcatatttacaaatcctcagaacaacctctttaacaaggaatacaatgccacgagacagaaccttttattagtcatagaaaatgtcacattttaaattatgacaaatacaaacatgatatattcaaactaagactttcatgacatagcaaccccttagcttctagatcatttcttaggcattcatagaattttttccttatgattggatatttgccagtaatgatggcatgaagtgtgtgtctattgacagggaagaggaatgaggctataggaggagattttttagttgtttgtttgtttgtgtttgtgtttgtttttgtttgtatttttatcacgtctcttgtttgatggaaacattttgctgttcgggttaaaatcattccatttaaagctatttatttctgcagctctgatttgctatagtaacaatccctactaagtcaataaactctttcatctgccctcctgtatccactccagtccaacagagaattgtagtctatatcactattgatttcctcagtgataaaaccacagagatattctgcactgtgtaattacagtattttacagtgaaagctatagtttctgtttaccagttagtttagtgtatctgggacagcattactgccaaagtcttgtaaaaaaataatattgtttggccattattttggaaaacaaaggcttctaacagtgaaagtgcaaagttcgcaagagggacaaggtcagtattaagaaaaagaatgggagtagaaaagatagccagaaagttgtaatcagcaattaggaattatcatttaatatttatttcctttgggagaattagtgtctggaatgcattaataaatagtccttcaatgatatcacaatttatctcaaaataaagctagtctactttcagtgaaccaggtaagaactacaacctctgaatctattcaaaattgtatacaaataattctgatataaatgtaggtgtactgctagataggagaaattcagagttcataatggatgttagtaggattcagagttacctagataatgtagcataatattttttcaaaagctaacttggtacttaagaggaatacaatgtgaaatatatagaaaatattactgttgatatttatttgttaatttgttcaaaacgaattcagatatatttccttgttaagcgcttaatacaaacacctttgactgaaaatatattaaaatgttggataaaatattgcaaacttagtagagacatacatgtgcatgcagaaagagagagagagaaaatacgtggtccaaaagaaagaaattagagaaatcctcaaatgccaaaaatgaagctgcaactccaagctagagaggtaacggtgtgagtggacaccaatataaccaggagcggggagctggatatggacatgggtcccggggactggaaatcagggtttcagttttggcacagagaagaagtcctggctttgtgagacctagacttggaaataagaaccctaaagaaagctgaaactcacaaatgcctgacctacccacaagaaacaactataacatttttgcccaccagccaagggaagacatagaaaaaagtggtaggaaaagggaaatgaagacttcatttaaataaaacccatagtaaaaccataacctcaccctagctctggtatggaatctaagatacagtgctagaagcaaaacacgaaagatgtataattaagcttctaggacaccagcagagcaaacagcaagccactatctaagtttcctttcataactaagttcattagtctaagacaaaaataagccacacctgtcaataagcttacaatacaaagttcccaatcacccaagaaaattgtccactgtaagggagagtcagcaataataaatgagttagcagtctactaacatgaactcatagagcaatctgaaggaaactatagagtaaagtagatgtaaaaagacaaaccatatttttaaaaggaacataagcacaaatgaaataacagaatattgttaaaaagacagatttggagaaaaaaacaaatggaatgtctagagaggaaggcataatgattgaaatttaaaactcattggaagatgaaaaatcagatacagctttagataaagctgaagagaaaatttataaactggaatgtagatcttatgaaacttctcacaatacagggaagttttgttaatacataagtgaatatgtaaaagagagaataaaactaatggaggatagaatgagaaaatccaacatttactgaataaaagaacaaaatttaaaagattttcaggtaatcaagatagagaggatttattactcataaaccttactgagtaaactactgaaaatgaaaaacaacaattggttccttaaaataagatgagaccaattgaggagaagctgaaaataagatggagctaaatggtagacaatattaacatggaatatgggaaggtgcaaactaagttaaaaatttccattttctatatattgctcaggaaaagaatagtaatggtatttacattagacttccttgattccactgttatagctaaaatgttaagacttgagtacacacataaaaattgaatgcataaattcaaaataaaaattttaagggtaggaaattggcaaaaggaaaactagtaaattaaaacaataaatgagatggtggaaataaagctacatatatcagggatcataatgtaaatgaattaaactcacctgtaaaaggaaatccaaaattgtagaaaaaaactcagttttattctgtttatgagtcacatacttaaatcataattataggaaaagattgaaagttaagaaatggaacttacagtattgttgagtatgtaggtatgtatgtatgtatgtatgtatttatttagagacggagtcttgctctgtcgccaggctggagtgcagttgcactcggctcactgcaacctctgacttcctggttcaagtgattctcctgcctcagcctcctgagtagctgggattacaggcacacaccaccacacccagctaatttttgtatttttagtagagacagggttttaccatgttggccaggatggtctagatctcctgatctcgtcatctgccgcgtcggcttcccaaagcaggattacaggcgtgagccactgcgccgggtctgttcagtatttattttaacatgtccaattaatggcttttactatctgattgggctattctttattcaattccatttcccattatacctaagtaatatatattagagatcatttttgactcatagtttgaatatagagttttattatgggctttatagtttttagaatgcttaatttcaactgaaaaattaatcaaaagttttctaaattgtttaccagtttgatagtgtttggataagacatgttagaaatctatttctttcctcaaatttgacaccaattgaaatttttcataaaaaggctttgaaggttacttataaaactaatgaatactttaaagatataataatgctaaatgttaaacaaatgtgtagttaagtggaaacttttgtactttgctaatgggaataaaaatttttatggggaagcaatttgacaatataagtcaagagttttaaagttatcataccctttgacccaataattctacttgaatgcataagttttaagtaattagtatgaatagctaaaaatatatacagtcagccctctgtatcagtgagttgcacatctgtggattcaaccaagtgcaggtcaaaaatatttttaaaaacaataaaaaaatacaacaattaaaaataaaatgttaaaatacagtataacaatttatttaacatttaaattgtattaggtattataaccaacctagagatggtttaaagtatacatgaggatgtgcataggttacatgcaaatactatgccattttacataagggacttgagcaatctctgattttggtgtcgatggtcaggggtggttctggaatcaatcctccttggatactgaggagcagctgtatgccaactatgtctatattctttgttattgtaaaaaatgtaaaacccaaaagtctaatattaggatgatggttaagtaacacatagtacttccattaaatggaacatcatttatgatgtccgctaaaatatttatgaggttttaacatggaaaagcagaatatggatttatatatgtatttagtgataagcgtgtaaaggtatgcttagtaaaagatgaatgaaacttatgaattttctgggataatgagattacaagtattttttttctttttctatatgctttctattttttttttcttttatttatttattttttattattatactttaagttctagggcacatgttcacaacatgcaggtttgttacacatgtatacatgtgccacgttcgtgtgctgcacccattaactcgtcatttacattaggtatatctcctaatgctatccctccccactcccccaactgctcaacaggccccggtgtgtgatgtcccccttcctgtgtccaagtgttctcatcgttcaattcccacctgtgagtgagaacatgcgatgtttggttttttgtccttgcgatagtttgctgagaatgatggtttccagcttcatccatgtccctacaaaggacatgaactcatcctttttatggctgcatagtattccatggtgtatacgtgccacattttcttaatccagtctatcattgttggacatttgggttggttccagttctttgctattgtgaatagtgctgcaataaacatatatgtgcatgtgtctttatagcagcatgatttataatcctttgggtatatacccagtaatgggatggttgggtcaaatggtatttctagttctagatccctgaggaatcgccacactgtcttccacaatggttgaaccagtttacagtcctaccaacactgtaaaagtgttcctatttctccacatcctctccagcacctgttgtttcctgactttttaatgatcaccattctaactggtgtgagatgatatctcattgtggttttgatttgcatttctctgatggccagtgatgatcattttttcatgtgtcttttggctgcataaatgtcttcttttgagaagtgtctgttcatatcctttgcccactcaaaaacaagaaacggggaaaggattcccgatttaacaaatggtgctgggaaaactggctagccatatgtagaaagctgaaactggatcccttccttacaccttatacaaaaattaattcaagatggattaaagactgcaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctgcacagcaaaagaaactaccatcagagtgaacaggtaacctacagaatgggagaaaatttttgcaatccactcatctgacaaagggctaatatccagaatctacaatgaactcaaacaaatttacaagaaaaaaacaaacaaccctatatgctttctattctatacattatttatgcttagtattccattatgtttataataataaatgacattttttaaaaagaactgttgaggataggccacagcatggtcttggaagcatggctctctgaatttaagaactagcaatgtcactgactttggtcacattgattcaaattagattaccaaaaaagtatttgcataaaatacttgtataaaaccctagttgtatgaaaccctagggtgcaagacttatagccagtaacacaagtattttgaagacatggggatttggaactgaattatagttttacattatttcccagttgcctatcacatacagatatatagacacatatctgtccttgcaatcataatttaaactcttatactgtgtgataacttggattcattatgtgatattgtgtaatttcatttgtgaaatataatcgtggtcttaaacaatttcagaagctctattacatttttataccactcatacatagtagttcatattgtaagtactgtgtaacatataatatatatgtattacactggataaagtctcactggcctgaaaaagtagttcctacgctggagataatcaatgccttggtgccttcaaattaagacctttacaaaattgatgttatttcaccagaatgcattactaaagagtaattagaagccatcagaatcacttaaggtgccagaaataacttggacattttgggttcataagcacatacttaattgttttcaaaactacattttaaaaagtggagttctgtggtacactaaatgacatggattgcattgaataagaaaggtaagttaaatgacgagttaattgggtgcagcacacgaacgtggcacatgtatacatatgtaactaacctgcaagttgtgcacatgtaacctaaaacttaaagtataataaaaaaaaaaaaggtaagcgatttggcgtgtttgttgctattgaaaataattgaaaatatatgtctgatctaaaaaaacttaacattaataacaaatatcagtttttacttaataatactacagaatcagtattggaagaccagttgtactgtgtacatattaaaatacttaggtttctttatatcatccctaaactgatgtgaaagcagccaccccccacattttacaatatatttttgaaataggctttacattaaatggttatgacaagagagagagacacagagaacaggacacatagaaagatacagaagaagcagaaaacacttaagaaatctcaaaaaatgctaagacaataagcatattatatttaccttttaagttgaaatacaattgtattactgagacctgataacttttaacttttataatcttttctttccttttttttttaaatgtgatggagtctcattctgttgcccaggctggagtgcagtggcgccattctggctcactgcaaccttctgcctcctgggtttaagcaattctcctgcctcagcctcctgagtagttgggattacaggcattcgccaccctacccacctaatttttgtatttttaatagagatggggtttcaccatttggccaggctggtctcgaactcctgacctcaagtgatctgcccacctcagcctcccaaagtgctgagattacaggcctgagccaccacatggggcctaacttttataatctttataatgaatttttagtaagatctatttgtcatggatagcatataatatgaatagtttaatcactgcttacttcttccttttgaaaatagcaattcaaatactatatatatggcctagtccagaaatgcaaatttatatatatatttatcaatacagtagattggattattaagttactgcaaccattcctatagattttagtttttattctctttgtaagtttggagtttctcatagggatttttaacagttcaaatctgaacttagaattactccttgctgaagacggttcatgccacagtagacaaatttaaaattgtaatttactaacaagaactgcttggaattgtgtctgcatcagtgaacttcctgactttgggaaattaaaatgttaggcattctgcaaagttagcactttcaactcattaaaaaaattacacgtcacacagctcttctattaattctcagaagtacagaggaagtggcagagctctccatgtgtaaactgtggtgtggacacactgcataccagggcccccagaagcccaggtggatttaatgtggggaagtaatttaccttacaaatactcatttcttgactttagaatgatacgtttataaccgcctgtggtaggcatttgagaaggtgctagtcatttcccagtgaaattcttgtcaacacagcagtttgataggaaagcataattgtgagtggtagacagtgagagcttttatccatagttggaagaagttgatgtcatagctgtgtttgtgtagttcttgatatgtgtagcgtcccagctggcaaataaatattctgtacatggcctgcctgcccaacacaatgctacacagtgtccggtataataagtgtggtttgcttttgttttcctttctggtaaaacattttcctggttttgaaagcagggatgtggttagaaactttagcctacagaagcctaatgaacacctacggagcaccaaacaggttagaaaacaaatgcaaggtctttagattctaggtggaaagggacctctgaggggatcaagaaaggtgccaccaagccagcaactacagcaaagcatgggctccttcgagatcacgggggtgcaggtccagggctgcaagctcaattttcttcttgctagaaatctagcagataggttcatgtattctagaagtcagtcaccttatacatcaggactcttcatcattttactttttctatcaggtgtctttactaccatggaggggttctggtatcattgcttttggatttataatttatttttcttttctaagaagcattgacggggatagagtccattatataatataacacttatataaaacatatataatatgttttataatatagtttacataatatagtttatgtaatatattatagtttatataacacttatataaaacataatatagtttatataacacatataaaaacacttgagtagctgatctatgagtttgatattaatgaacttagtttaaatttcaggcatttatgcttcacctactgtgaatcatgagataagacatttacatcctgggatgttaattatctactattcattttcagaagggtgtggctggtcactgtaaggaacagggctatgaaccagcttagtgaggtgtggccattgtcctcagcaggctggagcagtaaattaccatggcaatttagataactgacatcagtgataagcaaatgttctttttaattgttgttgtcatgtcctaggatttatgtattcatttatttggagttccttaagccctatcaataaataaaccctcagaagagtggtaaattataataaatgaccctgggtgtctttgacagacctgacctttgacatcattagtgcagccctgatgggtttgctagataagagctgaccttaaaggataaaagaaaatctggacatgtttattttgaatggcccttgaggttttaataagaacatttgcatcagaacaaatgtaattggggtgaaaaaattgcccatgttttggcttagtgtaaagtaactggcaaaaaagaagaccaagcggccaggtcaaggagaggggattcttctaaggataggatcagaaaatgaggaacaatcttatcaagtagcctagtggacttagagtagataaatattactaaaactaaccaagacctttgtgacctaaaaatagctacttttttagaatatgtttaatgcttttataaatgacattatgtcatatgcataacttgcatcctagccacccccataagatatgaatctatcatctattgtgcttaatccccacagtatcctaaaatctatttacgggtattaaggtcatagaagcagctccatattgaaatgtaatgagtaaacctcaaaggcaagcaggacacctcctaaaactctacctatctcttttttggccaagtatctgatactaatgtaaagacagggttttaatgcccagacacctacatatagactttagagggcataaaaagtaccatatcttatatggtagtttaaagatatttcagatttcattttaattctgtttgctgtccacctaatacattgattttaggccctggcattagttgcttctgaccccagtctactgtgtcagacatgaccaagttaagaaaaaattgaattgagctcaatttaattaatactcaaaaggtagaaaaaaaaccttacaaacagaacttttgttaatcccctaacaatagttctcttttacaaaggaagaaactgaggcatataattgaaacagccctcccaacatccacagatgagtgctggagccaatgtgtgaaggcagatctgtctcatttttaagcctgttctcatgcaggatcttggatgccagaagcaagtggttgtcagcttttattgctttaaaataggcaaaggatgccctatttaatgaatggtgttgggaaaactggccatatgcagaaaactaaaactggaccccttccttacaccttatacaaaaattaactcaagatggattaaagacttaaatgtaagacataaaaccataaaaaccctagaagaaaacctaggcaataccattcaggacataggcatgggcaaagacttcatgactaaaacatcaaaagcaatggcaacaaaagccaaaattgacaaatgggatctaattaaactaaagagcttctgcacagcaaaagaaactatcatcagagtgaacaggcaacctacagaatgggagaaaatttttgcaatctatccatctgacaaagggctaatatccacaatcaacaaggaacttaaacaaatttataagaaaaaaacaaccccatcaaaaagtgggcaaacaataagaacagacatttctcaaaagaagacatttatgcagccaacaaacatgaaaaaaagctcatcatcactggtcattagagaaatgcaaatcgaaaccacaatgagataccatctcacaccagttagaatggtgatcattaaaaagtcagtaaacaggctgggcacagtggctcacacctgtaatcccagcactttgggaggctgaggcaggtggatcacctgaggtcaggagttcgagaccagcctggccaacatggtgaaatccatttctactaaaaatacaaaaaattagttggccatggtggcagacgactgtaatcccagctactcgggaggctgaggcaggagaatcgcttgaacccaggaggtgcaggttgcagtgagccaagatcgtgccactgcactccagcctgggcaatgagagtgaaactccgtctcaaaaaaaaaaaaaaaaaaaaaaaaaaaaagggaaccaacagattctggggaggatatggagaaataggaatgcttttatactgttggtgggagtgtaaattagttcaaccattgtggaagacagtgtggtgattcctcaaggatctagaaccagaaataccatttgacccaacaatcccattactgggtgtatacacaaaggattataaatcgttctactataaagacacatgcgcacatatgtttattgcagcactgttcacaataacaaagacttggaatcaacccaaatgcccatcaatgatagactgcttaaagaaaatgtggcacatatacaccatgaaatactatgcagccataaaaaaaggatgagttcatgttttattgcagggacatgaatgaagccggaaaccatcattctcagcaaactaactcaggaacagaaaaccaaacactgcatgttctcactcataagtgggagttgaacaatgagaacacaccaacacagggaggggaacatggaacatcggggcctgtcggggtggggggctaggggagggatagcattaggagaaaacctaatgtagatgacaggttgatgggtgcagcaaaccaccatggcatgtgtatacctatgtaacaaacctgcacattctgcacatgtatctcagaacttgaagtataattaaaaaaaatggaattttcttctgatgtgtagagctcctccaattattgatgtttattccttttttccacatggcatcatttttgagggaaatgatgtttctcctttaaatatttacttatagggttttatgccaaatgcaatgtgattatcatgcattaacaactacatcactctagcaaggctccccagtcacattagagtggaaatgctgaggtttggtacacctctttgcttgccccacacttgaaacagaagacactgtttggaaatttttttcatgtaaaggagacaacctctctatgctatttttggctttataagtgtcatgactataaatgataatatttcaaatggagagatattttacagtccaaatcagcagggttatctcatgcaatcaccaaattacaaattaagccaggtgcctaccaagccctcttctgttatttccttgtctctcctcattcgaatctactaattattgctcacatagtacttaagaaggacggtggaggtgtagcctgagggctgggatccaaccctggctctgctgtttcaccagctttataatgttagacaaatccctttaccactctatactcaaagggttaaattagggagttccaatcaatgatctattttcactccaacatcctgggggtttgcaagtttgtgagaacatagacttggttttgaggatttaaacctggctaatgatgttcagaagttatgacatttctcacatcagaatatttgcttgataattatttatatgaaagtatgtagtatggcataaaaacagtttgaattatttttttaaaaagtagtaataaaaccatgatcattttttgctatctatccatatggcttggaaagaaaaaatttgaaaaggctagaaaaataaaagtagttgctgtttattggggaaatgaagatttacatttggtttctggcattattcttgagactctcaaatataaacccaccagacaggctacatttaggtatattgttgctcagttactgggtcttggctgtgtacttagggataatttgatattacttccttcagtgtaaacaccaaggaaagctctcttgctctctttctttttttacaatacttggacatgggctctgatcttttacaatggttggacatcactaaaaagttcgggcaacctcacctctagtctaaatgatgaccttgtgcaaattagaaaaaagtcattcgttccctaagtcactttactaccagcagccaggaaatggttctatgattaatccaaatctacagtaaacacaaatatgaatgctgccacccagagctggacaatgcaaaattatacattgtcagttttattgacccaaattttagttggtagaatatcaacactttgggtaactttgcaaacatcctttctcacctttgagactctgtctcctcatatgaaaaagattgaatgagacaatctcctgagataatgttttgagcaattatgagatggtcttcaagtaaaaggagcattgcatggactgtttaagacatagcctgctcttgctccagttttcaaatattttttcttcacttaaaggttttctccatatcgaatctcctttagtctgtattcctgcaagtcaggaaaatctatgctttaaaaaataaattttctttaaaaatacaagttacagctgggtgcgatggctcacacctgtaatcccagcactttgggaagccaaggtgggaggattgcttgagcccaggagttcaaaaccagcctgggcaacatagcgagaccccatctctacaaaaaaaattttttaaatagcctgggtgtggtggtgcagatatgtggtcccagctacttgagaggctgagatgggaggattgcttgatcccaagaggtggaggctgcagtgagctatgatcacaccactgcactccagccagcatgacagagcaagaccctatctcgaaataaatatttaaaaaaaaaaaaacattgttttaaagtggatataggttataagcagttacccttgaaaaagcactgctcttgaaaaagcagttgctgaggccacactgtacccagggataacaagcctcatacctttccctgaacgccatgcctgttcttgccttctcagtcaaaaagaggtgattttgaaagttgttatcaagggaggtggattttgttctgggccatcctttcatggcaagattgtttctttcattgcaggacattcaatatccttggcctccactcaccaaatgccaaaaaacaaccacctaatccttatgacaaccaaaaaaaaacaccatccctaccccatttccaaacaccctcttgagaaattgcatcactcttggttgagatacctttttaccatcaatttgcactctggccttgaaaatgtgctttggaaacataccaccatatcttttgccagaagccacaaaggacaggcataagcctttttacatgaagagagtgcaagagtccttagaagagagcattgcatacggcttctctgaaaaactgggctccctgtctatgtaataactggggaaacaaattcaaacgagtttcctaagatcactcattagataataggctatgttgactctacagataaaatcccttaaggacccagcatcttagtataccttagtaacgtgcatcataattatatcaatgtcattgttggtcatttcttgattactggcaatgtaccagcaccttacaaatctcatttatcctttccacagctctagatgtaagtattcatatccccttacacagattagaaaactgatacttagaaaagtgaagtagttcggcaaagctctcccagctaagtggcagagctaggattcaagctgatgttcatgacactgaaaagcagtgtactggcccatggcctggtgcttttcttagcccaccttactttgaagtagcaggaaagttaactgaaatccctaacttttgaaccaggctgtcggtagcaaccgaaaaacaattattttgcactgtgttccgccggagatgttatttttcattattgctaggactactctcagcagggtcacctcattagctgaagaaaatgttccctgttgttccgtgagagacggatcagatggagaagcataaaaacaaactccagaaagtgattctgtgttcccctcatttaggggatggaacagtaatccccttcttctctgattcccagcctgctaagtgatgttttacttctgtagttgcagaagtgttttgaaaatgatggaaaaagttttacagggatgccttacataactttttatcagtgtttccataacagagtaaattggagtgtcaaacctttggtgagtacacttaatactggtctgttttaaattttcccatgtaggaaaataagagtttggctagattggtcctaattgcctgtgaggaataactaaagtaagtgagactttgtaaaatatttttaaaattttttaaatattaaatattttaatattttagagtgaggcgatatttaatttttttaatattttattttcattcagaacaacctcaaatgcaaacacttcatcagttatattatacacctattgacagatatctcccaagccatgtgttatagaagccatctgtaaaaccctatcaccttgctccatttgacaatccatatctatagaaaccaaagtgatttttttcaaaatgacattcgatcacaggatatgcatttcacttagaataaaatcaaaactcactgtggaggccaggtgcagtgactcgggcctgtaatcccagcattttgggaggctaaggtgggcagatagcttgagcccaggatttcgagaccagtctagccaacatggtgaaaccccgcgtctagtaaaaataccaaaattagccggacatggtggtgcacacctgtaatcccagccactcgggaggctgagacaggagaatcgcttgaacccgggaggcggaggttgcagtgagccgagatcgtgccattgcactccagcctgggtgacagagcaagactcctcatcctggcccaccaggacgtgacctggtgctgcctgtcctctgaccccacctcctccctttcctttcttgcttgctccccaccctctaaccattctgtctttctgtcaggactttcgtatttattgtcgtttctcatcaagcacttgcctcctgatcttaacttggcagattctttctttttttcaagctccaggtcaaatttcatctcaattaaaaaaaaaaaattcttccttaattccctaagttggccatcctgatatctccaaacacattatgttcttttggtttatttttaaaagaacttttttactatttgaaatgatcttattattttgtttacttgcttattttctgttaaacttcagtaaaaacaggaaagtatccccatgtctacaacagaacccagaatataataaggttcaagagtatttgctaaacggatgatgaatgaatgaatgaatgaatgaatgaattccaattctgtgcctggaatgagattgcagtttcagataaataccataaggcacaaaacatttattgagtagtttaaatctacataatatttgtgaaagttgacattcaaatcgaagttacgaagttatattctctattcttggtctgcctatcaagaacaggaattctggtgggaagcagggacaaaaaactcagaactgctttacagggagaaatttcggaccacgtgatacctagctggagataggctttccttttgcaagacgcagctcttctgcttattcaagcaggaccacgctgattcttttctttttattttttgagacagatctcgctctatcacccaggctggagtgcagtggcgcaatctctgctcactgcaatctccgcctcccagtctcaagtgatgctcccacctcagcctcctgagtagccgggatcacaggcacgcgccaccatgcctagctaattttttgtattttgggtagagatgggctttcaccatgttgcccagattgtctcgtactcatgagctcaggcgatccacctgcctcagcatcttaaagttctgggattacagatgtgagccaccatgcccggctgccaggctgattcttaccaaaagtttcaggacgagcatcatagcatttgtaaacatgccttttatactcatttccttgcctcttacctgcaaaaataagtcttttgacattcttctacttaacatcatcacttccaggaagatggcattgtgatctggtctcctctactagcagtgaacttgttttgtgttaagtctttgggttttgaaaatagagcctgtgtatgtcccagatgtccttttattgagttcacagaatacaaatggaaaaattttattaccaggcagtggtgtttaaaaatgaaaatcaaacctaatacatggactcagacaactagaataaggaatataatatttataaaactgagtaggaggttgcaatcattgctctaaaataaggcattaaaaatgaattcagagcaaacctatctgtgctacagcaaagctctctttcattaaggtagcactgcatgtttctccagaattagttcccccaaataggtaaatagcttgtaagaactgagtgttcggcaaactacggaagtgctacctgaggcacgatttagagttgcttttagtattacagctttatagacctttcattttgaaccagttaattgtgaaacttgttttcctctgttttttgcccttgagtattactaggaaggtttaattcacaggcttcttagtcatcttcattttattaatccaaatggtgctgtatcatttgattaattcatatgtagcagaatagtaaatcttggagaactgtggttaccagtataagatatactttaaaactttccataggtttttcatttcaaaaagtttgtgttgcacatattttaagtgacttttccctatcttattccacttcacattattatcattatccatattgcattattattgttagtttccaccttcagaatacactaaaaaggaagagaaataaaatgctagtgctatttctgcatttttctattgagatgaaagtttttatttttcccaatatacaccatttctctgaagccctaaaataaatacccttataacctctaggccctattgattttctaatgatttcaaataaaaagcatccagtttccattgcattgacaaactgttcagtccctaggcaaaacctatcgaactcctattaaatgaagggggcaagaaacaacagaaaatccaaaaagtagatttgagatggagcgggggagaggtggtctcagcttagctcagtaaatgggtacttaacctttgaccaatgatgacaggtcttctttagttctcttagaccaagcacaagctgttatgattaaataaaaaagaaaaaaaaactgtttagagccttactgaatatgtcctgggaattaaagcatatggcagggataaggaaaaaagattttccttatgctaatgacccctgatgtctgaaataaattagatccattagagtttatgctcaataaaagaaagactttaagcactccaaagttagtgactcgagaccagtttttgctctaaaattcaatctgcctgcttattaattcttagtgaggctccagagcagacaggagatgcaaaatcataattttatactgaatcagaattttaaaagaccacaggtttcttttccttttaattaaaccatttttcatgcttcctattttctttccctcattaatttgattttgttcccatttttgtttcatttttttttcttttcaaggtttcatttatcccatttcaactgaacagagaacccagaatgaatatggattttcttgtaagtttgatgtttggattttatgttgctgaataatcatttaacgttattgcccctagttcaagtttacctttcttcggattacagatgtgcacacaggaaataggagcctaatatattctaacatgaaaaataaattagatttttgctgctgaagagaagaaagggtcatttcaagactctgccaactttaaaatctatcagtctaccattcaaagcttgagtcccagtagctgacaaaacatatcatgaaatgtgctgatataagtaaagggcagggttcaaataccaaaacagaaagggttgaaaaaagacagatgggttgagctagaaatcatgaatgttgaataagtaactatgacctggtaaagtaaaacaataagaatttagatataatattctgaccagagttcagaatcctgcagcagtgcctcaaataaaacccaacagagaagtgaagtaagtactttgaaagcagcactcacccaatcacgagtatttgtgatatcactggttttctgaagaaaatttgctaacattgatttgattgatgggaaagtgaatattctggaaatgttgggaagaaaattatttttaaaagaaagcaaaatccttttggatacattacatttaaacacaaaatgccaaaagagatagagcaattcccaataaagaattcatttacactgctaatatgtgaaagattccatgacattagagtgtgggttgtctcatgagccactggcaaatgaaatgatgagttatttcaccatgtaaaccatgtggctgtgagcgttaggagagggccgtggttcctcacattttaggaggtcatgggacctacaaattggaaagttctctctccctgaaaaatgtacatgtatataaaattgaccataaaattctaggttgttctcgactacctgaagtaccaatttaacaacctcttttacagtgagtggagcagctttgattaattttgctgaacatgtttttgtgcatcacagaatactaaaaacagagacttaaaaatgtcaaaggggtccacaaaggtttcatttcatttgtttgttttaattatcagcttctatcaccttttccagttagatgcaagcatgttctgtgccaccaaggcaacatgcaacatttataggaattctgttccagaaaaaagacctcagttgactgacacactgtgttggtcaaatgcttatttgccttctggggtagtctgaactttctgatcactgaaccaggcctttgtcttccttagtgcacaagagagctatattttattctagtaatgagtagctcaaatgtaaatctctgacaggggaccgtgagaagctcagggttctcagagataatactgcatctgtatcaaagcctggacttagagaaggttatcagcattaacctctgtcccccagatctgggccctctgaaagcacacctttcaaatttaatatgtttgctcctagtatttgctttgcttagttacaccattcccacccacctctccattgatttaggggaaagtgagaagagtgctatggaaagtcattttatgacttggagtgatacttaggaaaatattctggttcaataaatatgcagatttaaaacatgccagatatttctaacagtgtttatgtttatgtttttaaagaactatcagtgaattcaaaaacccttccaaacttttccacctgaaatgagtaataaacttttttttcctgtgggttgggatggttttagttccagtttctttatatgcctagtaataaacagtctgttatgctgcccaattataagatagattagtgggtggatagatgcagagtgagaaaggaaaagaaatcagagacaattttccactgaaaggccacagccattttatatagcttttgaaatagatttgaaattaacctataaaaaaggcagtaaatgtctgaaaaaattatagcaatacatatgtgtactgtgggaaatttctataagcagctggttcaatgtttcactctcctctctagctgctcctgattcagatgatgttgctctctatgttgggattgtgatagcagtgatcgtttgcctggcgatctctgtagttgtggccttgtttgtgtatcggaagaatcatcgtgactttgagtcagatattattgactcttcggcactcaatgggggctttcagcctgtgaacatcaaggcagcaagacaaggtcagttgacattccacttcacaccctgttacttatgcatgtaagcagtttcaaaatcaatgactttagagtcatctcattcagctagaatgtaagctccatgaagacagcaatttgagttaattttgttcattactgtattgatgtcatttacataacaaattagagttaacaagataaatcctctttttttcttttctgacagattgctctgtcactttttaacttctaatcgaaaagagtaccctgattggttgactgatttcttgagtctctttttttaacttcctttgacaagatatcttgtattgctatgaatagaatgatttaccaatgaacccaaatccagtatagaccagggaaaccatagctaatcgtcacctagtgaggctcgttgttcaatccaatctgttgaaatagccaaataccttgggcataatgagtagacatcaaagcaaattatagaatgagcttgaccacttacttacagccaataataaaagagctggtagttatctgattgccctgttttcagtagagcctgtctatctatctccgatattagctgagctgctttactttcggctcagaaagtgtgagggggagtctgactaatgtaggttggcctgaatggagaatgccaatgggattattttctctttctgactcagatctgctggctgtacccccagacctcacgtcagctgcagccatgtacagaggacctgtctatgccctgcatgacgtctcagacaaaatcccaatgaccaactctccaattctggatccactgcccaacctgaaaatcaaagtgtacaacacctcaggtgctgtcaccccccaagatgacctctctgagtttacgtccaagctgtcccctcagatgacccagtcgttgttggagaatgaagccctcagcctgaagaaccagagtctagcaaggcagactgatccatcctgtaccgcatttggcagcttcaactcgctgggaggtcaccttattgttcccaattcaggtaattcctagaggtttaaattgcaaagaggcagcttgaaacatatttttccataccaaaatcttttttgttcgtgggatgttttcattaggcctgaaatgttaaatgtgacctatccagcccaaatctactttcaatgtaaacagaacattacttcagacaaatcagcaaaaccatttctcttcctccaactaattctgaaaacacttcctctagaaattctatactcacaactttctgctgaggtgtaatttagaaccatcattgacctcctttttactagaacttcagaaggcaacatcaagccacaagtcctaatgttgtcattatactttaaaaggacgaattaattattaaatatatcatttgattaagttccaatttactacatgaagcaataatacagaaaacaaattttttgatcatcagaggtatcataatagacatcaaatcttcatttattaacctaacttgatcacacagtctttcacctcacagtattgatagtgtacactgtactcactcctacctctgatatttgtatccagaatcaccagattcatcaggtgtgcttttgtactattacttggtttcagtttattatgtagtttctctgcatctagacaataagcctcataaaggtctttcatggtgaatgaaggttaatgcctgatactgttggattaaaaatcgatattcattaatcaatattagtaatgagcttggaaccatgggtcataaaagggttaatggcttcctctctaaatctatctaattcttttgggcaaggctgtgagtattttgtaaatacagtaatacctaaaatgtaaatacctaaagtgttgtcacattgaaaaaacataatatgtgtatactcaaggaatatacagaccaaagagtcttcaggcctgaatatgaaattttatttgattcttcctgtcattcactctttcatttcaatgccttggcaacttttaccctaaacctttaaaagtatattttaacaaaatcaaaacatttaataaaatatttttttcttcacagtttacatagctgagatcatgtattatataatgttttccacccttttctcattaatcctcatgctattgcatgctctttaaaatcatgattttaaatatctttataacagtccattattgaatgaatcaaaacatactttaaggttcttccattgtttaaacattacaattgttctcaaaatagttcttttccctctgaaatgtattggattctgccttttcttcccatttctacctaccactttttcatatgtgcattattataaaggcctcttaagtggaagggagtgagctagcatgttttaaattcttcctatgtattaggcaatggtgatcaacatatgatattttatttaatggacaaacaatagttacctattactttatattcataatgctgtttcatccctataacaaagattaaggtatgttttatgttttcaatgaaaaaaataaaagcactgaggcttggtagcctcatgtgtgatcttcctgctgtgtcctccacaaatcattctgtacattgacagtccacttcctacaacaccagggctctcacattactctccttctcaagaggtctgtggctcaacatcttcaaccagttacatgaaggcctactacctcttaactctccattcttttttcttgagactttccagtgtggtcaggcaagttttcatattgccccacgctcatttggcatattccatttcctcgctaattaaattatgaattactcaaagacaggaagactatcttttcctttttgaaattcacaacagtgtcaaacactgtactcacaaggatgcttcataaatttgtatggagctgaaggaagctggattttaggggaatcaaatgatggagccaaacatctttggagtgctgtccacactgaatcactctttgtgatgatgagcagtggtgtgggccccagaccatcaccatgggcatcacctggcaactggttgaactaaaaaatctaccccacaccccatatctctgaatcagaaactcggggtagggaccagtaatctgtggtttaacaagctttccaggtggttctgacctgagctcaaatttgcaagccactgccacagcagacacagttagcttagaacacagcccaatctaatagttctgccaaagggcaccgattagcaactaactagaaacgctttgacctgctgtgactaaactaggagttagtgttcactttctagagttatgtataataaaaggtcttcaccaattcttataccattgtggaattacattgatgctaaccggatatttaaaaaatacatgttgtttttttttttatgttgaagttggcatttccctgactttgaatcttgtggggattttaaaaaaaaatggaaatgatgcatcattacagctgtttgaaattttgagcagttgttggttttccccttgtcttgcaaggaaaacaacagtggaaccatctgtctgttcctcaaataaaacaagagtttaaaaagttacatcattcctttaagtaattgcataagagttcagagggagccgtggtaaggaggccaatgaggaaggaaaatggagcaactcggaatatttacatgtctttagagaaaatgaagcaggcttatggctgcgcggtcacaaaatctcctcattcccttttacgtgctgcaaaagtcttaaatgactgcttttctcttttgctattcaggagtcagcttgctgattcccgctggggccattccccaagggagagtctacgaaatgtatgtgactgtacacaggaaagaaactatgaggtaaatatgctttttctggtgcactgactttaccaatgtctaacttggaggagaattgtacaatagacacaataaacccaacatatttttgtctcaagtgccttgcttctggcatacattctttttcccttgacctacaaaaggtcaggttttacttctctttgtctttgaggctccagacgcttttgcagatcttgaatatgggtagaaggctagagatcttttcccaagtggacacgttgccatatttcctggaaaaatgtccagaaatgtgatccctagattgtccagagagacaagtgggtagacacagagacgtcgacttcatggcatctggctcaggaatccagcctgttcccattacagagtcaaaggtcacaaaggattggacaactcctccaatccctaccgctcccactcagcctagcccttaattctgacccacgattcttccttttgtgactgtcttctagcttaagtattactaatttccttcttatgtttaacacttataaattccacattaggctgttcagaatgggtctaggattgattaaaactagattgaattaaaaggttttgtttagaatgtttcataatcataaagaagaagttattttaagtaaaaataacaagaggcattgagaagtcctaaattcaattttcagtttggcctctaacaaatcgtattgggtatttcttgattagtttccatgtaaaatgcgtgtgttaaatagtgctttagaagcctgattaatgcttctgaagtacaccaagatcttaaaatgaaagatgttgttaaaatggagatcctcatcatgtaattatcattgtttttcccaaggggaagagcatcggctcctcagccctgagctctgaatataaagcatgagtgacaatgcagaactaggttatcattataacacattataccttttcttttcccagctctcatcctcagaaaaacgtccatttttagccttgttcttcactagccataaagcttttgtattatgctctcaggtggagatactggcatttataattggtgtgacccagaacatttttttcctcgggtggtgtacttccacctacataaatactagcctgtctaagaaaataatacaattcttgagcattattcatgccttaaatttgagcaacagaaaaatcactaaaaggcttgtatttacccacatcaaatattcatttttttcattcccaatgcaaagcaacattcacaggccctcaaagctcccttcttttgcatcaggagaaaagaagatcagcaaactccaagatctctttattttattttatttttctttctctcttccagagtcaaggttagcattaagtacatctatccatcaaggcctttgtcagcgtggacattttgtttaaatagaaataagtattggcttgtgctttatggtgagaaacagtaagatgcctgagctctcctattttccatcagattatcattatctgcagctgaagatcaagccttaaggggctgctgcaggcacgggctgaagctgaaagaggtgtgcactcacgtgcctgctctccccatactttccttggcagccgaaccaggataattgtacattttagatgaaagaaagagaaaacagaaaattgataaagctagacacttttctgctgttagggttctctgcctttgactataatgaaacggaaactataaatcactccttgctatgcctaccatctgaagttaggtgcagagggaattactctgttgaatttggtgtgcataaaagaagttctgtttataaaaatgaagctaggaaaacctcaagatctcaaaagaaaatatgcactacagaccatgaaccaagaaacaaacacaggaggataacagtttcagataaatgagaagtcttctcttcactagttttctgttatgaaccagatgcatttttattgtaaaacacaatggcaagaatgtgctttaggatatagtcataaaacaaagcatccctgcccttcatccagcaaactcttaatttcatttacttctcactacgttctgcaagctgtgatgagctccactttaaagatgaagaaactgaggcacaggggaattgggttccaaagccaaggtttcagttagtaccttagcaaggcagaattcagactcaggcttttctgatcacaaagcactttctgcttcctaatgtgccatcctcctccattgcaccaatgcacaaaccaaacctctgcctatgtattacggtgcatttttggatacactttctattgctcactaaagatcctttctatccacacatgatacaagacagaacttctttggaagaagactctgtgaggacatcaggagctgtgatgttactatgcattcgtaggaaaattctgagcatttttctccattttccttctctctgattacttttattgcatcccaaactgggtatgtttccagctggatggtatccagctggtcatctgcggatgtgaattgtctgaagggaggcgtgaacttaattacatgtggcatagtgaatgtgacaagaggggtcttatcattgctgaatatgctctaagcgaaagtgcaggctggcagctgaacagcctgaatgagccacagagatgggacaagcggtctctgaccaaagagggtgcagagctgcaaggctgtgctcaggatttctacctctcctgctttacagatctctggaaaggcggcgacgcctttgttttcctggtggatacaatttccacaattaatgctgctaacatgggcctttttgccttgtttctagtagcagtttgcacaaatgaacccgacctagactgaaattttgttctttattgattcttgttggaaaacaattggaattgaagatatgaaagttgattttcccttttctctgcattctgtactcacctagcagttttatcaaagggtgaagaaatcaatttagaaattgcaaatacaaaggtaaatagaacaccctttctgtaaaccgcagggagccatggaaagtttctgagcagctgagtgacgcaggaatagcagcgctttttaaagattgatccggtgacagtgcatggaatgcatcggtggagggaacagaaggactcgcccagaaggcttggtgcctgggtgggccctggcagtaatgcaggtgtgaggagagaggaggaggaggaaccgggccggagggtgagccaggtcccagtctgagagaatggagagggtatggagagaatctatttcagaagagaaagtatttcacagctggctagaagtgttgcaaaggaggggcagaacacacagaatagattcaagaatcaagcctggggcactgtgacaattgtgagaaaggtgagaagcagcagtggctccaggggagaggacagattccagtttggatgcgttcagtgtgagtggggatgtggattcctgctagggacgtggaagtgaagtcacggcaaggaaggaacctccagccgagaaaatgcagaagcagaaagaactggggaaagaactttaagaaatactcctgtgaaggtttgggtgtgatgagagaaactagatagaacatgtaaggataaggcaaatgaagagtttgcatctagcacagtacttaacatattactgtgttaggagtagtggctcctcaatgaatatttcctaatgaaagtacgaaggtttgtaagggtagacagacaaaccgcggtataaataggatctcaaaaatcaaaggtaaaaagggctccaagatggagcctcaacacgaggtgtcattaaagtaaaaatgtaaagaaagaggaagaacaacaaaaagattattagatttgtcaactgtggggcattagtggtgttcagaacttttttttttaattggtggaatccccttagcaatggtttaagatgtgagatagtagtgtggcaactgacactatcatatacatctattaaatataaataataaagcaatgtgtgaggataaaggtccaaaattccctatgtaggtaattgtatagagatagatttgcttatcatgttattttttggaattttgtaaaatagtagttgacattattctgtctcaaggaaacacagtgatctttctccttttagtagagtcctttctcattcatgagcctcaagttcctcagtttgaaggaagagccataaaaaggctaacagtgggagttagtgagtccaggtatattgaaatcttatcctcatactgttcttgacaatgttcatttattgaaatcctacttagagagaaatgcttcaagatagtttacgaaaacacttctcaataagagaaataaatttaaataagtggataaaaaaggtaagaaaatggggaaaataaagttataaaagataagataaagtaggcgagcggttagaatataaaatagttggtgtaattcccagcacatttgctagtaccaggtcgtgaatttactatttctaagcctttcaagaagggaatgtgttaagttacaagatccgcatgtccatgaggaaaaaaatatgctcagaagaaacccaattatttttcctttggttcctcataaagaagacattttgctaatgcagtgaacagcatccttaaagaaaaacagcaatgagtttcaagggctgcttctatcagtgtccctcaatggaggtagataagcataatgcttatcagttctggcttaatccagggatagattttggcctgtctagggaaatggtggcacgcccttcggagtggctttcataaatattatttttgcacaattgagcttttgatagcaagtgagttagatattccctgtcaggtacctagagtgcaaatatttcaagttgccagttatgtgtgaaggcctgtgctttaaaaggcagctgagcctagggtgggattatcatcctgagggaccagataaaagacatgtccactactagaaggcatctcctgttcccacagaggtggatggagacagattctttccttgagcctgctctaggaaacagacaagaatagtttcgcaaggacttaaacccactctaagcaacccaaaatacagcatcgtgtgaaagaaattaaatgatttgtgtttgaaacctacctagctttgcatccttaggcaagtgtgttaatatctgtagatttcagtttcctcttctggaaaagaggtaatagacatacactgccatacaggtgtaccatgagcagcaaatgcaatggcttatgtgaaagttttgtaaattatgcactcttgattagaagttctcctcactgataatgacaagcaaaggatgagaaaatatttctgacaggaaactgaaatttctctctgtgggctttgtcctagaggactcagcacccatccagcatttactggaatattatccttgttggactttggaaaacatttaaaattttaatcattgttctttgctgaaatttctacttaattgatgcttctgaagctaatttttgctctatgttcatttccatatcatctgcaattaatatttacagactgcttgaattgcttagaaaacacatgagacatagagaagtccttctctgcaaaaacaagaatctgagatatttttattttctgctattttcttctatgtgatttaatagcttcctttgtataaaggaaatgtgttacacactctgaccttagttttcacatagttaaatcttatcctgcgtaactccttacatatatgctcagatatttgcaatttcaatgctatttatgtcatcttgaaagcctataagagaatcttatcattatttcttctttgtttttcattccctgttaagaattccacttcaccacttccctattcattacattcttgcacctcactgggttaataaattcttttgacacctactgcccctccttcctccctccttcccttgctatccctcctccaagaatggtgcccatcaatattgcatgccaggggtgtacttggagagtacaggtctgacagctccccagcccagcagggagccttctcccttctgttccaagtcagtgatgagaaggacccctcctccttcctgcctcaagcaccggctgctaacaccagactgagagatagatgtctccaatccccaactatattgcaaagaccacttgaaatacattccactctagtctccttccttaaaagtttaatgttcacttctcaaggtacacttgtaactagaaggtaagagttctgctcagaaaaatgcaatcattggttttttccccctccaggagaggaaaaaatagaattaagcaataataaagtcactccttaaggcagatagtatagtattaactatgacacggtgaaagcagaacttgacttgtgttctaagagaatgaatttcagactggaagaaggacaaattgggttaagagaaaatgaaaaccaaggtggtaatggggatagtaatgaggtctcaagttgctcccaataaccttatagttccaaatttaagtacattcccaagtacctaaataactttagctataatggaggaaagggtattgttatttaaagagaacggaaatgctattaaaagactaaaagtaggtaaaatttgtgttggttttctaaataggaagaaagaaaagccataggttggtgagatcctggtgcaatttcagaataagtgaggaagcactgatagccaagagttattaaggggaacatataccaaattttaattgtgttcttagaattaatagtcaactgtggaagctctaagatacaaacttacttgtgagctaccaagttagctgctacagttttatgcgtgctgataaaacacacaagtcttgtggatcaaagacaacagacagcttattacccacagcgatagcattatacagagtaccatcatgtttgtgccaattttgtgagccccattttagaaatggtgatgcaaaaatgttcagatgaagtctacacactcaatggttgcattccagaaaaggatctatgagcttagggaacctgagtcttttataatgaggagtagacaggcctgccatttgctccagaagtagacattgtctttatctttcaaggtaattgctatacaaacatccatgcataaacatgagaaatccatggataattgtcttccaacaatattaacaataataacaactgctaccattcattgagtgttcaacgagggtacccatagataaaagctaacttctggaatatgtaataaataatacgtaaaccatagacaaaaactagagaaaaatccatttcaagtgaccattgcaattataaaggaatttgatgtgtcccttgtcatatatatgtgaattccatcaaaagatgtgaaccaaacaatgtccattttaatgggtttatatttggtggaactaaatagctcaaagtattgatatcagactggaaagaggttccaaatggtgtccttgaaaaggtctctgcccttgccctgttcttgtgttgcaaagttatcaatggttagaatgagaacataaatggcaagcatatcagatttagggaggagaaaagaccggaagagatagccaatgtttggagggaagatagagcatgaagaaatagatgacccaaaatttaccttgaaactattaagttcaaatgaaaagctaaatgtaaatttctgtacataggtttaaaagccatcattacaatcatggaaccagacttagcctaagagcctttcatgttgggaatacttagagtggttagtttaacaaatttcttaacttccttggagcttcactgcttcattttataaaggaaatgcttaaccatactatctctatcttcccatgtaactggagcctgctaaataatatttgtaagtaattccttgattgggaataatcaacagcaacaattttgtgaggcatgaatacaaacacagatggcaaatcaaagaaaatactctctcatactatttgagtgttgagttcaaggtgccaccactttaacgaggacctggaaaacaatgacaagcatccatatgaaaatgaagatagaaacccgaggagagatctggaaaccatgctattccagctgagggtggaaacattgaggttgtttggtctgtaataaagaagactgtagagacatcataatgatctccaaatatatgaaacagtgtagcatcaaaagcaaatcaaggatacatacagagaaatttcaggaagtcaggttgtgctcattctaagtaagaatattttgtaaatttgagtttatagtaaacgaggtgaccttttagcagtaatggaacaattctggatgtgtctatagcactaactatacgtcagccatgttttagaggggttctggctggatggaaggtgctgccgaatgacttccaagggcccttctaaaattctgtgagtccatgatttcaaaagctatgctcttctgattgagtgagtagtttgactgttgtcgttgagagggcatttattttcatctcagcactaactagcacttagttgtgagacttggggcaatccactcaatacctttggaactatatcttcacaaatttactgataggctaggttaatttatccatttgcttgttgattacagtcctgttagggaaaagattaaaggcaatttttatatataagaataaagaatctgcatattttaggttctttctgcccagattctctgagcatgaactatacaagagatctcattttaagttgctgtataaatacagttctatattatttctagtcatatttgaaagaatgaatctgctgtactagcctaaattattcctgaaagtcatttggactaagtttagttctagagtgtcctcattctgaaatgattttttaaaactatttttcaagtcaggtcctgaaaccacaaaagtatttaaaaccctgtgagaccagtggcaagaattatcagaaaatctgcttatgtaacttcatagggactctgttcattctcattccatcttgaaagtgtctgtacataaatttggaggaagctaccatagaaagaccagtgtcggagggaaggggatcaaagagatgctggcaagtttattgttatcataaagacttccagtcctgcaagatcaaggtcttggtatagagagcatttaattctgtatcacctatttcctctccccaaccccccagaaaaaaaaaaaaaaaaagaattccaggagaaaactacttgacctgtttgccttcagaacccaagtgcatagttcatgaatacaatggaaatgtcactgaagccattctctgctctcctcctaggccacccatggatgactctcagacacttttgacccctgtggtgagctgtgggcccccaggagctctgctcacccgcccagtcgtcctcactatgcatcactgcgcagaccccaataccgaggactggaaaatactgctcaagaaccaggcagcacagggacagtgggaggtgagctgctgtcgggataaagatgctatgcaagaataatccatgcagataagcaggagcaattatgggaggccttttatttataaagcaaaacatgagtggaattttagctcaccctcaaaatgagagagaaacaggcaggcagactagttcctgagtgttatatcttctgattgacaggcacacagaaaatgatggtcactcattagataactcataggaaaggtgcacataagagttgtagacatgttccttttggaatatagattatatatatgtctatgtatatatattgtgtatatgtgtgtatatataatatatacatatatatgtatatggggtggctcatgcctgtaatcccagcactttgggaggccaatgcaggcggatcatgaggtcaggagtttgagaccagcctggccaacatggagaaatcctgtctctactaaaaatagaaaaattagccgggcgcagtggcatgtgcctataatcccaggtactcgggaggctgaggcaggagaaccgcttgaacccgggaggcggaggttgcagtgagctgagatcgcaccactgcactccagcttgggcaacagagtaagattccatctcaaaaaaaaaaaaaaagtatatgtatatatacatatataatttgcaggtcagaaacattgcaactggatcagaaaatgttaggcacttacttgcagacatgtacctgggatacagttcttgtgaacttaaccttggaaaacagaaagggtgtgtctccaaagctccactagaaggaagaaaatctgcagcattctggctgtccgcagctgctgtcatcagaacttcttaaggacaatgctttaaacaagcctagttctttatattagaaccctccacttagcacctgtatttcagtaatatgtttatccaaaaatactcaataattttaaaactatactatacatttatacttgtataaaatgtaaaacatataaaataggaagttataatatgcaaagtatatattatatgctttgtgattacttatgataattttttaggaaaaaattcttagaaaaaatacacatgaagattccagctcctaatattttaagaaaatatagtattagatgtagacgagtaccagagtatccctgggattcactgggatttccttcctatgggcatgttctactcttgaccatatcaggggatcactgcttgccgaagcgtacataataaataaataaatacactttatgttgagttaggaccagatttaaccagatctaactttcattctgtttaagctttaaatgatgtatctgaaaaacatcccgtcttaatccgaagtgatcctaaattattcgcatgattctcttcctattaccctatccatttctgggtttgagtagttacaataacaacgacattaacaataaactgagcagatgagggaagtagaagaggacagtcctcatgaaagcccccttgtacttgtgagtgactgggacgtgggcatcgttactctttggccatgtcttctaggaagctttctgcaccatgtcaccactaggggataccggaggctttcctttgtcctggagaaagcagctgctttccaggtgtcctttgggactggaataaacctggaggttctgagcttctctcttttcctttttaggggcttcctctgggggcataggttcagtagaagaaattatttcactgatgctattaaaacacagctcttattatagctcagatcatgttgcaaggcctaataaataataacctaggtggcaacctttcacatctttgtgtagccctctgaactaaatgtataactaagtgttcattcactgtttcagcaaatggttgtgggacacacaccctgagccaggcccactggaatacagtgggaagcaaagtcgacatgattcctgcccctgcagagagactgactgactcttgtctctgacagtgcagagactgactcatgctcacgcgtggatttctcctgcctgagattttcttttaaattcgagttaattaaaagttggaagatttcacattaaaatctgaacttccagcctgtcttggaacatgtgaggctttgtccatacttggcctgcattcctgcatagcaaccgtaggccgaagcccagcagaggctgagctctttagacaggcatgcactctggttcgccacagtctccatcattcctccttgtctgtggccctgcctacttcacatgcctctgttacctggttgccccaggatgcattcggaatcccaacccttggtttttgcatcccatacatggtctttcagctgatatattctgtggcctgaaccatatagatgaatcaaaacttggttgaattagtaactattttttaaaataaaaatcatcacttccatttatttttatttcttgctaaatgttttcagtgtctgaaagagtagactgtttaatgacacataaaaacccatctctttagactgaaaatttcactgacttgtctccttcaatttagcttccagctttactgccagctgctgcctttagaatttccctgagctccttcttgtgagctcacacaccatcccagcccaccctgccctcatcccagctccctgacaccaagtaccatgtccttggcccctggtcatctaggacttgggacagctgcctgcttggccaatcctctgctcagccatcagtcatcagatgacgactcaggaacaactgctcacatgatctaggttgagtgttttccgtttaaacctttttgcagcaaaatcctgctttcacatacacacacacacacaatatgaaatcctaaatatataaaacatgttaaaaagttgtggctgggcgtggtggctcacacctgtaatcccagcgctttgggaggccaaggcaagtgggtcgcttcagctcaggagtttgaggccagcctggcaacatagtgaaaccccatctctatcaaaaaaaattagccaggtgtggttgcacacacctgtggtcccagctacttgggaggctgaggttgggggatcacttgggcctaggggacggaggttgcagtgggctgagatcttgccactgaactccagcctgggcagtagagtgagactcctgtttcaattaataaattaaataaataaataaataaaagaagtatactgacccaacaacaacaaaaaaagtaacagagaaatgtatcttacgtgtcatggaatttgtcaggtcttgcttttcttagaatctgacggccaagattacttagaaaaagcagtgtatttctttaggaagaaactgtcaggtgagttttgaaagaacatagtagaattgcatattaatatattattgcccagttccttaatttatctaattcttttcacacgtacagatttttagggaaaatgtagattcttagaagatcaaaaaatgcaaactgaaagacatctaaataaatattctcagtgtaaagacaatggtagaaagagacagaatgatgaactcaagtagacagattataaactctgagagagaaaaaagaccaagtaaaggataggtcctgctctactcaccattcaccaccatccctggtggccggcatgcgtccctgggtgacttagccatggcccttccctcttgtcccccaggatgtggtggtggtcggggaggaaaacttcaccaccccctgctacattcagctggatgcagaggcctgccacatcctcacagagaacctcagcacctacgccctggtaggacattccaccaccaaagcggctgcgaagcgcctcaagctggccatctttgggcccctgtgctgctcctcgctggagtacagcatccgagtctactgtctggatgacacccaggatgccctgaaggtaagtgcctcccacctagcctgccctcttcacctccacctggaagccaaggttttgcacggctgtgcacacttggagatgtggctgtgtgtgtgcacccaagtgtgtggacacgtgtttggcccaaaaggatgcacttaaaaaagatagacatttctctgaggccatgctgatatatgagctgtttacactgattcctcccaagggctactttgtttaccttccttgatttcttttaatgaaaaatttagaagaatttggcaacgagacccgtggatggtaaataatctgcttccatgtttatctcagctgcgttcttcctataaaaggaattggcataattgctcacactgtatgttcctctggtgtgctgcttcatttatatgctttcctattctttttatgagggctgtgaaggagcgggttagcatttgacaacaggctgctgctttgcagaataaatgagcttaattcctggtgtgattattgccattcattttatcccattcgaagctttaagggatatagtaagtgcctttgaagaacttatgatatagaaggaggaataaaagaagtatgccaaggttgaggaggtaagtcagagggtgagaaatgccacagtggctgacatgcaaagtgctatatgggagctcaggagacggaggcatcattactttgaggaaatctgaaaaggagctaatatttgatgattggccctaatggaggattgggttttgaccagcaatagtagagggaaaaatacaagatttctaggtggagggaacagcgtgaataaacacagaagcaaacaataaataaagaccctcggccgggtgtggtggctcacgcctgtaatcctagcactttgggaggctaaggcgggtggatcacgaggtcaggagatcaagaccatcctggctaacacggtgaaaccccgtctctactaaaaatacaaaaaaattagccgggcatgatggcaggcatctgtagtcccagctactcaggaggctgaggcaggagaatggcgtgaactggggaggcagaggttgcagtgagccgaaatcgcctcactgcattccagcctaggcgacagagtgaaactctgtctgaaaaaaaaaaaagaagactctctgcaggcatattatttctggtaagcctagaataatagataggaattttgtctagatggacctttacggccagagagaggagctgagattcagttcttgagttaatggagattggagaggtttaaacagaaaaaagacatgattgaaaatacatattagaaatatcagcctgacttcagtgaaaaggtgagtcaaagtatgcaggaacgtgtgatggagctgaatgatgacaggggagtgagatggagagaacaagcctaaaaagtcctgttcaagtggcctttcgagaatcccatgacgagcgctcaatggatggggcggaaggtcaagttcctgcctctgagtcatagaagcaaactcaggggtcaggatgccttggggtgtagagattgtgcctgtcttagacagtttgggcagctctgacaaagtaccacggactgggtggcataaacaacaaacttatttctcacagttccaacccagacttccagtgtggaggctgaaaatctgagatcaagatgccagcatgggtgggctctgatgaggaactgctgacattttgctgtgtcctcacgtggtggagagctggggagagagctctctgggatctctcttacaaggctactaatcccattcctaagggcaccacctttatgacctaatcacctcccaaaggcctcacctcctaatactatcacactgggggttaggattacaacgtatgaatttggggggggcacagatatcactccataacagtgactgtgccttttcttttggaatactgaattagaggtataaaagatgcccaaggcacggttagaaatacggatatggttctctgaacagagagcagattttgaaacagagattcagaaaccaactacgttatgttgataattgttatccacagtggtcaggaagaatatcaagagagagtagagggagaagataatcataaaaataatcaagatgactgagagcttctatatttttggcaaaattctaaatattttatattaactcatttaatcttcattttatctataaggcaccattaactccactttatagatgtatcatccaaggcacagaaagtttaagtaagttgccctaggtcacacagctgttaagtggagaaagcaggcttcatgcccaggcaactggctgcagcctggctgctctgcccctaagcaaagttgcttgaagacctataccctagagcctggggaccagggaaagccctggctttgcaaggaaggaggaagggcagccagcaaaggagctaaagaaggataagcagccagattaggaatagaaatggaagaaaaatgaatcaaggaagccaaggaaagaaagtttttctgaatatcagggtatttccatctggagcttccgttcagagagtagtacttggttatgaacactgagcgttccaggataagtccactgggaagcaggctccaggggaaaagactgtagagggcacgagtggaaacaggaaggtgagctagaagcctgttgccatcatctgttcaccatggtagatttgaccagcatggtcttggggaagggatgagacctcttgggtcagcgcatataattttgatagtcaagcctgtaagattttctgatgtcgaataaaagttgtgaacacacagctctaatgtaaagcttaaggttatttcttttatattccttgcaaatgtgatacatccaaagcactgtcaggataggaatcatgctgggtttgaattagggaaaatggtatctgtaggggagccatggggtctgattaaggcaaatcttttcaacagttccaagaaaatcgttgcaaaagcgtaccatagaagacctacatcatatttgaagtgtttgatttacatattttatattcacacacatagttctctcctcagccaccttgttttcccaataaacacacacaaatacatgcaaaaatagaatattttataaaaataattctgattattataattagtgaacccaagacgcaaatggtcaatagtgagaaagagtgatgaacaggtttaagcagcaaaaacaactcaagagcagtttgtatcatggtcaatgctttctaaatagacatttataaattctcagcatctggggatctagcacttagcctgaaacaaacatgaataatggatgaggctttcttgcacctcatggccttttaataatgcagaaataccaaaatcctagttataggcaaatggcctctccaacataccgaagagacaattatttcagtcacgccatctcttcctcacacccacgcttgaattggaaatttggggctgattagctcaaaaagccctttattactaaaactctgccttcttggcgccctgctaatgttcccaacatactctctcccatctcgctacttctctaaccactgttgcccagaaatacttcctcttgcaacacacctcctgaaggcctccttctccttcaggcctgcccccatcctgactcacgctcatgctcttccaaaatcaggaattctcagcgcacagaggaagcaggtggaagcttttataaaaacccactccagggcctcactcccacaggttctgatctaattggtctaggtattggggcattttattttcttaatactccctgggttattctattgtgccaccaaagttaagagctattatcctaaacactttcccaaatctttttggaactttaattctactaagaacaaactttcctacaacctcacgtcattccctttcccattgctccacctgctctcattaactgccagtggatcttcctggtaacacctcacaatgcctccagcgaagactgtacccctaacaaaccccaaggccaagaggaaatgtgccagtacttctcataccccatgaccctttctggggcatctcttcactgcccaggctggatggttctacttctactcatgcccacttcagttcctttgcacagagctctgtggatcctgccctaccagtacttgccttgtggtctgtctttccatccattttattcccatcattccctcaaattcagtgtcatgacttaaatcacagtctctctgcccaaacttattctagtagcattcacatcatcttacattatctattcactggcatagatgtgctctggatttcatcttcattagcaattgctccactgccaagatctccacctgtcagactccccctttctgactacaaccatctgaccttccatctctctctcccacaagatgcgtggaagctaccctttgttcttaaggagaggctccctcactgggcacggtgactcacgcctgtaatcccagcactttgggaggccaaggcgggtggatcacctgaggtcaggagttcaagaccagcctggccaacatggtgaaaccccgtctctactgaaaatgtaaaaattagctgggcgtggtggtgtgcccctgtaaatcccagctactgaggaggctgaggtgggagagttgcttgaacctgggaggcggaggctgcagtgagcagagatcgcaccacggcactccagcctgggtggcagagcgagaccccatctcttaaaaaaaaaaaaaaaaaaaaaaagggagaggctccctcaacctgctgcagtttcccagtccaaaaaccctcccctggtcttacccgtatgggcagcaaactcgcttccacactgaactctctcgtcattatgagctgctgcagccttttctaatttataaccaaggataccctccactgaataagcccactacttctacttccaggttgatgagttgctatgaaaaatcatacatttctgattgggtctattatactctcaagatacctgttctaagggatgccttccctgcttctccgtaatccttttatttagctcttcttgacttacccgattcccacggcagttcttccatgtatcttctgctctcaggaagtccctggctgttttaaagcccacatcttgcctagcagtgacctaaccactcaatgaaagctcccccagctgcggtcctctactctccaaaccttttacttcagcctcttctcacttcatctgactctgatgaaaaggatctctgcttccttgtttgtgctttaatccaattcctgaccacctccatcttcagcatagcaaatgatgcctgaggctgcatttaccagcatttgatattttcgtatagtaactgctatgtgctggggattctttacaaattgcagaaaaatccacagaaatgctggactagggcagagatagaagcccagtggagtacttattctcagggaatgagtccaggagagctattgcaaaaagactgccccaatgtctggagctgtgtatttcaagaatgtgaattatcactttttattattattatatgtggttatattatccatgtggatagataatacatttatttatataagtatatatcctatagatatataattacatatataatatataaatattatatattacataaatataatataaaaatatatattatatattacataaatataatatataaatatatattatatattacataaatataatatataaatatatattatatattacataaatataatatataaatatatattatatattacataaatataatatataaatatatattatatattacataaatataatatataaatatatattatatattacnnnnnnnnnnnnnnnnnnnnnnnnnnnnnataaatataatatataaatattatatattacataaatatatataaatattatatattacataaatatatataaatattatatattacataaatataatatataaatattatatattacataaatataatatataaatattatatattacataaatataatatataaatattatatattacataaatataatatataaatattatatattacataaatataatatataaatattatatattacataaatataatatataaatattatatattacataaatataatatataatatatattatatattacataaatataatatataatatatattatatattacataaatataatatataatatatattatatattacataaatataatatataaatatatattatatattacataaatataatatatatttgtacatttatttatattatccatatggatggataacacactcagtcttaagcaactgtgatgcattttttcttctccctactcacctctttgagcttggcagcttttgtaacaattttccagggttttgttaagccttggggcaaaaatggtcacctgaaatttaaaagctgtgtttagcaatttgaaagcactgatacagaattagcatgttggcagtgactaccagagcaaaagtcaaggctgatgggcaacagtggaattattttatacctttcaggagggctttttcctgtgcatgtgcttgaaggaccactgggagcaatgctctagttgtgttcacataaaaggataaagatgctaagaattgtgagaatagtttggaatcaattcaaatagagaggtcaagtctattgaaaaggttgagtttggtatatcagagcttttctttttcccccgtcttcaggtgattaatgaaaaaggtgttttcctttcattatttgcaatgacttaaatcctagtataaatagaccagaaattaaccaagagcaaggttatatttggagtaagtttaaaaacacctaggagaaacatacgtctatgtggaaataagtcatttctgtcccagtatccaaagggtacaatacctgacagtctctttttggaataaagggttttatactaaactctgagattcagaacctaaaaaaggagttattttcatacattatgggcagtgtatgatatttattgaatttctgacaaatgtatttgtgatataaatcaaataatgtgtattaacataacctggcttttttttttttgatggactcattgggcatggagaagaccttccttggataaatttcatgtgccctaatcccaactgtaatagagtaactctgtgaaagcttgtattatgtgaaaagagaagagaagaatgaaagaaacactggaaggtgaagagagagaaaggaggttggcggaagtctagttgagaattgtgtgatgctcacgttcttgggccacagtcatggacagtcagacgtggcttgttacagggagaaggtagttatatttttatcctgctacctgtcaccttcctcactgatgtcctcctggcatttcctcggcaagctgtgaccttaccgaactctgaactcctcacgcttgcttcttctaggtcttctaaggctgatcttccctggaattatcctagtatccatacctactcttatagttcccacaaacaacctcaaaaatagccttacctgtatactttcaggatcctggcctctggagttaaactaatatattcacatgtgcaacatgtgaattagagaccaacaacaaaacgtgtgttaaaggttcctagtgcatcattgctgctgtgtgtatgggagggagcgtggtacagcagcaaagctcgagtcaggctggctgccgtgactggctgtgccacttatcagcctggtggccctggtcactgaatttgacctcttaggacagtaatttggtctgcatcaaggactctttgaagttctaaggacatcaaagttattaaatctcctggcacaaaatagacaccagacactgtttgccatgcgtatgtgggcatttagacttcagtggcattttgaagataatggcttaaggaagatattaaatctaactggaatctaactgtggggtgagtttcaggtttggtagcggtctggttgattagacatttagtcacagggatatttttggtgcctctaaatttaccccatttttatcatcttctgatgaaatctggccctgggtctatcacctatcttagaaatgacttgccatgttgaacttactttttgaaagagagagaaaacagaaagaaaacagaagttgtggtatgcagaataacacccctgcccccacccaaggatgtttacaggttaatattcaaaacctgtgagtattttaccctacatggcaaaacagtctttgcagatatgattgtgtgatttcaggagattatccgggaccatctgggtgagtccagtctaattacatggttttgaaggtggagaactttttccagctatggtcagaaagggatatgactgcagaaaaaggctcagagaaatctgtcattgttggatttgaagacagcggaaggggaccgtgagccaaagaatgtgagaaacctctggaaggtggagaagacccagtacagattctcctctcggggctctggagaggagggcagccccactgacacaccttgattttaactcaacgagaactgtgttactcccaccctccagaactgtgagataatcagtttgtgttattttttaagtcactatgttagtggtgatttcttatggcaacagtagaaaactaatatagaagtttaaaaataatgtgttaacaggagaaaagaaacacaagatgacttcaaaagtcctagaaaaacctacaaagtcctgttcctaatacatagatgtgagagagaactgttgtcctaagagcacgcccagaggtagacaagtgacacgctgcttgcctgagcaccacccgttggcatttggctttaaaagtgtcacaaactgccctgactgtgcaggctggaagtggcagctcagaccaagcatccgtggccacagcagctgtgggaacagcaggcagagccctagaaacgaagcaacttgacggggagatgtttgcagatgggcaccagagtccagccttgttattattagggaagaagtaaggcagacaaactcagggggagagcagagcaccctggcgtgaacacaggaagggaaaggagcaaagccaggccgggcgccagggatggcgacccgagcaggtgggagaggccgggctgacagtcagatgttctccactgcctggctcagcagtctgaggcctgcaagccggagaggaggggacagagcatggggggctgacagcagcgtcgccgaaaagctggcagagaacaggagagaagggcggccgctctttttggcctctgcttcggtggagtgcaggcccccacagctgtgacagagacagcagtgacagccaccatcgcaaaggcacagatttctcagccccaaatgacaagggcaggttttcgacacatgataatgaacagaagaaaggcaggttccatgaaatctgatggcagatgtgattttttttaaacaccagccagcacagtcattgagggctggccttttgaagtttcatatgagtggcatgctgcacatttgctggtctgttctttgtgtctgtgtcccagaatcaaggtgaaggtggggcaccgctgcagtacaactcagcctcctgtgccggctccagcacggagagcggttctatctccaggagccagaaagccgaaccaaagcaaaaaacagccagagtgccaggctggccactgcttcgcttcctgccttctgtgctgtcctctccatgtagcgatctcagcgactttccctcagtagctacctccacctgctcatgcttctgctgctgatgcctggcctcgtggcagcagtaaatccagccaatgcatggttctgtgtttctctcaaacatgaagactgcctggagaaataacatccagaaacaatataaagaaagaagctagcagagtgaaacacatcctggatttcatcgccttccagccttcccttcaagagagatttcagtgggttatatgagacttaactttaatcatttctttcatcctttctttagcctgtatggtttctaaaaagggaaagaaaagaaagacagaaaagtagttggagagagaacaagagagaggcagagagggagagaaagaagctatggatcatataatccacaaatagcataactgccccttgaaaaactggaaggcataacacatgccttgaggaagaaggtggtgcaattttggggcactggagtgagagaggggcaagttgttatgcagggcaagggtgagcagaggaagaggtgagcagagaagtagggtgagcaggggaggaagtgagcaggggaggagggtgaacagaggaggtgagcaggggaagaggtgagcagaagaggtgagcaggagaggagggtgagcaggggagaaggtgagcagggaaggaggtgagaaggtgaggaggtgagcaggggaagaggtaagcagaagaggcgaccaggagaggaagatgagcaggggaggaggtgagcaggggaggagaggtgagaaggggaagaggtgagaaggggaggaggtgaacagggaaggagatgagaaggggaggaggtgaacaggggaggaggtgagaaggggggaggaggtgggcagaagaggtgagcaggagaggaggatgagcaagggaggagtgagcaggggagaaggtgagcaggggaggaggtgagcaggggaggaggtgagaaggggaggaggtgagaagaggtgggcagaagaggtgagcaggaaaggagggtgaacaggggaggagggtgagcagaggagggcgagcaaaagaggtgagtagaggaggatatgagaaagggaggaggtgagcaggggaagaaggtgagcagaagaggtgagcatgggaggaggatgagcaggggaggaggggaggaagtgagcaggggaggaaggtgagcaaaggaggaggtgagcaggggaagagggtgagcagaggaagtgagcagaggaggaaggtgaacagaagaggtgagcaggagaggaggattagcaggggggaggggaggaggtgagcaggggaggaaggtgagcagaagaggtgagcaggggaggaggtgggcagggggaagggtgaacagaggaggggagaaagggaggagggtgagtggggaggaggtgagcatgggaggaggctgagcagaggagaaaggtgagcagaagaggtgagcaggggagaaggtgagaagggaggaaggtgggcagaagaggtgagcaggggaggagggtaagcagaggaggatgtgagaaagggaggaggtgagcagggaaggagggtaagcaggggaggaggtgattggggaggagagtgaacagaggaggcggcgaacagaggagcaggtgagcatgggagcaggagaggagtgcgagcagggaaggagggagagcaggggagaaaggtgaatagaggaggagggtgagcacaaagtggggttggtggggagggtgagcagagggtgtaggcaacaaagccagggtccggagcactagcccaccagatccgctgtgggaccctagcacctcacaatttttggcacaaaatcaccactgtgcagggctctgtaacccagcttcagcctggaccctgggggcagacttgtcatactctaatagatatacttcaaagcatccaagtatatgccactctgttgcctgggggctcccagtgagcaatagctgtaagcctgatacttaatggaaatttgcccaagcatggaaggaacaggcagagagacaacaagagaagcagatgaggcagatgaaatctaacccggacataatgcagagtgggaaactcgggggctggacagaccagagtggaggagtggcttggctcgcagatgtatcctccctcctgcctctctgtcaagccttaacgaggggagatcctctcatctaagagcctgggagcattctgggtagaggccagaggtgcctcctttgtgcacacaagcctttaaaacagcctggatttattgtggctcttaagtggcccaggctaatggcttggcatggataatgtcttggtttaattggttattgtgaaagctgcttgtttctactgtggaatctcttgtcctgcctttggagcaatccctcacaggctccctgaatcaatatagccctcactctgggccggccagtctgctttggaggcagcgcccgcagtggggaaagaggccctcccacaggattgctcagatccctggcggacgctgggctctgaggcaggtggcctgcttctggtgactgatggttcgcgtgtgtagatgtgcatgggctacagacacatttattgatgacctactcttgagggtgtctttgcaaggaaaagttagaggggtgcagatagaactgtacaaggggggctgggcgcagtggctcatgcctgtaatcccagcactttgggaagctgaagtgggaagtttacttgagtgcaagagttcaaggagcaacaaggcaagactttgtcccgacaaaaaaaaaatttttttattctactttaagttctcgggtacatgtgcacaatgtgcaggtttgttacatatgtatacatgtgccatgttggtgcgctgcacccattaactcctcatttacattaggtatatctcctaatgctatccctcccgcctccccccaccccacaacagtccccggtgtgtgatgttccccttcctgtgtccctgtgttctcattgttcaattcccacctatgagtgagaacatgtggtgtttggttttttgttcttgtgatagtttactgagaatgatggtttccagcttcatccatgtccctacaaaggacatgaactcatcattttttatggctgcatagtatttcgtgtgtatatgtgccacattttctttattcagtctatcattgatgggcatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggctgaactagtttacagttccaccaacagtgtaaaagtgttcctatttctccacatcctctccagcacctgttgtttcctgactttttaaagatcaccattctaactggtgtgagatgatatctcattgtggttttgatttgcatttctctgatggccagtgatggtgagcattttttcatgtgtctgttgactgcataaatgtcttcttttgagaagtgtctgttcatatccttcgcccactttttgatggggttgtttgtttctttctcgtaaatttgtttgagttcattgtagattctggatattagccctttgtcagatgagtagattgcaaaaattttctcccattctgtaggttgcctgttcactcagatggtagtttcttttgctgtgcagaagctctttagtttaattagatcccattgtcaattttggcttctgttgccattgctttaaaagtagccaggtgcagtggcatgagcctgtagtcccagctacttgggaggctgaggtgggaggactgcctgagcacagaggtcgaggctgcagtgagctatgatcacgccactgcactccagcctgtgctacagagcaagaaagaaggtgtctaaaaatattttgaataaaagaactgtgaaaggaagtcagaaactgtctcccttctcacagaagcaaaacaagctcatcaaagcaacaggtggattcacctagagccaaactaggccactgaggtgggggaactcccagtaggaaggacaacttctgcaaaggaacttgacgttcaggtttctgagaacaaagaggccagatgatccgcatccttactatagcatttctttccagggtcacgatatttctcttaagtcttcctaaatcttctgacattaaatatattttgttcatattctattttaaggtgtgtgaaatatcctaacctttgtgattcaagagcagcctgtctggaagtggttttagacctgagcacactgtgttgtggttacatgtttacaggtcaccccccaacccccatgaaccattagcccattagcagtttaaagcagtgacagggacttacttgtctgtgtgctccagacctgacatggttcctggcagcctaacgtgtctcactgatgttgaatgaatgttcccagggagaggaagcagaggaaaacattgaactgtaaagccatgtcttattgagttgtatatttgttatttttctgtcctcttacatatctgtatcatataaataaccaaaatgagatcatgtgcgaagaattcagaaaatcaagcagtgtgaaatacaagttgcagcatatttttaagtggaatctgctggagtaaatctcaaattgtaacacttaaaatggtaacacaagacaaagcctgattagcctttcgggcaggcttgcttcttctatcatctgacacaaaactctatttgagattcgccgtatgtgacgagtcagctcctgttcctgtgtggttttagattatactcgtttcccaggagttgctggatgatcgactgagatctctttaactcacaccatggtttttgtcctctccttttttctgttatgctttcctatgtcatgaacgtctttagtgcaacgataccagttgccactttgcgggaaggggtgttaagtgtggtaaggttactgaatccttcactgctgggctgaattcttccccaggtactagtgaaaggacaagctgtctgagccagcagtctccaatatggagtttacacaccccaggcccagtgaaccactgggaccaaaaaaaatacagtattagtacttagctttatgctaagacagattaatacaggatcttatgtatttttaaattttatgtatattttataatgcaatatattaacatactgataatagagatatgtaatttataaatatgcatgctcaatgttttgactggtagactattctggcaaacatgtttatagcctctgctctaagcatgggtgtgtcctgatgggcagtttgtctttccccagggcttatgtcccattggaagggagaaaaaagtcaggttccttccagccctgtgctgcagctttgtgtcactcctgggtgatggagaaatggcgagcttaagtctatggaaggagtgtgttctgtggccccactgtctttaaaatggcacttggtactttctatccaaaaaagggctcctccaagccagtctaggctttttccccactagggagaattcttcaccatgacttttcaaatcattgctgaagaaacaaaaaactgagcctgattcttgggctgactcccatgaagactctgcactcaaaatgccgtgttagatttcctgacttcaaggtcatggccaataggcagtttgggtttttttcaatgtcctgcctgccaagaaaactgataatgctcttcatatcctctggcagtctatgttgattgtaggaatggggtgtggattatacattgttgggtacaattacctcctggaatacaatgcatcttcttttagacatcccagggagataatttcgacataatgaagatctatagtaatcagataattactatcgattgctctttagacgtcttgatgaggtaattagggcatatggaaagaaagaagctggaactgattgattggcatgactgtaatctcaaagatttctaattatgtttcttttcttctaatggcttataaacaaacatcattttagctttagaatttgtcaggtgccaggttcactgggaacatcagctttctctattatgctaactagacaccaaacatgatcaacataagctcattatgccttcctgctgaagcagaagaaactgcaattaaccctcacttttcttcttcttctccacttccacatggctctattcttgtcgtggagtggggtgtcatggagtggggtgtgccacgttctgtgaggagcgtgtgtgactcaaggctggatgggtctgtatggcctacgggagaccctcggagcctgctgagctcaggcacagcagactagggggacaatgacacaacatatgtgtcaaggtgtctggctgactgtggctgggggctggctgactgctcgggctcctgtcacaagccatagctactcatcagccagcaacattaagtagcaggtcaatactctcaggcagctggaccacacacttgtctacgtcagtgtgctattgcctcatctcttccattagatactaactagaggacgccctgtctgaaaccacattccacattatcctaatatttttttacaccttataggaccttcgagcagcttgcatggttcagaatagttgcctcaccaaaagatgacagatattaagaaccactaacgcagcatcttgaaatgagctgtttgcatgtaatcaatgatcgtggtagccaccacacttactgctctacaagtgcatgggttagaattcgttcaacaaatgcaaggtggatgcatttttctgaatatgaggcaatctggttcccatgcctgaaatcctccactgcgacccacctgtgcttggtaccctggtgggtacccaatccatgcatgttacagtctgaatgaacacctgtgttcttgaattccctgctttttattgaaatagcaccaaagaaaaaattatattttgctttttttctaaaatccatatattcctggacccttattttaaaatgggtcacaaatttcctgtgtatttgtaccattaaaacttttaaggcatgagaggagtaacgtgcatagggatggttcagacagcagaggagacccaagatagtttgttcattgataactaatggtttgctgctgtttggataattacagctgcagttggaaatgcttcattaactcccattaactagcctgagaaatggaagtatatatagaatctgtctttatgttgttatctgtatagtataagaaaattatgtagcaaattttttcatcagccacaattctcgagaaacaaaaatattcttttgaaaatgtaattggagtaactgtttagttcaatatttggtgtttaaaaaccttcctaatctgtatcggaatattttcctttaatagaatatataattagcatattctaatttttttaataattgggaattatgcataaatcattttaagcaaactttttatatttttatttctgtacttgaagtaactataagagattgaactaaatgtctaaaacaggttctaattttttatttgttgtttggttttatcaagtccaaggaatgagtatctcttctagttatttgtccctttttgtaaaagttaattgaaaatctactttcttatcaatcagtttgtctacatttctacctattttttctttaatttatggctctctggttttgagttctgatgttattcccccatatttgataaatactccactcatcagtcggtaaagggcaaactgtatgaaattgctcctcaacagtgtgatgtagactgccaaaacatagtttgttattagggtctggtcccatacaaaatgggaggggctttagttagtttagttagagggtctcgaggctgcaaaagtgggtgttcaaggtgttgcacaagttccgcctgccattcaggaggcagtaaagaaacttattcaatgagagagctgacagaagtgatccaaatcaataacgtgctttgggtttggggcatgtcattataggaaattttacatcttgagagacagatgggaggacagctcctagaagaacctaaggctcttcattttaaaggcagcacccacaacctgcgcctgtcaattcacgatatcgcccattccctctggaagagcaaattgctggctaaatatcaggtaaggttcccaagccgaacaaaaggtctggagacatctctaagaaagaggtctaaaattatatagacataggaaatccccttccttgaaattaatcatatgtcattacttgtttctccaaaatagtttggggttatttaggatttttgagaaacacagacatatttgagggaatgctttttaaaaattcttcctttaaataaatgtactatcattgttttatttttaataaatgaaaggcttccaaatccatcatttcaattaattttcatactaaatgttcacatcaatgggtaaaaacagcttgaaatgcattcacagaaacaaacagaaggacatttttattccatgggacacaaattaggcttcagccttcctaggccagtacccttacattgaaaaattagagggagccctactttggagaactgaaatagcatgtaaaagtaaaacccaatcaggatattattaaacaagagacaagaaaatactggtcccaagtgtcatttgtatatacctgggggaaaatcacatgaccctcaaggaattttcccctccttcatccgtcagcctgagctcttgagaaaaccactttggcgggattgcaagcctcatatgccatcctaggaggggcagacatatttagagagctgtgaatccatgttgatatttatgcaaattcaacccaaaccccagcattgcctctgaactggtagctatttcctgatgtaagccaatgaacatactggaagactgatgggaagacattctggctccattctcactctcattggtctagttcctacacataaattatgggaaacaagcctactggtttgttaacaatcatgagctttgacggaggttgcatgccagactctctatgcacagctcagtccttgatggagacagaaggcttctgacttactcagtatacctctttctttgctttcttctttcctctgtgttgcagttgtcataaaatactataaatctccctgttttaggagtaatttcttttatacaattataagaaaatactattttaatgataatgataatatgatattagttaaagctaagcctggccgaatgcttaccatctgctggacactctcttcatacattggtttagctcatttaaccccagcagacctacgaatgagaagctctttgtttactcttttgcagataggaaaactgagcaatggaaagattaagtaatttgccccaggttatcaagtaagcgaaataaggggttcttatttgtactggatttggctccgaagccactgctttttacagccatgctctcccattttttatgtggcaaccttttctttctttcctttattgaaaacagattctaggataggctctgtaaggtggtctagacttttaggaaattaaagcctgttcgatgcttggtgccaagaacttttctgtggcagctaattgagtctgaagtttccaactgtagtgggttttggcttcccctgtcctgggcagaggaggatgtaaagcatgaaagggagccacatcagtgcagtatcctttagactttctttgcttttctccagaatgtcacgacagggattctattaatgagcaatggctggtgtgtgcaagttttattttgggaattgtataaactcttttttttttttaatcatttacaatggttcctgttgttgtaaattagagacatgtggcagactggttaggtacatggattctggaggctgactccttaggttcaaatctcagccctgctacttacttgctgtgtgatttggggtaagttattgaacctctctggccctcaagtttttcatgtgataagggtccaggatgtacttaaacatagggctgttgtgaggattaaatgaggccacaggtgtgatactcagagtacctggcagcagaccatctgagagttatttttggtattagtccttcaattgtggttaacactttcatatcctttaggaaattccattttaccatgtttggagtggatctcaaagaaacctgcactgcaccttcactctggaaagatttagcctgaacacagtggagctggtttgcaaactctgtgtgcggcaggtggaaggagaagggcagatcttccagctcaactgcaccgtgtcagaggtaagtggctcctgtctgtctgaaatcaggggagagtgcgacactcaggaagacagagtgtgtgggctaaaagggtatctcaacatagtccatatgggaagtcctcaaaagctttctatagatcctatttgttaatagaataatatttgtaatgagcaatggaagctagctgcagaaaaaaaaatatatatattaagggatcctttttgaaaaacaagtcttaatttttatgacatgaattttaagaattatgttctaacttgtaaaaacagatctgaatttcaagtaaaggtttaatttaaggagcgtgcacatggagtaacttctccccatgcatcccttagcgtgccatgttcccccatcctccatctgtctctcctccctttctgcttctttctcagcaactctcctccctttcccctaatcacctgctgctgggtggagtggaagaaaggagaggggcttctctgctccctttttcttcttctccattcaaaggaagaaaggagaaatctcttgatctcctttctctctatcattctctaaatataaagagagatacactttcctccgggatgggggaaatatgccacaaatagaagtagaatctccatatttcccccctgtggccatcagctttgccttcctttgctgtgatcttcacacacttcagttggctatttccctgtgtccatattacagaaataatagtgatcactgctatctaaaacttctccttaaggaaagaggaagtgcccatgaccttccttatctgttaccttggatccaaagccttgaaaattgataacccttcacaccagaggaacaaagggaagagaagaagccaaaagggcagaaggcagcctctttggggcctcatggagctaagccctgtgctgcgtgctaagccacaaagcacaagattgtcatatgtgaaaatgacagcgggccagtatatgatttaaaatactacctctccctcgttgtgtcatgcacagtgacgaatgcaatgtcagcatgttcagcttgtcttgcttcacatgtcatatttaaagaccatcttccttagcaaaccgagtggggagaaaagcacatcagcttccgctacactccatccttctttctttcccacagcctgccgaggtgcggtcatcatttcctcctgtagtttcatgagacttttgactcataaacaactttagtcacagcccccggtgacattcataaggaatgatctcggtgtcagggtgccatggcaaccgccaggccttcggatgcgcagccctatctcccaggcacacagcaccacccctgctggctcgggagggtgttttcactttccaggcccagcaggtctgcaaagttcaataaccacccagctccagtgacaacaaaggctgcggaattttggaggggggtgagggggtctggtcctttgatgcttgctttctgttccacatgaacattggctgcgtgttaaaaaggtggatcagatgcagccacaaatgaaagagagctgctctgtgctctcccgcgccagggctgccacctcccttcagaaaaaggacagttttgcatagtgtgatcacaatttaagggcttttgctttcttatggcaacacagaggaaagattacttcttttgcaacacggtgtcagtctgctcaaagagaccagccttcagtcatgtcagaggcatctgcccttgtgtgacagacaagcatatttaactgagggcggggaagaagtgaggggagtcaagatgactttgggggattaaggggcactctgcggcttttccttctgggtcactgaatcccactgttgtggttagcatttgaatgcgggtgctgggtgcgcagaggagggagtgtggatgggtgtactgatgttggagaggaagcctctgcgctgaagaacaatggactctgtagagttatgggacccagatcctcaacaaaaccttcaagaaagggtacaagatgattgacaaaccataaacaagtagagaaaaggctccatttgtggtttctttcttctgaacagggctccttcctagggtcacagggcaagatggcaatgaggctggggttcccgttccaatgtcctatctcccaggaatgagctggcttgccagaaatgtgctgcccctccctccagccacccaccaccggacgcactcaccagtcgtcatttataaagctacacagcccttggcctgtcctgtcagacagaggacctgttgcccaccccagagaccaggctgtgcgtgacatgtactctgattatttcaagggccagccagttgtctctgggtgatttagccagggattccttaactagagacaaaggctttaattaatttcacagagatgaagtttaagaaggaaaatgtctggaagactaactaactgtattgacacaaatgaatgtcaaaatgtaaaagatgataaaagattttgtttgttggtttcatagacaagtgcagagagagtaaccaggaagctactcattatctccaaaagaaaagaaaacatggtgcagaggacagatgataaatttacagttttttcacatcttctattttgtttcagttacaggcagacatccatcatgggaaattcccaagtaggctgttccatggagatagatagggccaattacttaatcctttcttgcctcagtttccccattgtaaattggtatagaatattatcttgggccagtgtgggaattaaatgggagaatgtttgttagtaagtaagtgttctaaacagaacttggcccagagcacatgcttaatctatgttcaccatttttactggtgccactgatgccataaggataacagggcttttgagtcaactttgctacttcaatccgtgggggggggtctgtcatcaattgaggtttcagattttctttctatcatcaatcaaaataaacacaaaaataaaactcagatcctatataaataaatgaaaactaaatataaacaaaaattagctcccagagaaaagaaggtagcatgtatccccaagttggtttatcacattgctttacttgaaagctctgaaccctgaaaaaaggtgcagttttagggggcagtatttattagtcagtcatctttttcttttttttttttttttttttgagaaggagtcttgctctgtggcccaggctggagtgcagtggcacgacttcagctcactgcaacctccgcctcctgggttcaaacaattctcctgcctcagcctcctgagtagctgggatcacaggcatatgccaccacacccagctgatttttgtattgttagtagagacagggtttcaccacgttggctaggctggtctcgaactcctgagctcaggtcatccacccacctcagcctcccaaagtgctgggattataggcgtgagccaccacgcccgttctcatctactttactttaataatagatttataggtaataaaagcaattataattaagttttatatttgctagatcttataacctcttaagttgtggtgcacagcacttctgtatacacaaataatatttatttaaaataaatgtacaaagtaatatcactctgctacagccatttcatctgtttacatcttctgctttccataacctgctcaaaatgaccattgggaaaatctagtttttctaagcgactttaggaaaagtccaaatatcagaatagaaagttgtttcaggactgtggagtcctgaatatgtgtgtcatcacccatagcagctgtttgactaatgttgaaaaatcatatgtttacataagggaatcataacatcaaagaccaatggtactgatattataaatgattattgaaataagcattctgtgagagtaaactctacttttacctggaagtaaaggaagaactaatagcaactaaaattactagatgaaatgtaaatgtataaacgtattttactttaactttcaaggctgttgtcagccatttgataagagaaagaaacaaagaaatgatgccctattgagcttgtttcatctacacagaaataaataggctgagtgagtagccagggatagagagctcaggacttcaatgcccacatgaaatgctgaggagagttctttatccacaagaaaatggggacaacatgaatatgtgagcacgccttcccaagatccatgcctatctatcttcaactggcctctcatttcaggatttaacttccacatttagttggaaggcagctcaacaccctagtctatgggtgggcttctatcagaggttggcttcatcttctttctgtactaaggacaaatattttctctcatttcaacaaacaaacattaattgagtagcttcttgtgtgtggggcacagtgttatcatagaggtctgaggatgattgattgattgatatactctcaccaaaaagaaatgtgagaaataaaaggcagtaacctacaaatacagccaatgtgcacagagcagagtgtgaggagcacagaagagctgggaggcaccgaggagacctccaggcctgacgcctagggtatgctcgcccaggggggccccagggcacaggacttttggaccaggctttgaggactttgcctgacagagatcaaagaaaagaaagagcagaataactattagaggtgcatccttagaaatggcataagaactagtgagtggtgctcagactctaaggagcctatgagtcaggtcaagtcacggtaaggacggggcaacctgagattagattgtgaagtggtggaagcacaggtgaacagccctactccatgtccgactgcattctgcacttcacatggtcaccttgcagcctcataccagccaaccaggaaggtcatataaagatccctcactgggccaggtatggtggctcacacctgtaatcccatgactttgggaggctgagctaggaggatcacttgagcctaggagtttgagaccaatctggacaacacagtgagaccccatcatctcttaaaaaaaaaaaaaggcaaattagcccagtgtgatggtgcacaccgatagtctcagctatttgggagactgaggtgggaggatcgcttgagcccaagaattcaaggctgcagcaagctatgatcacaccatggcactccagcctgggtgacagagaagtgtcaaatgcccctcctaccacatgaagaccttgtctctaaatacatatatatatgtatttgaggacaaataccatgatcacagccaacagcactgtgcataccatggcaaaagatttcaaatgccctccacacccctggattgaccctgttccatgggattgcataagcctagaagtgagcacttgctgctgatcgcagaatgtggaacatactgctaatcaacactggcacacaggcagttgcaacctcaccgcctgcagtgccagtgcattcacggctggggaggccactgaagcggtgcagggcagcatatggggggcgctctgggtgatgatggtggtgttgagcccctgagctgagcactcagcaggaaccaaacacttcatgatggctgaaactgggtgtggccagttagttcatcctctggcaactagtgaggaacaccaacaagttacgtgctttaaaaagagagagacagccgaataggaacagctccagtctacagctcccagcgtgagcgacgcataagatgggtgatttctgcatttccatctgaggtaccgggttcatctcactagggagtgccagacagtgggcgcaggtcagtgggtgcgcgcaccgtgcgtgagccgaaggagggcaaggcattgcctcactcgggaagtgcaaggggtcagggagttccctttcctagtcaaagaaaggggtgacagacggcacctggaaaatcgggtcactcccccccaagtactgcgcttttcccacgggcttaaaaaacggcacaccaggagattatatcccgcacctggctcggagggtcctacgcccacagagtctcgctgattgctagcacagcagtctgagatcaaactgcaaggcggcagcgaggctgggggaggggcccccgccattgcccagacttgcttaggtaaacaaagcagccaggaagctcgaactgggtggagcccaccacagctcaaggaggcctgcctgcctctgcaggctccacctctgggggcagggcacagacaaacaaaaagacagcagtaacctctgcagacttaaatgtccctgtcagacagctttgaagagagcagtggttctcccagcacgcagctggagatctgagaacgggcagactgcctcctcaagtgggtccctgacccctacccctgagcagcctaactgggaggcaccccccagcaggggcagactgacacctcacacggccaggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaatggaacaaagctggacagggaatgaccttgacgagctgagagaggaaggcttcagatgatcaaattactccgagctatgggaggaaattcaaaccaaaggcaaagaagttgaaaactttgaaaaaaatttagaagaatgtataactagaataaccaatacagagaagtgcttaaaggagctgatggagctgaaaaccaaggctcaagaactacgtgaagaatgcagaagcctcaggagccaatgcgatcaactggaagaaagggtatcagcgatggaagatgaagtgaatgaaatgaagcgagaaggaagtttagagaaaaaagaataaaaagaaatgagcaaagcctccaagaaatatgggactatgtggaaagaccaaatctacatctgattggtgtacctgaaagtgatggggagaatggaaccaagttggaaaacactctgcaggatattatccaggagaacttccccagtctagcaaggcaggccaacactcagattcaggaaatacagagaatgccacaaagatactcctcaagaagagaaagtccaagacacataattgtcagattcaccaaagttgaaatgaaggaaaaaatgttaagggcagccagagagaaaggtcgggttacccacaaagggaagcccatcagactaacacctgatctctcagcagaaactctacaagccagaagggagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaatcatgccaaaatgtaaagaccattgagactaggaagaaactgcatcaactaacgagcaaaataaccagctaacatcataatgacaggctcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagacctaccaagcaaatagaaaacaaaaaaaggcaggggttgcaatcctagtctctgataaaacagactttaaaccaacaaagatcaaaaaagacaaagaaggccattacataatggtaaagggatcaattcaacaagaagagttaactatcctaaatatatatgcacccaatacaggagcacccagattcataaagcaagtcctgagtgacctacaaagagacttagactcccacacattaataatgggagattttaacaccccactgtcaacatcagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaatgaacagaaattataacaaactatctctcagaccacagtgcaatcaaactagaactcaggattaagaatctcactcaaaaccgctcaactacatagaaactgaacaacctgctcctgaatgactactgggtaaataacaaaatgaaggcagaaataaagatgttctttgaaaccaacgagaacaaagacacaacataccagaatctctgggacccattcaaagcagtgtgtagagggaaatttatagcactttaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccagtagctggtttttttaaaggatccataaaattgatagactgctagcaagactaataaagaaaaaaagagagaagaatcaaatagacgcaataaaaaatgataaaggggatatcaccaatgatcccacagaaatacaaactaccagcagagaatactacaaacacctctatgcaaataaactagaaaatctagaagaaatggataaattcctcaacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggagctgctaccattccttctgaaactattccaatcaatagaaaaagagggaatcctccctaactgattttatgaggctagcatcatcctgataccaaaggctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctgaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcagttaggaaaagaggaagtcaaattgtccctgtttgcagatgacatgattgtatatctagaaaaccccatcgtctcagtccaaaatctccttaagctgataagcaacttcagcaaagtctcaggatacaaaatcaatgtacaaaaatcacaagcattcttatacaccaataacagacaaacagagggccaaatcatgagtgaactcccattcacaattgcttcaaagagaataaaatacttaggaatccaacttacgagggacatgaaggacctcttcaaggagaactacaaaccactgctcaaggaaataaaagaggatacaaacaaatggaacaacattccatgctcatgggtaggaagaatcaatatcgtgaaaatggccatactgcccaaggtaatctatagattcaatgccatccccatcaagctaccaatgactttcttcacagaattggaaaaaactactttcaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataacgccgcatatctacaactatctgatctttgactaacctgagaaaaacaagcaatggggaaatgattccctatttaataaatggtgctgaggaaactgcctaaccatatgtagaaagctgaaactggatctcttccttacaccttatacaaaaatcaattcgagatggattaaagacataaacgttagacctaaaaccataaaaaccctagaagaaaacctaggcattaccattcaggacataggcatgggcaaggacttcatgtctaaaacaccaaaagcaatggcaaccaaagccaaaattgacaaatgggatctcattaaaataaagagcttctgcacagcaaaagaaactaccatcagagtcaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacgacaggtgctagagaggatgtggagaaacaggaacacttttacactgttggtgggactgtaaactagttcaaccattgtggaagtcagtgtggcgactcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatatacaccatggaatactatgcagccatgaaaaaggatgagttcatgtcctttgtagggacatgggtgaaattggaaatcatcattctcagtaaactatcacaagaacaaaaaaccaaacactgcatattctcactcacgggggaattgaacaatgagaacacatggacacaggaaggggaacatcacactctggggactgttgtggggtagggggaggtgggaggggggagggatagcattgggagatatacctaatgctagatgatgagttagtgggtgcagcgcaccagcatggcacgtgtatacatatgtaactaacctgcacattgtgcacatgtaccctaaaacttaaagtataataataataaataaataaaaaagaaaaaaaaaatagagagagatggcatttatagtagattaagtagattttcttttattgctttaatagttcccaggcaccatttgcttttgcttttccaaccagcacaagtgatcagaaaatgattagaatttctcctgcagatgaaattcagattttgcatttgtgttgttttatgagctgagactatcttaagagccaatttatggttttctctactaaaattagatttttaaaaaataaggatatacagcaattggaggatgccattaacaacttgccctaaggcaataatatactgtgtttaccattttcttttttaagaaattagccttaagttgatatcatttagaggagagctatgttccagttcattcaacaaaagcagaactgagacatcttctgtggagtttagcagaactactggagcatttgcccaggactttctcctcaaggtcaggctgtttccagaagccttgaatctcagatctattcattcccaaagcactgcccttttgaacattttcctctcctgaaatttaaacctttaggagctctgatattccctctcttctctctcagcctggagaatcccattagtaaagctgttatcgaatcacaccagagctttccatccagcccagtcctcaccaaagactcacaaatctgaggctatgcaaagttagctcaaaatgtatgtacctctatctctgagccaggttacatctagtgatgcacaactttcaggctaagaagaagccattcttcctaagaagaataacagcattcattcttttcttatcactcaaagcaaggcattatgttgattggttcaatagagattgcttttgtcctcagaaataatgctgtgttgttcctgtccctgaactacaggaacctactggcatcgatttgccgctgctggatcctgcgaacaccatcaccacggtcacggggcccagtgctttcagcatccctctccctatccggcagaagctctgtagcagcctggatgccccccagacgagaggccatgactggaggatgctggcccataagctgaacctggacaggtgggtatggtctggccccaagactagcttctttctgttagtgccctccaggaccgataactattagacgtagggttagcttcatttttttttccatccacacatctatttaatttttcattttgcaaatatgcattaagctctgtccttgtaccttgcactacgggcttgcaaagagtgctaagagacattctgagcttatctggcattggtaagtatcaagttttgtgatgcactttgccaagctgatgggctaaattccccaaatcatatagccattcactaccgtagttattgctcctcctctgcagttgagcaggacctaatgtttgattaataattagcatgccaacacagcactgatattaagttataaagagacctctggagcgtctactttgtggagtgtcaccgtcactaccaaacataacatgtggcatgacctgtcaaagatcatccaagcctggactagaaagaaaacataagtctcttgatttcctgtttagaatatgacccatagacatcttgtctcttaaattatctcactcagagctgaggttcacaaagttaaacatcacatcccctgtctggggctgatctaattaagcatgggctagttatttaggatggctcactgtcagccacaatgggaccaggaaacttaaagacaagtagagagacagaaaggtttagctgaggaaaaatagatatgtaagtcacactgttgagcacattttctctttcccaattacaggtacttgaattactttgccaccaaatccagcccaactggcgtaatcctggatctttgggaagcacagaacttcccagatggaaacctgagcatgctggcagctgtcttggaagaaatgggaagacatgaaacggtggtgtccttagcagcagaagggcagtattaaccaccatgctggaaggggaaatgaaggacaaaaatgcacagggagtctgtggccgtccaggtgaatcacagctgaggaggaaatccagatgagaccaatgcacttcacaggcaagactgcagcaggagccagaaggaaaacagatacaactgcccatgtacatgcccactttactcggacatcatcacgggagttaagaaaaattgtgtaaatttgtaccttgaatttagctatcaacctaattttcctcttagttgggctgtatgctgtgtggtacaggatcttacagtttcctaggaaacgctttttattgctatccagatatatggataaactttcttaacaaacccaatttctacaaatgttgtttacatcaaattggacagggatgcagacactgtccatggctcgttctatttttgttcaaatcatttgaagttgaagctgtggacggtttgttgtgtctatttcagattagtaatttacagagaaatcacagacttttgctacaaatcgtgtgcatcaagtgtctcagataatcctcccatcagtgttctgtttctagaacttgtagaaccagtgttactgtttgtatcagggaagtggagaatctaagtgtaaaaaagaaataactaagactcctattccttggagggacccttctggtgccctttgggaataaagctgtagcactgcagggaagacagtgattcatgttcaaccccacaaacaagcatttttttcacaacatgtgtgtttgtttgtaatatgcaatatgaagtgtttttttttaaaggtattattattatttacaggtattctggtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaaccagttctcattgtgggtctgtcactgtcttgttgcgccaccttgagaaagtcatttaaccacacgacctcagtgtcctcactagaaagtgaaagggtgggattagatcatctccaagttctgaaatgctcaacttccaccgtgatgcctccagtctcattcatcagtctgaagaccacaatggactctgacctggatcatcatttaaaaatcatcagctggtcttttgcccaggctatgttacgcctttcaagtagttctgacaaggaagatgattattctaaccagcattatgatgttgtttgtttggcctgagtcgctctgcatcattgcattatgctgttcactgagagatgacatccctttattatcattttcttagcctctcttgggatgcccctgcccccagccttcctgactggttgcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacaagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacac

SEQ ID NO: 16537 - DNA, 14587 bp, Human
  misc_feature (1)...(14587): n = A,T,C or G
gatgaatgaggcagaatcagcaatactcatcatcagttggttaatggcaggtggagtgtcaatggggagattctaaaatgatttatcaagttattggctcagatgattaaagaggaaaacatgtgcatcttaccaagagaaggacttcaagatgggtgaaagatagtggattttgttcagggaatgttgaaattgaagtacttgtgggacatgatggtgaaaatgtacagaagacagtggttatgtggatacggaactcaaaggagaggactgggttcaatatggcagtcatgaggctataactaatagctgaagtcatgggactagagaactttacaacaaagggaccctgggaaaggctgcagtaagtcttcatgttttataaagtaattatataccatgtctttttgttaaaagacagttttagtggataaagttatgtttctttgtaaattctgcttttagaagtaaaattatcactgcaatgtaaatgagttttaaggaagattggtatctgatgaaaaatgttatggatttgatttttaaggtctttacagcaagatttatacaaatgaaagtcgaaaacaacaaaaagtttaatatccaaaagaagtttatgtcaaacatttgaaagaacaaaaacattctagaacaaaaagggaaacaaattattttagaaatcaacttaaatgtaacttctgtctgagccccatgttgtaattatttgctactttgcctcacctttggggctgggggcggggggtgggctggggcacaacactgtgtcttttatctatgtttagggcgttgtacatagtatatactcaggaaaaaaacctgtttattccatgccagaatgggaggtttgaacagatgacttggaaggtccctttcaaccctgggagtctataaaagggaagtggttattaccgcttaaaagaagaagtaggcttagtcctacttccagagagccaatgttttcatagttacagaaaggtaaatagactgtcagctcaatatgacactggtaagaattttctaacaattacggctatccaacagaagaaaggctgtctcagaaggtggttagctctgaaacaactggtatttaagggctggaaggacccttaggtatctttaggtcttcctaatctttttcatgccattgcctatacagaaaatggtatttctataacacaaataaaaaaattatacagcaatttttgacacatcaatgtctcaaggcatacttgtcacacgttctcagggctttggctgggaaaactgatttagtctaacatcctcgtttgcagagggggaaactgaatcttaacgagggaatgcaatattcccaagtcaagacgttaatgttaatactggaactagaagaattgagactagcgactgtggacaactagccagtttcctctgctcaaattaagcaagctggaggccagactgaaagactgcagtagatggtagaataaacagtctaaagctatattgctttaaatgtggtctcaagaccaccgacattagaacttgttaaattctggggaactcgctaaaatgaagattaatgggccccacatagacacacggaattaagctctgcggtaaggccttggaatctgcatttttaggtttgcgaatccccgcctctcccgttactatttctgaactccgagctccagccctggcttgaactgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcaaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcaggtaggcccgcttgcctgtgccctaggggcagcagggcccaggacgtcccggggttggaatgtagaccctatccttcactttctgcccctcctaggagttcagagtcaccctggttctttgattcagaccgcgaccttgccaaggggacggtggccttgagaccaggcctttatttactctcttaatacgccgtaccttcttgctaccctccactcgcttctcccatccctcctcactgtccagctttggatcctttccgcctcctctgcgaattcgcgccgagtctccggccatcatctaggcattgaggaggcggggcccaggagctggagtatagacgctttccttcactccctgcccttcctaggaggtaagggctttgagacttcagtcctgcagacgctcccctccgtttaggacagggttttaataagtctctagcattcttgttgaaggcgttggatacatagtatcttgatgacatttcttatttgggatctgtgttcatatacatgtgaatattgacagttaaacatctgacactggttattttctttttgtttatatgtagttttgtgtatttaccgaggtggttttcatctgtcttggcaagttgtccaaagaaacctgtaagttcttaccttcgattttctaaagaacaactacccatatttaaagctcagaacccaggtaaggagttttggggcatatacccttttctcatgtaataaaaatgccattaagcagttaaataccaatgttgaattgcagtgctaaagcattcagtgactgcaggaacaatcatttgatgtctgtaaaataggaagttctattttataccaaatggaaatgctttaaatataaatgagaactagtaaatggtattttaaaaataacgtatagtgtagaaagcaccctaggaagaggataaaaaagctgaatttggggccttgttgcctttggtctagaggaccactgatgaattattttctcttgcctagctcctcctttttctggctcagggaattgttaataaagttgcaacttctgtggaagcatccataaactgtaagttctgtagaactgtaaagttctatgcaatttactgctaatttcaagagctttcaagataagaaaggataaaccttttcatcataggagttcagagccactctggttctttgattcagacctcgaccttgccaaggggatggtgggttgtaaaggataaatcctttcttgtcttgggttcctaaaaaaaaaacatttccaggtaggatgtttgttgactctctagaaagcctctcggcgagaataaaaaatgctcacatcaggctgggtgaggtggttcacacctgtaatcccagcacttcgggaggtcgagatgggtggattgcttgagcccaggagttcgagaacagcctgggaaacatggaaatcctgtctctaccaaaaatacaaaaatgaggtgggcatgggggcgcagtgcctgtagtcccagctacttgggaggctgtggtgagaggatcactggatcccaggaagttgaggctgcagtgagccatgactgctccactgcactccagcctgggtgacagagcgagaccctgtctcaaaaaacaataataattttaaaaaaaagctcacattataggtaaggagttagtttcagagacatgcttaagtacccacatcttttaaatgtaagagttagtactaacaggtatttttaaaaatcaattaattgcacgccatcattccggttaagatgaagaaggaagtggagaataacagattgaatttcgaatagcttgtttccaaatgatatttctgttattgaaatacgaggctgtgttatatggatcgagaatgtattttgttgttagcttttataaatttaggaattcctcaaagacttgaaaaagtgttttgcttgaaatatggaagggaagtaaaaaacttgaagcaattgatcatccagcttcttaaactagtaatcagcctggtgtggtggctcgcgcctgtaatcccagcactttgggagactgaggcagatggattgcttgaactcaggagtttgaggccagcctgggcagcatagcgaaaccccgtctctacaaaaaatactaacattagctggacatgatggcgcctacctgtagtcccagctactcgggaggctgaggcaggagaatcacttgagcacaggaggtggaggttgcattaggccaagattgtaccaccgcactgcagcctgggtgatggcctgggtgacggaccctgtctcaaaaaaaaaaaaaaatcctagtaatcaaactgttgactgtttctggtggtatatggtatactccttagttgttagataatagacttttgataatgttggataaattacttacgtttaaattagttggataaaggaaagttaaatcattatattaagttatgtgtggtatggattgtgctttcctggatatctttagaaattaatcctgagaggtaaaattgtggcatcttttttctttttatttcattccatagatgcaaaaactacagaactaattagaagaattgcccagcgttggagggaacttcctgattcaaagaaaaaagtaagcacataagttttcaacattgctgaccagttattctgcagttaggagcaattgtcatgtcctttaaaggaccagatggatcagactttttaaaaaataatctgttatctacaaagaaactttatgtcttctcatctgcataaataatgagaatatggatgtatggggtggaggtgaagaagtggcagtagtttgaaaatggaagctgattactaaactctcaccttgattagtatatataaggaaaatgtatgttttaatccatatacatctcatcccagagcacattttccacctggtgataaaatctgtctgtctgaagtcatgcagttgcctttccctggcatgtgctatgttgaatttgccagcaatggtttgttgacttacttgggttttttatttatagatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagtgagtatcattgaaatacttttttcttatggtaaagaattgagatttatataactatgaatataggtagttttctcttaataggcaaataaaatatggtagaatgtcatcaagtattcttcagttaggcagaagtgggatagttctcttatgaaaagtgagatagccactaggaccacttgccattgagtctgtttggaaatccttgttgctacttgcagatgtatccacatttaaggtgtacagttcgtagaacagtaatggaaactacaggaacagagttatgaaacagtcaaaccaggagtatcaagaatctttgcttctgagtcttctttagaataacgtattaatttgaattattctatagattatggtgagtttgatatggaatattgctgagtagactgcattaattcattaacacatcggaaaaatgccaatttatctaatcaattaagtgcctttaggatggaattctttttttttcttcaaagaaataactattaaaaacctcacatggttcaaaatttgtagttcccagcttaatgtattaattcacataaatgtcatcatttgaaagttatacatttttttcatagagccagtattagttttgaggtggtcagtttgctagtcgtgtacctacactattacaaatgatcatcagagttaaaactatttctttgaaagactagattacagccttgaatgtgggatgccaatacgtctttccctgaccctaatgttttaagctgtcctagcactagggttgaggacccgcccagtttcgagaccatgatgccgctactttagggtggctgatctaatcagtaaaagggagccagaaagatactaagagtgaaaaatagagtgtctacataaggatggtgtttggaagagtgattactaaagtatatcctccctctttcattctcccttcctccttaatgcacccagcccactgtgctaagagtagagaggaccagaagcatgaattggacatttataaagtttcccttgtcattctctctttcttttgtaattgttcttgactcccagtaccaactagttcagagatcaagtgagaagtgtgaggactaggaagttacaagtaaaaccctcaggagagaaatccctagtgatagctctagaaacaaagagggaaatagttaagttgtaaagtgcttggagtctatagtagtttcaatactcagtgactgagagattcaggaagaagaaactaaatcagaggagccctacttacagttatgaataaaagttgaatttgttactgattatagccaaattgctattaagagccacagaattttgtaaattacaggtactacttactatccaaattcagaaacttaagtataataatgcaatatcactccctgaactcagaaattaaactgatagtaagggatacttgtattcttttccacagtttcttcccttttggtaactagtaaaatgaatttaacacaactatggagctttaaaggtggagacattcagggaatggagtgagatgaaagattattaaacaaatagtccattgttcttgggttgtggtggaagcatgcagtgatttggtcaaggggacagtagtatcttacaaggatgaacctaaggttgttttatcttttaaaaaggttttgtacatatatattcagttatttagttcatggagactatgagaataataggtaaaggaaatggttttgtatggaaaataactggtgaaatctaacataattttcataacagtgctgtcaaaaaaattctgaccgcaagatgtaataatcacactatataagaatcataacattcactttaaggaataatctgtaatgcgtagtagtgaataaagtttctgtaggtaaaattaagtctcatggaggttaacactatttttgaccctccaatttttttaattcaggagttaacactgcttggaaaaccaaaaagacctcgttcagcttataacgtttatgtagctgaaagattccaagaagctaagggtgattcaccgcaggtaaagctgaaatatatttttgtttaatttttaaaatatttagacaggaaaagtctagagtgccatgtgtcaggtagtgaagaaaagtagtgaatatccagacagtaaactcttttgctaaggccctctttaaagaaaaatcttttttcttaccatatacaatcaatttaggtatgtagttgccaacacatacatacatacattgccaactttttaaatttaaatacttaacattttttttaatatgtagggatattaaagttcttctggaggcttttctgttccagcagttcttaactgttttacgatcactagaaagaatgagagtagagctgcaatattttctatggggaattgattgtaacctattgcttcatttatatcttttaataacattttggttatacccatagggatgtgttatacatgtgaatgcatcatatcagtgtgtcaaagaaaaagaaagcttgtcaatccctgctgtggcttagtctttcctatttttttgctgcttagaagctccaaatgggcaattgctttttttcctgtatcatatgacatagtaagagaaatggatgtttagatccgtaacccatgttaatctaagatgaagtttttggcactctgcctacgggattattatatctgtagttcactttacaaattctgtttccatatccctaaataacatttttatattgttgcttcttgattttttttcaactttaatcattgtttatcttatgctttaagcattacctaccaccgtttaagctagacatttcttccccgggtgaagacgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaacttaatctctctgcttttagtatggtaccatttccctcaactgtacctgtacctggttttcacagagtgacactattttactctctagagaggataaatgtcctaaaatttgccatggtagaaatttaacctcttttttttttttgagacaggcagcctgttatacaggctggagtgcggtggcactatctcagctcactgcagcctctgccttccgggctcaagcaattttcccacctcaacctcttgagtagccaggtctacagtcatgtgccaccaagcctggctaattttttgggtattttgtagagacggggtctcatcatattaccccaggctggtcttgaactcctgagctcaggtgatccacccacctcagcctctcaaagtgctgggattacagatgtgagccactgtgcctgacccaacctctctttattttttttgagtcggagtctcactctgtggcccaggctggagtgcagtggcgtgatctcggctcactgcaacctgcgcctcccgggttcaagcgatcctcctgcctcagcctgcctagtagctgggaccacaggcacgtgccaccacacctggctaattttttatatttttagtagagatggggtttcaccatattggccaggctggtctcgaactcctgacctcatgatctgcctgcctcggcctcccaaagtactgggattacaggcgtgagccaccacacctggccctaatctctttttaaacagtctttcagccaatcttgtgtttaaccttagcttcacctgttttacacctgtctggtgctgccaattcctgagatatttgggaattctgtatggtaaattaagttgcttttaggttttctccactgtcagtttaacaattagctttcttttgtcagttaagtcagttaccactaatgcatctgcttttcagcttccagaattttgtgttgatagtgccctcttctgttgtctttattcatgtgggattatcctttaaaaagatttctttgtttaatgggattttagggaaagcaaaagtaaacatctttggctgggcacagtggctcatgcctgtaatcctaacaatttgggaagcggggtgggagggttgcttgattccaggagttcaagaccagccctgggcaacgtggtaagaccccatctttacaaaaaaagttttttaaaaaaattaaccaggcatggtggtgcatatctgtggtcccagctactccagaagttgagacaggaggatcacttgagcccaggaggtcagtgctgcagtgagctgtgatcataccactgctttcccacctgagtgacagagtgagaccttgtctcaaaaaaaaaaaaaaaattctatccctttaattttataaatgaagagccaagcccaagggaggtaaagtgaccttttccaggtcatataattaagttcaactaagtagacttactggacttgtgctgtattgttcttattactgcatctaaacactgaagcacagattttcaaataaaacctaaagctacagggaaggaataaaaacagactttgaagttagtttatgacaacacatagattatacctgaatattaatatttccgaatcaaaaatatgtaccttcattcagttcatttttgtaaattgtaacagtttgatagtttttgtttagagagaaaagatgttaagaattgatgaggctttgcctgtaattcttggtatcttgagtttttgttggaatgaataataaaggtcactgaagtccccatatctaccttaacttaaacatatattgttttacaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaattattttcatattctcagaaccagtttggcatttttctcttggtagtttttgtctgcaaataaaattggtatttgaaaccacagcactcataagcctgagtgtccacttattcagtggcagtgataccctgctgctgcccccttcctgcacctcaagatctgaacttgtaacaatttcattcaaagagataacagtctatctcttacattttcatcatctaacttttatctcatgaaaatatttcttctccagtctgcctttatacatgtagaatggtaatgtaatttctaaagtatatacagaagcattccagaaattaattgctattttaaataatcattttatctcaaaaaataagtaaatcattttaacagttatgctttttctcagttatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaccaagatcattcttttacttgtctatggctgcttttctgtggcagagtagctgccacagaaactatagcccacaaagcctgatatttactgtctgtctgtttatggaaaaaatttatcaacccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactg

SEQ ID NO: 16538 - DNA, 13743 bp, Human
acaggaagatggccatcttttgttgttttggtttagtttggggtttttttggtctttgtttttgagatggagtctcgctctgtcgcccaggctggagtgcaatggcacgatctcggctcactgcaacctccgcctcctgggttcaagcaatcctcctgccttagcctcccaagtagctgggattacaggcatgtgccacaacgcccagctaatttttgtatttttagtagagatggggttctgtcatgttggccagactggtcttgaactcctgacctcaggtgatctacccgcctcggcctcccaaagtgctaggtgtgagccaacatgcccgtcctttttttttttttttttttttttgagtcagagtctcactctgtcgcccaggctggagtgcaatggcgctatctcggctcactgcaacctctgcctctcggcctcaagcgattctcctgcctcagtctcctgagtagctgggactacaggcccgcgccacaacgcctggctaatttttgtatttttagtagcgacaagtttcatcatgttggccaaggtcgtcttgaactcctgactcaagtgatccacccgcctcagcctctcaaagtgctggcatttcaggtataagccactgcacccagcaggaaagctgtcttgagtaaaagtattatataatgacaccttgcattctgagagcagctgctgttttcaaggctcttaaagagcctggactctggagacaaaggggcctccagaggggtccacgcctagctccatcactgtgtgaccctgggcagctcacttcgcctctctgagcttttgtttccgcatctgtaaaatgggggcatggatgatgaggtggtccccaccctctagggtggctggaaaattatgtgtgggagccatgagcacatagtgtccggcacgtgccagtgctcagtcaatgagatttgtcatttcttcagtcaacaaatatttatttttgagctgctgctgtgtgcatcatgagctgggagctggggagacagtcagtggtgagggaaactaaagtgatccctgccctctgagctgacgctccacagatgctgaagaaaatgagtcagtgcactgtgggcagtgttcgggactgcctcacgctgtgcagagaaacaaagaagggagatcggagcgcaggaggtgcgtggctgtgttatttgtttgttttgagacagggtcttgctctgtcacccaggctggagtgcagtggtgtgatcgtggctcaccacagcctcaacctcccgggcccaagtgatcctcctgtcccagcctcctgaatagctgagactataggcatgcaccaccacgcacagctatttttttttcttttgcgtagagacaggcatctccctatgtcacccaggctggtcgcaaactcctaggctcaagcaatcttcccgcctcggcctcccgccgtgctgggatttcaggcatgagccacagtgccagccttcatggttattttaaagatggtggtcggggaggcttcactcaggagatgacatatgagcaaagatgcagtgaaggaggtgaaggaaggagccgtgcgatgactgacagaaagacattccaggtagagggcacacaggtgcaaagaccctgaggccagatccaggctgataaaacagagcattttagcagtctcctctccctgccattttttttctcaaaattgacaagcacaagtgtccccggcccaagcaccgcagagagcgcgcagcatctctccccgtgaccatgacccagctactgcctctttaaccttgaatgcctttttgggggctcacgtgtcacccagtggcgagtgagccacccttacttcagaagaacggcatggggtgggggggccttaggtggtgcccgcctcacctatgactgccaaaagcggtcatggggttatttttaaacatggggaggaagtatttattgttcctgggctgcagagagctgggcggagtgtggaattcttctcgggaggcagtgctgggtcctttccaccatggtgagtacaagggctccaggaggtgatgatgccgggtgggcgaggagaggaagccactacaagcgagggaccacggcggagggggaggaaggcggccctcaaagcctccagccccttgtggaaaaagccccattgactgcgcgggcacagaggaaccccaatcaatgccccgataggccacaaataacagcagctctcggggactcacaaacacaaaataagagagttggcttttttatggcttgtctactgacctctcgaggaatcaataactcccaggacttgcaaaatgggattgaatgcttttaaggatcaaattgtaattcttttctcttgttcaggcagctgggaaaaagaatgtttttgttttcaccttttgaacttgcaaatttaaaacctttctttctgtgctgttgggttaggtgtccccctcctgaagtgggcagtccccaaatcagggtcagcacaggagggagagtggttagaggcaggaactctggagtcagaatgcccaagttcaactccccaagttcaacgcccaagttcaactccggctctgccttctgtgtgtgtggctgtgtgatcttgggcaagtgacccaacctctctgagcctcagttgcctctcctgtaaaatggggatgataataatagtatccacttgacagagtggttatgagaattaaataatacatatgtagagtaccgaatcatttgctgttattgaaagtcagagagaagtggggtggggaagaaaggtcaactcgctcttctctgccctattgatgtggtgcaaggacggagcattcagagaggaggttttgctgccatttggagcaagggaaaattgtggggtgtggggcgcagttgggttttaacaccttgaagaactgtcatttcatcttggcattcatcatggcttagtgagcctgactttttctttccctccaatcaattctccttctgtgcattactgagctttttgtgaaatgcatcagaacaaaagtggctggatcctgcaggggcgatctgaaggtgtggcctccatccccagggacacacctgtggcttctcctagttggtgaaggagccactgcaagatgcacaaacgcttatgatccactggtaccagagggctctggagaaacttcatgtcatgtcctttgctccctccagcatcaccgtttggagacctgagtgtggatgctgtacccacatttcacagatgggcagctgagccctgcaacagagatgaacacacccagagtaggggcctgacctagttttttgactcccagcctctcactcttttaatcgatgcttttttcccccaggcacctaagaaagcaaagaagagagccgggggcgccaactccaacgtgttctccatgttcgaacagacccaaatccaggaatttaaggaggtgggtgcagctattgaatcatccgcctggatggaaatcccacccacgagggagaaccttctttttgttccatattcccagcagggacctttcattagatgcctctatcctccaaacaatcccaaattcggcctgaacggatgtgtgaatttttaaaagaaactatttttaatattttcactgattatcaaagtaaaacatattccatgttgaaaaatgttggaaaatttttcagaaaagcacagaaaaggaaataaaaactacctacaattctattacccagagataatcagttcacattttagtatatacccttcaaaccatttttgttatctatgtatatatttattaaacaaaattataatcttctgtgcccactgattacacctgcatttttttcgttgagaaattcaccattaacatttcctatcatgtatttaaaccatttcctatggttaaatatgacatttgtttataatgttttactactataaataacacctctttgcttgtatctctggttatttcttgggggtaaattcctaaaagcagaactgctgggtcaaaggaacttaaaacaacaacaacaaaagaactaaaaacaggcagaactgctggtccgaattgccccccaaaatcacagcactaattcctatgcccagcagcctcgtgcctttccccacatttccatcaacgctgggtattaatagtcacaatttttttttgccagtctgagaggtgaaaagcagtatcttctgggttttacattttacagtctttgattattaaccactagccccatttgaaaccccatcgcatttgatggcaatggaccttatgaagagaaccaaagtaccaattaggccaaactgcacacgggcttggatggacaggctcagaattcattttccagccgttgcgagggctcacactgactcatccacattcccacctggctttccagagggaactatgctaaaatgatgctaaagagaccagactgctttctttttttgtgcgtgtgacagagtctcgctctgtcacccaggctagagtgcagtggcacaaccacggctccctgcagcatcaacctcccagattaatcaatcctcccacctcagcctcctgagtagctgggaccacaggtacacaccactgtgcccagctaatttttgtgatttttgtaaagattgagtccccctgtgttgcccaggctggtctcaaactcctgggctcgagcaattctcctgccttgacctcccaaagtgctgggattacaggcatgagccactacaccctgccctagtgtgctttatatcaaaggggaaaccatttggggcttccaaacaggaaatgaacagtcgtaccttttgtcctcactaacattcagattgcaggaatgccgtgtcccatagggaaagagaaattcctgaggcaagtgtcatatctgaacttgagatagtcaccttccaggcagaaagctacacccgcctcttttcccagcctctggcatcagctgccggcggtgtgggtaagggatgcaaagaactcaaaacatgtagccaggattccccatttggtctgtttgtttgtttgtttgtttgtttgtttgtctgagtaaatgggattacaggtactcaccaccatgcctggctaatttttttgtatttttactagagacagggtttcactgtgttggcccggctggtctcaaactcctggcctcaagtgatccctccgcctcggcctccaaagtgctgggattacaggcgtgagccactgcacctggcctaaagctattattttttaaaaagctaaaaactggtgtctcatctggcctctccactccctagcctgccctatctataaaatgggaccagtaatctatctcagctgacagtcagggagattctcagaactttataaatgcccaagtgttttacaaatgaggaatcacgggccaggcacagtggctcacacctgcaatcacagcactttgggaggctaaggtgggcagatcacttgaggtcaggaggttgagaccagcctggccaacgtggtgaaaccctgactctactaaagaaaaataagctgggcattggtgatgcgcgtctatactcccagctactcgggaggctgaggcaggagaatcgcttgaacccgggaggcggaggttacagtgagccgagattgcaccactgcactgcggcctgggtgacatagcaagactctttctcaaaaataaataaataaataaataaatagctttatagagttataatttgcataccataaaattcacccttgaagtgtgcagttttgtggtttgcagtatactcacaaagttgtgcaaccatcaccactatctaatttcagaatatttccatcacccccgaaagaaaccccatacccattagcagtcacttcctgctcctccctctcccaccagcccctggcaactgctaatccattttctgtctccatgaatttcctgttctggacatttcatagaaattgaatcatacaatatgtggtatttgtgtctggcttctttcactgatgttttaaggctcatccatgttgtaacctttgtaggaatttccctcctttttatggctgaataatattccattgtatggacagaccacatttggtttatccattcatcagttgatggacatgtaggttattttcagttttgggctactgtgaacgatgctgctatacacatttgtgttcaggtttttttgtttttgtttttgttttccgagatggagtcttgctctgtcatccaggttggaatgcagtggcatgatctcagctcactgcaagctctgcctcctgggttcaagcaattctcctacctcggcctcccaagtagctaggattacaggcatgcgccaccacgcctggctaatttttgtatttttaatagagacggagtttcaccatgttggccaggctggtcttgaattcctgacctcaagtaacccacgggcctaggcctcccaaagtgctgggattacaggcgtgagccactgtgcccagccttgtgtacaggcttttatgtggacatgttttcaattctcttgggtatatatctagcagtggaatgtctgggtcatatgataacacgaggcctgacgttttgaagaaactgttggattatcttcaattgttgacttttaatctgaggtcctacaatgatctttgaagatcccagaatccactcctgccaagtccttggcccaatctcttgggcaactctgccagtttctcccaggctgagctgccaatcacttcccttccacaggccttcactatcatggaccagaacagggatggcttcattgacaagaacgatctgagagacacctttgctgcccttggtatgtcaccctctctagccctgcatgagggtctctttatctcacatccatgaggagcaggaggtgggaccatcagaaaagctcaagatggtgtcatttcccaaagaaacaactctgccacaactggtctttaagacaaatttcaggggatgggaaagaagtgtttagtctttgagtaccttcagatatcttttttttctcttgaaataacttttttgtgtgattttgaatgcaatgtcagctcacaacagaaaatggggaaaaaatgcagaaaagtataaaggagaaaatgacatcacccagaaggtcatattccactgtgaacattccagtccctcctctaagtctttctagacatgtctgttaggtttgggttttagttttttaaattattggaatcattctctttcgaatttatcttctaaaatgtatcatctcaacagtgtgagcatgagtacatggagtttcttcaaaatatacatgcccaatctgctacccgccaccaccacttactcctgaccttagaactcagggcaaccatacacagctgtgcagactgcgcactgcacaattctacagggaagtattcacatttgtagtgagtgtagctttttatacttaaaacatacattggcttaaaaaatgacagatttttcttatttgcacaaaggtaggcttgtggcaggactagagcaggtaaatcagaacctccacggctgtgggttacagcaggtttaacttgtaaaagttccctcaggtgatcctgatctgtctctcccgcctccaactgtgaagggctaatttacaacatgagcctttcccatttgagtgaaaaatgaaaatatctgcatcaaatgttccaggttctgaagacactattttaaatataatgaactggccggcatggtggctcacacctgtaatcccagcactttgggaggcgtaggctggaggaccacttgaacccaggacttcgagacctgcctgggcaacatggcaaaaccctgtctgtccaaaaaactacaaaaattagccaggcatggtggcatgcacctgcaatcccagctacttgggaggctgaggcacgagaatcgcttgaacctgggaggcggaggttacagtgagtcgagattgtaccactacactccagcctgggtgacacagccagaccctgtctcaaagaaaaataaataaataacgaacaccttcccacatcagatgttagggtcgcttccagtcatttggttattataaataacactgtcaagaacatcttctcagaaaagatctttgcctccatccaccccatctctgatgatttctagactagatttcttgaagtggaatcccaggagccaatggcagtgtcataatggttctttctccccagctcggagtccctgagtgtgtgtttcctaccctagggcgagtgaacgtgaaaaatgaagaaattgatgaaatgatcaaggaggctccgggtccaattaactttactgtgttcctcacaatgtttggggagaaacttaagggtaaggtcgtgtgtgtgtgtgtgtgtctgtgtgtatgtgtctatgtttcttcgggggggctggcagaagatggttaactttaaaagagataaagcaccattggaaaaaaataatgaaaacagcaacttggctgggcgcagtggctgatgcctgtaatccccagcactttcagaggccgaggcgggcagatcacttgaggtcaggagttcaagaccaacctggccaacatggtgaaaccccatctgtactaaaaacacacaaaaaaattagccaggcatggtggtgtgcacctgtagtcccaggtactcaggaggctgaggcgggagaatcccttgaaccgggatgtcagaggttgcagtgagctgacattgtgccactgcactccggccttggtaacaaggtgagactctgtctcaaaacaaaacaaaacaaaacaaaaacacagcaactaacattgctccaagacttaacctaagtcagacctcatgctaaccactttatatgcattaccccacttaatagcaactaggaggtatgctctattcttatcaccagtttacagatggggaactgagactaagagacagaaagtcccttgtctgaggccacatggctagcaagtgccagggttaagatttgaatcccaggctttcaaatctagatgatgtttgaccttgggttctcagccctctcttcgaaatacagaggctcagtgatcagacgaaagcagggtctttttcctccatgcaaagcagccttgctctggccccttcatctctgggggaacttgggccctgctgcctggggtgccagtggttcccagccacccccagtacatgtaagccctgtgttccgtttcaggagcggaccctgaggaaaccattctcaacgcattcaaagtgtttgaccctgaaggcaaaggggtgctgaaggctgattagtgagtggggtctgtgggggaggaagggggttccctgcttgccccctgtcccccctacacacacacaactgacaccaacacctgctttcctttctctgcagcgttcgggaaatgctgaccacgcaggcggagaggttttccaaggaggaggtaatggggtccttcaagcactccctctaacccagctcctgggttctccttctggggggctccgtctcccctctcgtctaaagcacccctgaccccacactgacagagaaccagctatgtcttctgaggcctggcctcatttcattctctgccaccctatgaggtagggactggcataactgccattttacagataggcaaactgagacccagggaagtaaagtcactcatctaaaataacaataatcacacctgtaatcccagcactttgggaggccaaggcaggaggatcacttgagaccaggagtttgagaccagcctagccaacatgaggaaaccctgtctctactaaaaatacaaaaattagctgggcatggtggtggacgcctgtattcccagccactcaggaggctgacgcatggcacgagaatcgcttgaacccgggaggcagaggttgcaatgagccaagatcatgccactgcactccagtctgggcaacagagcaagactctgtctcaaaaataaaataaaataacaacactaatagtaaatgccaggacctagattcaaacctaggtctgcgtgactgcaggttctgccttgctcacgatgcatagagacctgcttagagcatgacattattatggcgtgaagggccgccacatactgtcatgtgagttgtgcactgaacaattcttctaaatgtcagtttcataaaagtcatcagactgtgtatttgttgcaacagctttccagaactggcagtaaagtgtctggtaataatttttttttttttcaactcaggtggtgcggtagtgagtttggtagaaggggcacttttgctaatttgccaaagcttctgtatgagcaagcaatggtgccgtcaaccttattagtgaaccttaatgagtcgattttaaatgctcccctcatagcctcacaggcctgtttccatcaagttccacattttactaaaaattgtatgtagattttccctcccccaaaattcaagcagctaaaagggctgccttcactttccacctgctgtgtgctttgaacaagctccttaacctcactgcacctcaatttcctcatctgtaaagtgggaataataatagaagctacctcataggagattgcgaggattcgacatgttaatgtggggaaagtgtgaacttgtggcaagggcatataagtgctagctatgaatagccagtatgttttaaaaaaataataataataactagccaatgctttttaaatggggaaattttgtgtaaaaacaaaaatctagatttctgacaccctggaccctgtggtcacttcatgtcacctttttagatggccacgtgtctccatttagccataggacctatccagcacccttgcataacctgcctggcccctcggaacccttgagtttgtgatcccagtggaaggctgggtttccagggacatctctgcatgatgtttacttgggagggcccttggggtcagggaaggaagaacagggaagggcaagaaaggaagaacagggaagggcaaggaaggaaaagtgcatgaaggaagaagttgagccaagatttaggcccaaagatcggcactgctgactacccagggagggagcttattctacagctctcctgagaggtaccaagttgggcgagatggccgtgcctttatacccccacaccaatcccatccgctggctgtgggctgccccagaaagggcatgaccttgggcgagggggccctgcagcagctggggaagtccttccccggaggaccctctgagtggcccatgttcccatcccccaccccccagctatccgtccactcaggccccgcccacagccccccaccctccgtctcagttcccctcccctcgtccttagcacgtgttgctggctcattgcaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtatttggtcacgacatttctctgacaaacagtgccttgtgtaaggaaggcaaaggcagatgagctagtgacagccttgcagtcattattattgaatcttggtgactctttatttaaggtagacctttgcagccactcagaactgtttctatcaaggatcacgttttcctggaatgttacctggatgaccaaagccctctcttccaaagagctcaagcatttagagggccttgcttccatgacatctgtcccttgggatgccatcggaatgcctctcctgccagtgacagtgacaagaaggaagcggactgacacatggtaggaacatagctcgttcaacagtaatcacacctgctaatcctaagagggtgacttctagtttcagataaagtagaagttgtctgtacttcttccctagcaaactgagggagtggtactgacttctgtctctgtctggggcccaggcctggatgtgagttgacctttgattttgaatgaccacagtcacggttgaagcattcaggtctgttatggctgcaagagtcccagtgtaagaaacaaatagggccaggtgtggtggctcacgcctgtgatgctagcgctttgagaggctgaggcaggaggatcacttgagcccaaaagtttgagaccagcctaggcaacatagtgagatccaatctctataaaaaataaatagccaggcatggtggtgtgcacctgtggtctcagctacccaggaggctgcagtgggaagatcgcttgagcccaggaggtcgaggctgcagtgaactgcactccagcctgggtggcagagtaagactctgtctcttagaaaaggaaaaaaaaaaaaaacagaaataggttcaaataactaagaagtccaagggcttcaagcacaattgcacctaggagcccaggcagtgccctcagaggctggggaggcctctgttttctgtcacgttgctctgctctcagcagtggcaaaataattaagagcagctcctgccccttttccagcccctcagcaatcctagaagagcgtactcctctctcttccagctccacacaaacatcagaacagggccttgtgggatccctctggggcacttgacacccctgagccaatcaccatggactggcaagggcagtgctctgatggacaggcctggctcaaatgatcagccctgtgctggggttgaaatcagagtcctcctgaaccatatggcctggagatgggagggaagattccccagaggaaaacccaagaagaagcagggagtggacttcgggtacttcaagttttcaagagaatcccaagaaccctcccagcactttgggaggtcgagtcaggcagatggcttgaggtcaggagttcgagaccagcctggccaaaatggcaaaaccccgtctctactaagaatacaaaaattaaccaggcatggtggcacatgcctgtaatcccagctactcagtaggctgaggcaagagaatcacttgaacccgggaggtggaggttgcagtgagctgagatcacaccactcactgagctgagatcactccagcctgggcgacagagccaaactccgtctcggaaaaaaaaaaaaaaagagagagagagagagagactcctaagaacccaagaacccaggacacagcccaagtcagtgatgtgatgggaagaagctgaaatgtggtgacggagtggagctggggtcacagtgaaggcaggaggacccaggaggccagaggagccacagttagggccagtcctcaaggcttgacaatgacaacagtgggaggagctcagggctgagccattaacaagacgaatgaaactgtcccctggctgcagagacctggggcccctttcaaagcaggctgcgtgggcagggacccaggggagtcatggccccatccccatgacccaggacaccccacaccctgtggtgaccctcgcccctcacggcttccctgcactccagagttggtccaggccgagagcctcatacccgggctcctgtggtcagagat

SEQ ID NO: 16539 - DNA, 45684 bp, Human
  misc_feature (1)...(45684): n = A,T,C or G
atggcaccactgcactccagcctgggcgacagagtgagactccgtctcaaaatacaaaaaaaaaaaaaggtttgtttggtaaagagataaagaatgttcgttctggattcagattgcctgaatttcagttccagctctgccactactacctgtgaaatcctgagccagttactcttcctccaagcctcaggttactcctctgtagaacagggacatagtaccagtttcataaagttgttgtgaccattgcatgacacaaggtatatgaaacactcaaattagtacctggcacatgttgaaatgttatctactatagtaatatactaaaaaagttcacaagaggtctcataggttttatgcatacagtatgtgtgtatggtttatgcactttcacataaccctgtgattcttcaacagggttatgttttctaaccccaaggagacatctggaaaggtccagagacattattggttgtcaccacctggggagaggtgctactgacatctagtgggtcaggccagggatgtttctaaacactctacaatgctcaggacaccccgcccccttgccaaaaacaaaaaagaataatcaggacccaaaatgttaatagtgcagagttgagaaaccctgatttaaacagggcatatggaaacgtatttcataggatgtagtcacaagatctatatacgcatgtatcttgtggtcatgtcatagtccagatacacacacatctagaacgcactatgtccacacacacacacatctagaatgtactatgtacttacatatgtatcattatacaatgtacctagagtagcatcctgtcatgtatgtgtcccatatgcattgattgtgtcagtatctacatacaaaagccactctgacatactggaaagaatgctgagcctcagaaaagctaatgttatctccatatacataattccatttcatcctcacaactgcatgaggacatgatatcatgccaactttatgcaatgactatactagttcaagactgcacaactgctgatgtaggtcaacctcatagtacggacaggaactgtgtttatcttatacgccaacgtatctcaagcatcccaagggtgtctagactctcagtaaacatttgtgaagtgacagggtggggaggaggaccccggtctaactgcagcactatgctcgtaaccagcagatcaccatcttttctctcttttttttgagacggagtttcgctcttgttgcccaggcgggagtgcactagcactatctcgactcactgcaacctccgcctcccgggttcaagcgattctcctgtctcagcctcccaagtagcttggactacagacgcgcgccaccaagcccggctaattttttgtatgttcagtagagacgaggtttcaccatgttggccaggttggtctcgaactgctgacctgaggtgattcgcccgcctaagcctctgggctgggattacaggcgtgagccaccgcgcccagccagatcgctatctgaacagcgatcgactctccactctctacggccccttagaaggaacttcacctctctgagcctcgttgtacctatctgtaaagtgggacagaaacaaaaccatccagactagggttagagacaggagtcaaacacaacaaaaggggcaaagttctgcatagcagatagctcggacaattcggagacctcgcggagccagggatcccgcgccgtcagccgaggtggattaggacgaggcctctggagcaagcagaggttaactcgcgactgtgcgaaaacctgcagctcagcctaagtgtggcaccccagcgcaagcaatctccacgacgtccttccgctccgacctcctcaaaattgcgtccggaagagcagtgggtgacccctgccacgccgcccaatcgctgtgcgcggtcctgcgcgcatgcgtaaaccgcaggtcagcgacggcggccgggaggcggaagtggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcgggtgagtcccgcggcctcgccgcattccctgtagccgggtctgggcccggagggcttcccttcccaaagcactggcccgggaaaagcccgcggcgagggctgttgcccaggaagacacggagaggtaatcgggatccctctctttcccatccgcctttgagaggccttcccgtttgttatctcagggaagccctgccccgaacctccctccctgtgccgtctgagggcatttagtttatacctggcgcgtctccctctcgagatagtcgagtggtgtgtttgtctcacttgcttccctatgggcttcgtaaaggcagggactgggtccccagcaacgctggacggtccctgggttaattaaattgttcccttttggaacgatatccattgaagtgccccctaaccatagtcataactaaaatttggacacttcctatatcccagcactgtactaagcaccttttgtgtattgtattctttaattatctttgcaacagccctaagaggcagatggatgtgacatgtacctcttacacattgggaaactgaagcttagtgattaattgatttgcccaaggttatctgtaatgggtgaaactgggattctaactcagtgagctggacttgagtctgagctttttacaccattaacacaagtgaggaagctccttagtggggaatgcagctctggctctgttccttggtcctcagataattaactaacattcattcaagaaatacttggccgggcgcggtggctcacgcctgtaatcctcacactttgggaggccgaggcgggcgggtcacctgaggttgagagttcaagaccagcctggccaacatggtgaaaccctgtctgtactaaaaatacaaaaattagctgggcgtggtgacaggtgcctgtaatcccagctactggggaggctgaggcaggagaatcgcttgaacccgggaggtggaggttgcggtgagccaagattgtggcactgcactccagcctgggcgacaagagataaagtccatttcaaaaaaaaaaacaaaaaaaaaacttatgctcatatctgctggagccttccttgtgtgctgaatcagacagcgtctctgttttaatggcaccagcagtatcatggaggaaacagatgaattaaataagtgcagaatatgtgtagaattacaactgtggtaagtgctgtgaaggaaaggagaaacaatttgggaaagtattacaagaagatgtgtttggtttggagagagggatgggggcaggtagggatggtgtcattgggaacttcctgaggacgtgacctttgaagctgcaaattaaagattgaatatgactttatagcttatgagcacctttccaaaggctaaaagtggcttctgagttctgagagtcagctaaattgatattagccgcatatagacatctgcatgggtcagtcatgtagtcatttattcatcaaacatttagagggcttcctctgtgtgctcggcactgtggtataagggctgggaatacagtggtgggcaaaacaggccttgtccctgccctgacagagcatgtattagggatatttcagttaagtctccaaattccgtttcccttttcatgtgtttcattgatttaagacagtaatcacagatgttcatggcttggttcatggcatgagcataagccaggatgtttaagactacccctacaagtttttgaaattttgtttttttaatggacttgatagcttcattttgggctgaacacaatttcattttatcaggtgttactaaaatgttagctcatctgggcatgatcactgttgcatcttctctaaggctccctctttggcgatttgctttaaagtgcatgattttgggccaggcgcagtggctcaaacctgtaattccagcgctttgggaggtcaaggcgggtggatcactttgaggccaggagttcgagaccagcctgtccaacatggtgaagccccatctctactgaaagtacaaaaattagctgggcgtggtggcacgtgcctgtaatcccagctactcgggaggctggggcaggagaatcacttgaacctgggaggtggaggttgcagtgagccaagatcacaccactgcactccagcctgggtgacagagtgagactctgtctcaaaaaataaaaataaagtgcatgatttcagtagaacagccctgcatttctgagtatattgtcctggctgcttattgactctttgctgtgtactgcagtggtcccagagttgagtgagatggatactacaaaggcttcttatcatcttggcggaaggcaggagaaagaaaaggaaaacctaatgatagaggaatagagaacagagaggagcttgttttattaccttgtattaatcattcatgtgttctttagccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccaggtatgctttctaaaaccctggactctcttttgtaatgtgaacactggttgcctattttatacacggtgtttgatgagcctacaatttcaacatctagcatacttttgtctttcactacgtgtgtgctttatatgacactgttaagccacatgttagtgtttccaaatatttcttccaaattaatcctaacagttggagttgacaattcagttcagtgacgggggggacttttttttttgaggcagggtctctgttgcccaggctagagtgcagtggtgcaatgtcgggtcattacaacctcagcctcctgggctgaagcagtcttcctgcctcagcctcccaagtagctgggattacagatgccctctaccacgcctgggtaatttttgtattttcagtagagacaaggtttctccatgttagccaggctggtctcatactcctggtctcaagtgatccacctgcctcggcctcccaaagtgctggaattacaggtgtgagccaccacacccggctaccagggagaatttcttaccacctagttcagtggcagatcattaatgtgtccaaataaacatgtcgtgccttcccctgctctgccagctcattttttctttctttcttttcttttttttttttttttttttgagacagtctcactttgtccccaggtgggagtgcagtggcatgatctcggcttactgcaactccacctcctggtttcaagcaattctccttcctctctcagcctcccaagtagctgggactacaggtgcacgctactacacccagctaatttttgtatttttggtagagacagggtttcaccatgtgagccaggatggtctcaacctcttgacctcccaaagtgctgggattacaggcatgagccactgcacccggccagccagctcattttatctgcggaagtggatgtgtagatagtactacatctccaacatggaggtggtcagaactggtaggtttggatttccaccttagtagccctgaatgtttgtcccagttaggatttcgtgatagaagatacctgcttgcattatggtattgccaaatgtaatagccatccttaagtttctgagggtgttaatgagatttttatggagcaaagagagctttaaagtatgatgccctcataaactcagctattctacaaataatagctgttaatgcattacattgtaattactctatcaaagtttattcctctgacttgaaattttaatctagttcaaatccttcagcatatgtcctatccatttataatctgctattttttaactggtgaaagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaagtaagaaaaccctcttttcttgggggttagtcaatttttttttttttttttttgctttgctttagcatagtctcttgtcctgaaggaaagtgggtattttaagcttcaaaataataatacttttgtctgttgtatgttagagaattctcagatgttttacatttgattaatcttgtggattgggtcaaagcttttccttataaaagaaatgcttgtggatacacttaagagaatatgtgggaaaaatgttttctttttttttttttgaaatggagtttcggtctcgttgcccaggctggagtgcaatggcgcgatctcagatcactgcatcttctgcctcctgagttcaagtgattctccttcctcagcctcccaagtagctgggattacaggtgcccaccaccacacctagctaattttttgtatttttagtagagatggggtttcaccctgttggccaggctggtcttgaactccgacctcaggttatccgcccgcctcagcctcccaaagtgctgggattacaggcgtgagccactgcgccctgccaggaaaatgttttcttagcagataggcatggaaggtgatggggaattgaaaggacaaagaaaatgatccacagcatctttgtagtctcatgtccccaccaaatctttactgaagaggctgctaagaagtcagttaactcattacaattttattacctcttttttaccattttctgtggttcaaacaaagcttgctagagccccaaggaaaggaagcatttggctagataatccacaagcccagccactaccttcttgggtaatggtagctgataccttaaggctgttcttgtgctaactcatttgccagatctctgctgggaaaacagtgactattcaggtagccattttgttttttgttttgttttttgttttgtttttttttgagacagggtctcactccataactcaggctggagtgcagtggtgcaatcctggctcactgcaacctcccctcccgggttcaagcaattctcctgcctcagagtagctgggaccacaggtgcacaccaccacgcccagttaatttttttttttttttggcagagatggggtttcatcatgttggctaggctggtctcgaactcctaacctcaagtgatcagcccacctcagcctcccaaagtgttgggattacaggtgtgagtcactgcacccggcacaggtagccattctggatcacagctgtcaagtgagtttgcagcatttcaaaaaacaaattgcattgtgggaggattttctttcctctctattccagccatctcaacttggtaacacttcctgtaatcctcagttacatcctcatggtttagaattctctcttgccgggcgtggtggctcacgcctgtaatcccagtactttgggaggccgaggcgggggatcacgaggtcaggagttcgaaaccagcctggccaacatagtgaaaccccatctctactaaaaatacaaaaattagcccggcgtggtggcacgcgtctgtaatcccagctacttgggaggctgagcaggagaattgcttgaacccaggagtcagaggttgcagtgagccgagaccatgcagcaagactctgaaaaaaaaaaagacagaattctctcgtatatttagagctgtttttttaggccttttaagagaggtccatagccagagttgtgcttttaagttaaccagtgacagatttttttttttttttttttttttgagatggagtcttgctctgtggcccaggctggagtgcaatggcgcgatattggctcactgcaagctctgcctcccaggttcacaccattctcctgcctcagcctcccaagtagctgggactacaagcacctgccaccatgcccggctaattttttttgtatttttagtagagatggggtttcaccgtgttagccaggatggtctcgatctcctgacctcgtgatccacccgcctcggcctgccaaagtgctgggattacgagcatgagctactgtgcctggccaccagtgacagattattattcaaacattgatgagagtaaaacactgcaaatttaccgaatgcagatttataaccgtaataaatgttgaactgaagattaaaaagtccaatggggggtataatatagaacagttcattaatgaaatattacaatttttattttttcctgttttcttggacataaaagttgtctagtattgtttaaactaaccatacctcatctattcaagacactctaattttttttttgttagtaagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggtaaaagttattaaatttattaaaaatctctttgccacagaaactgtggtattcaaactgtatgatagctgtgtgtgatttacaacattttgcacttaagattcttgagatgtcttctaagatataattgtaattctagatgtatttctaaattcattagcagaaatacaattataacgtatacacttttttttttttcggtagagatgagatcttgctgtgttttccaggctactcttggcctcaagcaatcctcctgccttggcctcccaaagtgctaggattacagatgctctgagccactgcacctggcctcatgcccatgattttttatagatcagattgagtatgaagtttagggttttgcaaggaggcagaggttgcagaaagctgacatcacaccactgcactccagcctgggtggcaagagtgagactccgtctcaaaaaaaaaaaaaaaaaaaatctagtgtgtttttttgtttgtttctttttgagacgaattctcgctctgtcgcccaggctggagtgcagtggtgtggtatcggctcactgcaacctccgcctcccgggttcaagcgattttcctgcctcaacctcctgagtagctgggactacaggcatgcaccaccatgcctggctaatttttgtatttttagtgcagacagagtttcactatgttggccaggctggtctcgaactcctgaccttgtgatccacccgcctcagtctcccaaagtgctaggattacaggcgtgagccatcatgcccggcctgtttgtttttttaaacaagcggtaactattccagaaaagcggtggttcccagactttttgaagttaacaccatcttattatttttccattacccccacttctttcattttttttttttttttttttgagacggagtttcactcttgttgcccaggctggagtgcaatggcacgatctcagctcacagcaacctccacctcctgggttcaagccattctgcctcagcctccggagtagctgggattataggcatgcaccaccatgcctggctaattttgtattttcagtagaggcggagtttctccatgttggtcaggctggtctcaaactctggacctcaggtgatctgcccgccccagcctcccaaagtgctgggattacaggcgtgagcgactgcacccggcctcattctctttttagtgggggaagagtgtacctgttctgtgatctccagagagaagctttagtgtggagttctgtctgcaagagagtacacagttattatgttttctgtttacaaagtaccccatcatttagggagacatttaaaaggtttcaattatcctttggatttaaagtttacaagttgacattaagaacagaaaagcacttgaatagctcctttcactgtccatcagaaagccttccaagggtgccaaggagctttgcaaaccatgggaaaatcgtgccttaagccatttcagtctggtagcacatgtaataataaggataatgatgataatatccaacgtttatcgatggcttctgtatcactcactgtgctaagtgttcaatacactttgtctcatttaatcctcactacaatcccttgcggaaactgtgttgttatctttgttttacagatgaggagggtgactgcagagggagatacatggtttgcccaaggttacatagctagacataaatgacaagcaagagtgtggcaccctcacttttaattccagggacgcgttcctcttctagtaggagtgggatgaaggtgtggggaagggaggcggttgtttgtgagacattctatgacagcagtattgttacagtttctacttaacaactagggcaataagcaagtaacaaaggaaaagacccagaaatagattgggaaaaaaatgttgaagagcactcaggcttttgaaatagtctgaagtcgtataaatccaccacagtcacctgtttaataaacccacacagttccctataacaagtactgcccttcataatgtgcaggtagtactgtggatatttactgtgaatgaattttccttgtacatctgcactatccttccccttgtgtcttttgatcaagtgaaggttgctcaagttgacatgtttttctgagactgcgaaacaggttgctgcatgctcttccccatggggctagaaccctttatcttggtatcatgagttgtattatttattgctaactctgggtcttaggggctaatccctatcatcctaacagggattttctaatacctaataataccctcttggtgtaagactggaagttaaactaatatcggctgtagtgagaataataggctcagtagctaccaactctgaagcacttactagagaccggaccctgtgccaagtgctttccatgcattgtctccttgaatcctctcaacgatgccatgttggccaggtgcagtgcctcatgcctttaatcccagcactttgggagagaccaaggtgggcggaacacttgagggcagtggtttgagaccagcctggccaacatggtaaaagcttatgtctactaaaaatataaaacttagctggatgtggtggcgcacgcctgtaatctcagccacttgaaaggctgaggcaggagaaactattgaacctgggatgtggaggttgcagtgagtcaagatcacaccactgtactccagcctgggcaacagagcgagactctgtctcaaaaaaaaaaatgccatgtattttacagttgaggaaacaggcacagataagtcacttgcctgcagccaaacagctagtaggtgtcagagttagggttcaaacctaggcagcctgactccatagcctgggcacctaactatgtttttattcttttcctcaccacagatttttaaataaggacttataagccttctctttatctttggtaatttttgaatttctgttggccttagctttagctgaaagagttgtgaggccaggtgtggtggctcatgtctgtaatcccaacaccttgggaggccaagacaggagtattgcttaaggccaggggttcaagaccagcctgggcaacatggcaagatcctgtttcttaaaaattttttttaaaagatcaaaaaaaaagggggggtgtgcttaccaatttgtagtgtgacccttaggaaacttggtctttgggtagagaatttacagttcttcaggacataggaaaagcagaaggaagttcaattttgttgttcttgggggcagaaaaggacagatgaccacttaatagagtatgttggcttttttcacctgcgtgcttagttaccacagccttagcagacacctccttggagaagtagaggtatgttctcaacactgtagttgattcctgtgacagcgaaggaacttgatcataatggatttgtctttttctgagttaatcctcagaagagaacaataaaaccaaaggactagagggaaacaaaagccaggtttatttaaagttttgggtccacacaatgcaaacattttcaataaaagctgtttctgcaatgttcttggcagttagcttcaggcttttgtttagtgcatttagatggtgagttgaagtaggaaccatgtgtagtttgttccctactctctacctagtacatagcacagggcctggcacatactagatgctcagaaaatatgtgaacaggtgaaggtgcatttctaataccaagattttaaagaagagatcaatatgttaattgggaaatctcagctgtttagtgatgttgtcattacaaaaaagtactttttctttttacttttttcatttctgccacaatcatcctagtgtaggccaccatgacaactcacctacatgcttcttctccttttttattttattttattttttttggagacaaggtctcactctgctgcacaggctggactgcagtggcacgatctcggctcactgcagctttcacctcctgggctcaagctatcctcccacctcagcctcccaaatagctgggactacaggcttccacccccatgcccggctaatttttgtattttttgtacagatggggtttcgccacgttgcccaggctggtctcaaactcctgggctcaggtagcagaaaggaataattcattgaatggttttggtcacatgccttatcctttcctgtagaggaggctggtcgtttagtgagcatttgcagagctctagaccccaagagggctctaccagccactggtggtgcctgaggctctgaagaggtgagagaaggccctgactttcaggcagtccgttttctcctggtgaatccatgtgctgactttgctgcttacttagccaaaagcatttcaagaaaccgttgctcctgaagaatgggggaagccatattaggttgtaacctcttagtattaaagaggcttcttctccaacagctggctttaaacattttcaaattgtaatgcactatgctcaatacacggattattttcttaagtaaagcctctccaccccgacctgctgccactctgcccctccaaaataaaagtatattcagaattgatcatccttcctcagctgcttagctcacttggtcatgttaagaaagcataagtagccaggcgcggtggctcacgcctgtaatcctaacactttgggagaccgaggtgggtggattgccagagctcaggagttcgagacgagcctgggtaacttggtgaaaccctgtgtctactaaaatacaaaaaattagctgggtgtggtggcgtatgcctataatcacagctacacaggagactgagacaggagaattgcttgaacctgggaggcagaggttgcagtgagctgacgtcatgccattgctctccagcctgggtgacaaagcgagacaccatctcaaaaaaaaaaggtgggggggaagcataagtaatcaagaattcacaattacctcattagaggggaattaaaagctatcgagaagcttacagtgtctgtgagattcagaaccttgtgagggtggacaggcaggaatatttttgcctggtgcagccctgaatctcttccttaaggttgacgatgctgcatttcctgttgcagaattcccagaagcagcctgtcaatgttggtagggccaaagcacataactttctgtgtttggattaatgcccgtatgggaataaaatccagacaagccttggcctccccgcttgccttaaaaaattggctgagtttaaaaactggaatcgtctccattgcttgctactaaggctagactagaaggttctgtttacctgtgtccatttcatagacgcacatgtgcctttgcagctttgcctcaaagggactgtttgtccacatttcacccattttctaacgctagcaaatgagactgttagtattttaaaggctggttcatcttgggccccttgaccttgaccaagagctttgcttttggtattggacactaggtggcggtttaagacctcctgatgggacccattagatgggatctaactatcatatattattattattattatttggtttattaaagagtagttggtttttcatctcataccagttcccctggtcttttatttttttctaacataagtgctgacattttctttcttttttttttttttttctttttgagatgaagtttcgctcttgttgcccaggctagagtacaatggcccgatctcagctcatcgcaacctctgcatcctgggtgcaagcgattctcctgcctcagcctcccgagtagctgggattataggcgtgggccaccaggcccggctaattttgtatttttagtagagacagggtttctccatgttggtcaggctggtctcaaactcctcaccttaggcgatccgcccgcctcggcctcccaaagcgctgggattacaggcgtgagccaccacgcccagcccaatgctgacatttccttaaagagttctttcataacaagcgtcagttattatttggttccaggctttgcagaaatgagtgtttactttcagctgcacaagtgatgactagagggaaaaaaaactgctattaagggaaatgttgactgttgctggttgaatatgaaaattgtaccagctttcagcttgttgcacttcagtaccttctgccagttcaggtaaaaactctgttgtagcccaggaaatactgtaaacatggaatattgacttacagagtgtgattagcctaccaatcagcttcagtagatgtgacttttggtggttgctctctctcctaagtataaattttaaaagctgatgagaatgaataaagccatgcatattgaatataaagcagattttcagggtatctgtcttaatttttttccttttccccattggtgtacataggctgatgcggatagtttttatatgacatgcaatggccgccagttcaactcaatagaagatgacgtttgccagctagtgtatgtggaaagagctgaagtgctcaaatctgaagatgtaagtgtgaattgttcctatatttaattaaaatatatcagattggtgtaaaattgaatgctaaggtatctgtgaaatacccagaataggccagtccatagacacagaaagtagactggtggttatcagggcaggaagagacgaatggggagtgcctgctaacaggatacaggctttcttctggaagtgatggacgtgttctagaattagatagtgatgacagttgcacaaccttgtgaatatactacaagccaatgaactgtatactttaaaatagagaattttattgaatatctcattttctaaaatttcaaaaaacgtaaaaaaaaagaaaaaagatactgcattgttgaaattgagtgtttatcaattctagatcaacgaagcctggagctgaaaataaatgtttttgttttcaatattaactcctaattcttgtttctgccttttatttttgagacagggtctcgctgtgtcacctaggctggagcacagtggtgtgaccttggctcactgcagcctctgtctctccagttcaagcatctgctagcctcagcctcctgggtagctgggactacaagtgtgtaccaccacgcctggctaattttttaaatttgttttagagacaagatcaccctggctgggcgcggtggttcatgcctataatcccagctctttgggaggctgaggtgacggatcgcttgagcacaggagttgggaggccgaggtgatggattgcttgagtgtaggaattcgagaccaggctgggcaacatgacgaaaccctgtctctacaaaaaatacaaaaattagccaggtgtgatgctgagcacctttggtcccagctactcaggaccctgaagcaggaagatcacctgagtcgggggaggtccaggctatagtgagccgtgatcttgccattgcactctagcctgggcaacagtgagaccctgtctcaaaaaaaaaaaaaaaaaaaaaaagtctctctgttacccagactgttcttgaactcctcagctcaagcatttttcccaccatggccttccaaagtgctgggattacaagtgtgagcgactgtgcctggcctcttgattccgttttgttttgttttggagacagagtgtcactctgttgcccaggctggagtgcagtggcactctcttggctcactgcaacctccacctcccaggttcaagcgattcttgtgcctcaccctcctgagtagctgggattacaggcatacgccactatgccaggctaatttttttatttttagtggagatggggtttcaccacactggccaggctagtctcgaactcctggcctcaagtgatctgcccaccttggcctcccaaagtgctgggattataagcatgagccactgtgcatggcgttgattctgttttgatagcaatttgtgatggctctgatctttcactcccatgggaacctttcctatattatgtggtcactggaatcattttgtaaagtagcaatacagctctttattttaagatatattttaagattaagatttctttttcctttcttttttttttggagacatgagtctcactctgtcacccaggctggagtatagtggcgtgatcttggctcactataacctccacctcccaggttcaggcaattctcgtgcctcagaatcccaagtggctaggactataggcatgcgccatcactcccggctactttttgtatttttagtagagatggggttttgccatgttggccaggctggtctcaaacttctgatctcaggtgatcggcccactttggcctcccaaagtgttaggattacaggcatgagccaccgcgcccggccagatttcttttattttaaattagacctgggcgggatcctctagagtcaagccgcggggtcatgcctcttaaaggcnnnnnnnnnnnnnnnnnnnnnnnnnnnnnnnnnnnnnnnnnnnnnnnnnnnnnnnnnnnnnnnnnnnnnnnnnacatgaggaaactcatctctactaaatatacaaaaattagcctggtgtcgtggcagatgcctgtagtctcagctactccggagctgaggcagaattgcttaaaccccggaggccgaggttgcagtgagctgagattgcgccactgcactctagcctgggcaacagaacaagactcccatctaaaaaacaaaattaaaaaattaagtagacctgaaggtctttttactttgagatccgcttgatggaagttagttctgagtagattgttttagcatttgattaggtgaaatcaaaatttgataagtgggtggcgggggaaaatgttggatgggagagaagaaggctgaaaagtctcagcgagctggagctgccagaggacctgaagaagaggcagaaaaacttgtgaaaactaaaactgtttcttccagtaatggaggggaaagttccagtcgcagcattgagaaacggtcagatgaagaagaagctgcagacctcccaacaaagcctacagtgatctccaagtttggatttgccttagttggatgacaaagaaagcatcaacaatatccatcaaacttggatcaaataagccaaaagaaactgttccaactcttgctccaagcactttttcaggagcagcagcttttaatgaagatgaagatagtgaaccagaggaaatctccagaagcaaagatgaagatgaagaatattggaagggatacaccaacatcagctggaccaaactccttcaataaaagaaagcatgggttttttgataaccagaagctatgggagcgaaatataaaatcttatgttggaaatgtcaatgaccaagacaattaaacgatgttttgaaattggggtgtggggtgggtgtaaacttaaaaggaacagtttccttttttaaagaatggtataagactatttttggagccactttttttttctctttcattttttgtttaaatattgagctgtacactaataagttagggttcaaaattagaggtaatttatgttttatatacagatttcaagacatttgctaattttgtagtttcatgtgattagtttccaaaggttacagataataaatcagaaatggtacctttttaagaattgcatatatttttagagacaactattaacacattaagagggaagcaaagccgggcatggtggctcacacctgtaatcccagcacttcgggaggcgaaggcaggcggatcacctgaggtcaggagttcaagaccaacctgaccaacatgaagaaaccccgtctctactaaaaatacaaaattagccaggcatggtggcgtatgcctgtaatcctagctactcaggaggctgaggtagaatcacttgaacccaggaggcagaggttgcggtgagccaagatcacaccattgcactccagcctgggcaacaagagcgaaactccgtctcaaaaaaaaaaaaaagagagagaagcaaatagttattgtctgtttaaaactgtaagcagttactctcttaactcccttattacctaaacttgtctggctcccaggaacagccttctagagacagggagtattgggaggaaaacgttacttaactattgactgaacgtaaatttagataaaattaaaatgcagcttttttccttataggcatttgttttgtttcaagtcatcataaagtaggtattgcattgctatcagtggatacagatgcttagctcttaaaagaattttttttggccagacgcagtggctcacgcctgtaatcccagcactttgggaggttgagggtggatcacgaggtcaggagatcgagaccatcttggttaacatggtgaaaacccatctctactaaaaatacaaaaaattagctaggcgttgtggtgggcacctgtagtcccagctactcgggaggctgaggcaggagaatggcgtgaacccgggaggcggagcttgcagtgagccgagattgtgccactgcactccagcctgggcgacagagcgagactctgtctcaaaaaaaacaaattaaaaaaaaaaaaaaagaattctttttaatgtaaactgttgaatatttgaaatagcccacttcaccttaatgggtcttgtgtatcttcatttgtcttcaaagaaaaaccatttgctaccaaagtaaatcagtatttcgaatgtgcttctcttgttttttgtttattagctagttgctgtaagcatttccaccagaacttgagccaaatcataaggaagctgtttcttttaaaatacaaaccaccaccaaaaaattaaatgtacatattaagcatttgactatttttatttttttaaaaagtataaacaccaaaaaaaaaaaatttaacattgtatgaagatggaaaacaagaagatacactttctgtaactttgtctgaggatttaaattactaacttgtgaatccaatttaaattgaacttaactactggcttcccccacaccccgccccgacccagacggagtcttgctctgtcgcccaggctggagtgcattggagcagtctcggctcactgcagcctatgcctcccaggttcaagtgattctcctgcctcagcctcctgagtagctgggattacaggtatgcaccaccatgcccagctaatttttgtgttcttagtagagatggggtttcaccacgttggccaggctggtctcaaactcttgacctcgtgatccgcctgccttggcctcccaaagtgctgggattacgggtgtgagccaccgtgccagccccagctttcttactagtaaaattacatggttgattttaaatgtatacatgttgaccaatggcctctcaaaaagcacattttagatactggagtagaaggaaagaaaatgcatcttcaaacatttttttggaatctcaccacatatactttgtgagatttgtatattgtagggtgttagtttttgtatttttgtattgtgtatgagcttttttttttttttttttttttttttttttttttttttttttgagacggagtttcactctgtctcccaggctggagtgcagtggtgtgatctcagctcactgcatcctctacctcctgggttcaagaaattctctgcctcatcctcccaagtaactgggattacaggcacccacgaccacacccggctaattttttgtgtttttagtggagacagggtttcaccctcttggccaggctgatcttgaactcctgaccttgtgatccacccgcctcggcctcccaaagtgctggacttaacaggcgtgagccaccccgcccggcatcttttttaatgtgacagttaaacacatctttaaaagcatagtcacagacaaaagaagcatacagtataaacatttccttgaaaactcctacaatattatatttggaggcagcttcagactgttttattggtggtaactgctcgctgagctcttttagttggtaataactccagagaagcatcctgtgtatattcctaacacttgttcactagcatttaagtttagaatgagccccaagtaaaacaatggaaatgtatatagaactcttagttcttacatgatttaattatatcaaaatacatgaatttaacttactttaatgtaggcaaactatcaatttttgtccattttcctgtttgttaacatacctctcctagatattcttttcttgacccaaatgaaatattaacctaaggtcaagctgggagagagaaacaactgagatgaatgtctttactaaaataccgataaatttgtcaaactcaaaaaaaaattgacgtgataaaattgggcatcctttgtgctggctgctgcacgaggcctcagttttagagattcctttcttaaatgaacgtggcttcttgagagatttcctgtaagtatctactcttcagggactgtaggttaatgtgctttttctctgtccataagtgtgtgctccctgacctttgcctaagtaattctttctcgtcttctggctggaagcgtcaagtcaagcactgtcttaggaatgcctttcctgaccatctagactgtcatgccccctaattcacaccctgttgtggcttcctgtactgtttgctttttaatttgatttttgtctctccctccactagattctaaactctgtgggggcaggagctgactgttttttggacttaacgtatctgtttttgctcaccactgttccacacctagaacagtgtctgtctgctgcacatagcaggggctcaatctctatctgtacaatgagggaataaagaaaaatcagtgttgttggtgctgtcatcactgagtagaaagtgttaagttataacttactctatggaaaaatccttcaggtccagctattcttttgttcctttgtgttctattatagtcgtagacacttagagcttgagctaggagtctggtcacatttgagatttatatgttaaggttttgacagcagtctcccttcctggaatgtcagttctgtaagggcagagatctttgttttgttcaccgctgtactcccagtacctggcacagtgctggaacacaggaggtactccatccctgtttcttgaatgaatgaataaatgaatgaaaatattaccaatttaaattacttgcttagagtaatgatattgaggatatcctgccaggagtcaaaaaagcaactagaaaactattattaaaagaagaaaggcctggcacagtggctcatgcctgtagtcccagctactggggagcctgaggtgggcagatctcttgagcctgggaggtcaaggctgtaatgagccatgattgcgccactgggctccagcgtgggtgacagagagcgagaccctgtctcagaaaaaagaaggaaaaataaagtattgctggtagatgaagagtgaggcttatgtgaggtgtttcctgtagggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgagtgcaggggccgaacccctctgtgtacaagcccattgcaacccttccagaattaaaaagagccaccagcagaaatgaaccattccaagtatttgactttattcaagaggtcctttttctccttccctttcctaagttcagggaatcggcattctgagaccaagtccttttttagtatgctgattctgaacccttgtggaattccccaaagcagcatgagttgttctttccttccaagagccagagagtgaaaaaaaaaagcaaagcttagtttgaggctctcgtgctgcagtgaaatctaggtctggaatctcatgtatcagctgcacttggtgtctgccattcactctgggcttcttatcaactgggctacagcagcctaatattttagctttgctgggctgttgatggcttggtggccagtagaaatagcagttactaagtatgagatctactctacagcctcctgattcccaacataccaggtcttagtcataggtgatgttgctacagacaaagaacaggtaaggcctgtaccttttttttaccccctaaatccaggatggttgctccctttgcagactgcactgtgggacttaaccagaaaggtgtatcagatgctggccttctggatttcccagtacagaggggaacccagaaatgaaatcacacaagtaaataaatcacagccataaccagtgttacagaagagcagtgtgcagcattgggactgagaactggggccctaatgaagccaggaccacctgagaagtggcatctccaggagggtaattaggagttaagccgggtaaagagcagaacccagagaaggcagtgggggaaggggaagatcatgttcccaagcacagaagtgaggaggggtgaaagtctacaggaatctctgtccacccacaagtggcctggtggccggaagaagaatatcagcttcacagagcgggggccatgcctggcttgctcactgctgtgtctctcacacctggtgggggacgtggcacacagtggtagacactgaggagcacataaataaactgggtctctgcagcttatcactgccctgcttatttagctggacaggagtcttgctccaattccgtggagtcctcagtcaattcttaggtatcatttgggagttttccaaggaattgtccagttgccttgaacaaagccatactgagatatgtgcattccttaaagtgtttacctgtatcttcagtccatctgctataccagttaagttctaggcaattctttgttccccgccactccagttttactttttttttgagacagggtcttgctctgtcacccgtgttggagtgcagtggtatgatcacagctcactgcctcctcaaactcctgggctcaagtgatcctctcgcctcagcttcccaagtagctgggactacaggtgtgcaccatctcacccagctaattgttttttttgtttgttttgtagagatggggtctcgctatgttgtctaggctggtcttgaactcctgagctgaagcagtgttcctgccttggcctcgcaaagtgctgggattgtaggcatgagccacgatacccatccccagtattccttttgatataaattaactgttacagaaccatagcattttaaagttggaagtttcctcagggaccattttttccaacaacctcattttatacaggaggaggacacaggcccaaagataagaatttgcaagctcaaagtgtcatggccagagaatgccagaactgggactagaattcaacctgtcatatgggatgtaagacatgccatttgccctcagaatcatgcagttcatttaatgagttttgagccttggtacatgcatagaactgtgagagatgctgagacagaggaagcaaattcaggtcctctttggggtggtttggtctaagagagtttacacttggacataaacacatgtggttcagggtggagattggaagagagaatgatggcatccccaaccaggggtactcaggaagggctgcagtaggaggcagtgttggtctttttgatagagatgtcagagaaggctttgggaagagctcccaaagatctcatcaggaaaataggataaaataattttttgcagagaaaggcaggaagaatttaataaactgttaattattattattattattttttgagatggagtctcactctgtcacccaggctggagtgcagtagcgtgatctcggctcactgcaacttccacctcccgggttcaagcagtcctcgtgcctcagcctcccgagtagctgggactacaggcatgtaccaccacacctggctagttttatatttttagtagagatggggttttgccatgttggcccagctggtctcgaactgctgacctcaggtgatccactcacctcagcctcccagagtgctgggattatgggcgtcagccactgtgcctggccgataaactgttgattattttttagtagacagatgaggtagtatatcatagaatgctaattgtttgtttacaagtttattcttgtaatttttttttcttttcaagatcaaatttacatttcagaaagatcgttttgatcatttgggcatagtgtagagaattagatttcagaaccagttctgaaatctaattctgttgtttttagttttttgtttttttttttttttagaagggcttttgccacattggccagggtagacttggcttcaagccatcctcctgcctcggcctctcaaagtgctgggattacagatgtgagctactgcacctggcctgttttcttattcaaccactttcacagccaccacacagaccgaagggatgagacaaagccaatttctactttctgcattctgctttctggctaccatttctgttctttctttgagtttgtcttctgtcttctcttttgatgctaaaggaagaagtggactagatcctttcctttctcttacacagatagagctgtgtcatctgtgacacagtgttcttcctgtttattccattttcttggttttatttacttagttgggtaactgttactagttatagcttttttttttagacggagtttcgctcttgttgcccaggctggagtgcaatggcgcaatctcagctcaccacaacctctgcctcctgggttcaagcgattctcctgcctcagcctcccaagtagctaggattacaggcatgtgctaccatgccctgctaattttgtatttttagtagagacagggtttctccatattggtcaagctggtcttaaactcccgaccttaggtaatccgcccgcctaggtctcccaaagtgctgggattacaggtgtgagccaccgcgcctagccactagttatatcttgagcattgtttcttcctggtgccagttcagtcagcctcagctataacccactttctgtcctagttgcccatctaacaaaaatactcatgactagtatttagtattattttgtgtggagtataatagaaaacagttaatggattttttcaacattgtttttattggctttttgtaaattgagacatgaatgcctgatagagcactggtatcttccacatgatgttcacggtgcagtgagatatcatgtgcatttcaataagtacattaacacctttgtgtttagccaggtgcggtggctcatgcctgttatcccagtactttgggaggccagcatggccaatatggtgaaaccctatgcccactaaaaatacaaaaattagctgggcatgggggtgcatgcctacaatcccagctacttgggaggctgaggcaggagaatcatttgaacctgggtggcagaggctgcagtgagctgagatcgcgccactgcactctagcctgagtgacagagcaggactctgtctcacaaaaaaaaaaaaaaaccttttttttttactacagattttaaatccaattcttaggagcaacctggagaagaaagggtactttttgaatgatttaaatctttgggaaatggggataaggcaggttgtttgttggagtaaaaatacattataggctgagcacggtggctgacgcctgtaatcccagtactttgggaggtcaaggcaggcagatcacctgaggttgggagtttgagacaagcctgaccaacagggagaaaccccgtctctactaaaaatacaaaattagccgggcgtggtggcgcatgcctgtagtcccagctactcaggaggctgaggcaggagaattgcttgaacctaggaggctgaggttgcagtgagctgatactatgccgttgcactccagcctgggcaacaaaagctaaactctgtctcaaaaaaaaaaaaaaaaacaagctgggagctgtggctcacacctgtaatccaagcactttgggaggccaaggccagtggatcatgaagtcaagagatcgagaccatcctggccaacatggtgaagccccgtctctaccaaaaatacaataattagctgggtgtggtggtgcatgcctgtagtcccagctactcgggaggctgaggcaggagaatcgcttgaacctgggaggcagaggttgcagtgaattgagatcgcaccactgcactccagcccaggcaacagagcaagactctgtctcaaaaaaaaaaaaaaattataaataatcagacatgaaatgaagtcctaattgtaacctgtaaatacttagctctttgatcatctaagctttagacataagagcggaaaaggacatgaggcagatcccaatttctctgttctctgttttatcaagattttgtatatttttattttgtatattttattttaagtgatatccttagttatgataaaaatagcatataagaggaggaggatataaaatccagtgtttgacttttgggttctgtaacagctgtcttttatatttaacctgcaccattatcttttggtgtcctggataggtgtcctgtttgccggtactgtcaaacgcccgagccagtagaagaaaataagtgttttgagtgtggtgttcaggaagtaagtaatgggtgatggaaaagaacaaagaatgcagctttaattgtcatgagttttcttctgcctggtatgacttaagttctttatttttaatttattttttattttttattttaagagacagggcttactgtgttgcccaggctggtctcgaactcctggcctcgagcggtccttccacttcagccacccatagtgctgggattgcaagtgtgagccactgcacccagcctaaattctttaaaattttttttctttttgtctagggttgggcaagacatatgaatacacaaattatgttactcctgagctaaatttattccttttttctttgcacttttgaaaggcttagacttttactgatgaattgtgaatttttttcttgctgttcacatagtgctccttagaaatcagcaaaaaaaaaatgacccataaaagcatccttgattgttgggttttaaacatacatttaatcactcaggctcctgtagaaacagttttttctttttctttttcttttttttttgagacagggtatcattctgttacccaggctggagtgcagtggcatgatcatagttcactgtaacctcaaatacctgggctcaagccttcctcccatctcatcttcccaagcagctgggaccacaggtgcatgccaccatggcctagtaggttttgttttgttttgtttttgttttttctaaaaaattttgtttttgttttttctacaaaaaaaacattttgtagagttggggtcttgctatgttgcccaagctggtcttaaactcctaggctcaagcgatactcctgcctcagcctcccaaaatgctgggattacaggtgtgagccactgtgcccaaccaacaattctgtcttctagtgtctcaggttccttcccactctgagtgagctggatcgattatttgtttgtttgtttgttttaagacagagtcttgttcttatcacccaggctggagtgcagtggcacgatttcgggtcactgcaacctccacctcctgggttcaagcgattctcttgcctcagcctcctgagtagctgggattacaggcagctgccaccacgcccagctaatatttgtatttttagtagagatggggtttcatcatgttggccaggctggtctcgaactcctgacctcaggtgatccatctgcctcggcctccgagccatcgcgcccagccagatcatttatttttatttaactaattaagatcttacctcttccggcagaatctttggatttgtttaatatgcggccacataggatgtggacggtatgtcagtcgacatgcttataagcactttgaggaaacgcagcacacgtatgccatgcagcttaccaaccatcgagtctgggactatgctggaggtgaataccactctcttttctaatttggactcattctgtgtggaaactttgccttcacaacgccttcactttccctcccagcttgaaatgtcatcttttgacagctgttgcaaacccaaattctcagtttccctgagggcactatttttctaggaatgtcttgaatcacacattataaagggagttaatacttccattcttgctttctccctcccctctaaaattcaaatgatttgacacttttaaagaaatattgtaaggcatttaaattagatctgaaaaaaaaattttgtcagagttaaaagtgtacagagacccttttcattctaaagaaacacacttttgttgactctttctgtagataactatgttcatcgactggttgcaagtaaaacagatggaaaaatagtacagtatgaatgtgagggggatacttgccaggaagagaaaatagatgccttacagttagaggtaagagatttaatgagttatcactctatctgtttctactgctctttactattctaatttgaaatatttgtcatttacctggatgtacattttttttttaaagtttggtcatggccgggcgcagtggcttatgcctgtaatcccaacactttgggaggctgaggcaggtggatcacctgagttcaggagttcaagaccagcctggctaacgtgaaaccctgtttctactaaaaatgcaaaaaattagctgggcatggtggcacacacctgtaatcccagctcctcgggaggctgaggcaggagaatcgcttgaacccgggaagcagagaatcgcttgaacctgggaagcagaggttgcagtgagccgagatcgggtcattgcactccagcttgggcaacaagagcgaaactctgtctcaaaaaaaaaaaaaatgtttggtcattgctgtgaggtgttattaaaatatttttattctgtttttcttctttgaaagtctaaatgtcagctgggtgcagtggctcacacccctgtaatcccagcactttgggaggctgaggcaggcgaatcacctgagatcaggagttcaagaccaacctggccaacatggtgaaaccctgtccctactaaaattagctgggcgtggtggttcatgtctgtaatcccagctacttgggaggctgaggcaccagaatttcttgaacctgggaggcaggggttgcagtgagctgagattgtgccactgcattctagcctgggtgacagagcaagaccctgtctcaaaaaaaaaaaaaaagtctaagtttcactgtgccttgttactttcattgtgatgtctgtagttgtctcaagttcagtgttaagatttgttttcccgtagctacaggctagagtacagtggtgcagtcttggctcactgcaacctctgcctcccgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggttgcagtgagtcgtgattgcaccactgcattccaacctgggcaacagaatgagacccagttttaaacaaaaaaaaaagaaagaaaaaagaaaaatctttgctgtcagccactggtgctagtgctgcaaacacagtattgaacaaactccctgctctcatggagcttagggttcagtagcataggtgttcttctccttgccctctctgtagtctgcagacatgtttatatctcttctagtcttctagaatggtttttccaaaatggagatgtgaccttgccactccttggccttgggttccccattgcccatatttgtcaatattataataccccaaagccttccactggtgccatatctcctaacctggcacattagtgttacaacagcctcattagtgttactcattcatttctgaagagattctaatgtccacagctctgtcttggtcaagtagttctctggactcggatctctgtctttatctgttcttcttctatctgtcagcaccctctcaaatctcgccttctctcacatcttactgtcatacgccatctgtcccttccctgtggttacacagcactgttcattcattcatgcagtcatgcagcaaacaattctcgacatccaccatgtgccaggcactggagatacagcagtagagatataacccttgctttcaaagagttcacagtccagtcagggagacaggcaggtaaactggtgatgaagtgctgctgtcctgagtgctgttactgataggcacagtgctatcagtcagggggtgcctgactcaagtgctggttgggacaggatgggacaggactgcttcatggggtcagggagacaggtaagtttatttgagttatacatagatttaaaaccactgtggttcttcttaaagtcagcttgaccagaataaaggtttttataagtacatttattctgactagattgtaagccccaggaagacagaagcataatgtcatttgtgtcccctggtccagtatatattgagtagagtagaaccagggcgtaaatatacattctgttggttagttttagttttctgtggatcattaaatatcagatttttaaattggatttcagaggctgacaacagtgacttacattttggtctttattctctatgtttctagtattcatatttactaacaagccagctggaatctcagcgaatctactgggaaaacaagatagttcggatagagaaggacacagcagaggaagtaagtctgtttggtttgggtgactgcggaaatgacacatggcagggcactctgatggggggtgtggaaggcagagtacagggaaagaggaatcttaccatcttcccttctcaggcaggtaataggtggagaactgttttgccactaaaaagaaactttggatttaaaggcttgactgttttgatattttggggtcttagggggttttgtttgctttttttttttttttttaaacctcagtctggttttctagtgccttgtgaagttccactaaaaacatagaagtatctacctgagggtttgtcatttgagttaggcacttgggaaccgctgcctttgggagctaaacatgaacttctaaggcaatgaaatggcgcagagcctttctaaatggaaggaaataaaattgggcagagatactggcacttcattattcaccctgaaggtctagggcagcagttttcaaattttaacaaaatagtcctttaaaaaagatgccattcactactttagcaaaattaaaaagtggtatgattttggtggaaactcagatggaaggcccagagctctgtctccagtatgtgcaaggaaccctgtgacttccaaagaaggtagtctgaaaactagtaagcatctgtgtataattgtgtataattatggctctaggaacctttctttggacctagggacagtgtttgtaattcagtgattcccttagtatgaaataaaatcttgtaaaatttctcaatgattactttagtaaccttgtgagtccccacctatccttgggccttcagataggcagtacagagctgggcttggggcccacctctgaggtggctaggaatatcctggagcttagcaggcagggccatgggccccagtttctggatatgccgtaagtgggcaaaatcaaggtctgtaaaaattaatgcttaacatcagctttaggccaggtgtagtggctcacacctgtaatcccagcactttgggaggccgaggcaggcagatcacttgaggtcaggagtttgaggccagcctggccaacatggcgaaacccaatctctactgaaaatgcagaaactggtcgggcgtggtggcaggcgcctgtaatcccagctactcaggaggctgaggcaggagaattgctggagcccaggaggcagaggttgcagtgaaccaagattgcaccactgcactccagcctgagcaacagaccgagactctgtctcaaaaaaaaaaaaaaaagtcagttttaaaatgatctgcagttaaaagttattgatgaacttcttacaagagccttctaatcaatgcatgtgcccttccagtggcactcaaggtcacttgactttgctagttctgaataggccttgattagagtatgtgcagggaggaccacctcccaatgctctcgttggagcagagcgcaggtcgctgccgcgtactgtgaagttggctcacgggaagtgcattggcagctccactgcagctgcactcatgggtttttccatgggatataccagtgtgactacctcaagtgcttcatccagacccttgaagctaagctcaggattctctctgccctctaggattgaaaagcaagtcaaggggcaggaaaacgaaacactgaaacttatgtttgcttttaggtcagggtaaaatggaagccagagcagctctaaataaaacgcttggggtgcttaaaaggatgcttttgttttctagtaacaaatgtcgtttatccataagttaatggatgatgcaagccttttgttctgccacggtcctccttttggccagtcccttgtccgttagcacccccagcagtagaacatgttcagggagaaacagtaacccggaccctgggtttcactgacagagattcttgtttgtgggccttctgttgatgtggaggaggggtgtggatcaaggttgaaattcattgtgggcttcagttataaacactgtttctttcccccagtgccttaggtagtgccgttattatagcatgtgagcacagcctattctagaagatgaagctcacagacattcaaaggttcttagttttcatggccatgtatgaggaacacatggtaggcagaggcagtcataaggtgacctcctctaaaagtatatcttttcttgtggatgtctagctccattttaatcagtatttttccagctgtggattgtaaaatgagtttggtggaccacaactagcatttttattagataaaatagtgtagatgtaaatattaggatgtagtacaattaatattgttttgtgaaactcatttcacttttgtgtgtgtcatgggtgtttcttactgtgggctaatgatcagaatttttcatttgttttttgagataagatctcactctgttgcccaggctagaatgtagtggcaccattacagctcactgcagcctcaggctcagcctctcatgctcaagcgatcctcccacctcagtctccctagtagctgggaccacaggagggtgccactgtgcctggctgatttaaaaaaaaaattttattcagatcggggggtcggccgggcacagtggatcacgcctgtaattcccaacactttgggagaccaaggcgggcggatcatgaggtcaagagattgagaccatcctggctaacacggtgaaatcccatctctactaaaaatacaaaaaattagccaggcttggtggcacgtgcctgtagtcccagctacttaggaggctgaggcaagagaatcacttgaacagggaggcggaagttgcagtgagctgagatcacgccactgcattccagcctgggcaacagagcgagacgccatctcaaaaaaaaagagagagagatgggggaatcttactatgttgcccaggctgatctccaactcctgggctcaagcaaaccttctgccacggccctcccagagggctgggattacaggcgtgagccatggcactggaccagaaatgttttaataagcactaatttaaatcgttgttaacatttgtctgtagcaatattaagaacctttctggccaggcgcagtggctaatgcctgtaaccccaacactttgggaggccgaggcaggcagatcacaaggtgaggagatctagaccatcctggctaacacagagaaaccccgtctgtactaaaaatacaaaaaattagctggacgtggtagcgggtgcccatagtcccagctactcaggtggctgaggcaggagaatggcatgaacccaggaggcggagtttgcagtgagccgagattgcaccactgcactccagcctgggcgacagagtgagactccatctcaaaaaacaaaccaaccaacctttttagggttacctttatattttcatcttgatttaaatgtgtttggcttaagtatctttactgtccaagacatgtacagtttggttccttaggatagtaatttctgtccttttcaacttccttaaactgacaggagtcagtttagaagaaaatttcaaaaggatctagtgctctgttattttaaaataatattgaagagaaaattaatacctaactagaatttgagcgattttaaatctattttgatttttatgacagagaagtacatttagaaatctctcttccagccaggcgtggtggcttatgcctgtaatcctagcactttgggaggccgaggcgggcagatcatgaggtcaggagttcaagaccagcttggccaatatggtgaaacctcgtatctactaaaaatacaaaaattagctgggcgtggtggcatgcacctgtagtcccagctgctcaggaggctgaggcaggagaattgcttgaacccgggagttggaggttgtagtgagccaagatagcgccattgcactccagcctgggtgacagaacaagactctgtctcaaaaaaaaaaaaaaaaaaaagaaaagaaatctttcttccatgttcttccagtggaggttggctataaagttaatttgaacaaaacatttatttttattgtattgtattgtattttttttgtaatggtgtcttgctctgtctcccaggctagagtgcagtggtgtgatcttggctcactgcaatctccacctccctggttcaagccgctccctgcctcagcctcctgagtagctgggattacaggcgcctgccactgtgcccgactaatgtttgtatttttagtagagacgggctttcgccatcttggccaggctggtcttgaactcctgacctcgtgatccacccgtctcggcctcccaaaatgccgggattacaggcgtgagcatcatgcccggcctattatcattattattattattattattattacccccccccatagtgctattagagacttgctaggcaggctgtatggaaaatgattaaaaagaaaggtctagctgatccctgggctgtatgacttaaattctcagccactttcagttcctgttatattgccttgtggttcacccagcctcctgactttgccttcccaccaaatcttttgctggtgtccttagaccagtggagttgaggaaattcccaagttcgcagatcttcacacaggagtggatccagtatctacctagccagactccaacatactctgggctgggatggctgccgtctgatatgttatacatcagaattttttaattctcttatgtttttaaggctgtgtaatatgaattagtctatgtatattgtttttataaatagactcaaaagaacatggactgcttatactccatgtggcttcatgatacatgaaaaaaatattgtgaattggaaaaaataaacaactagagtcaagtgtcacaagtttcttagattaccaatgtttgtctccacaaaaaatacaaaaattaggtcaggcgcagtggctcatgcctgtaatcccagcactttgggaggccgaggcaagcctcacttgaggtcaggagtttgagaccagcctggccaacgtggcatctctactaaaaaatagaaaaattaggccgggcacggtggctcacgcctgtaatcccaacattttgggaggccgaggcaggtggatcacctgaggtcaggtgttcgagaccagcctggccaacatgatgaaaccctgtctctactaaaaatacaaaaattagccgggcgtggtggcaggcacctgtagtcccagctacttgggaggctgaggcaggataattgcttgaacccaagagcgggaggttgcagtgagccaagatcatcccactgcactccagcctgggcgacagagcgagactctggctcaaaaaaagaaaaaaaaagatttcccggcatttttaatcctattacagaaattctttcaaatgattacctcaccttttctttatttttttcccctgcctggaaactgccatatctcaccttctctaattttggtttgtcaaagttatatacagataattggggggaaaaatatgatgttggtcccaaagagcacaccacattacctttgtgaaatgaatctgatttctctttgctctttcagattaacaacatgaagaccaagtttaaagaaacaattgagaagtgtgataatctagagcacaaactaaatgatctcctaaaagaaaagcagtctgtggaaagaaagtaggtataatcggtctattctgttgtaacaggctctataaacagacagtttctttcattcctatggaaacaccctcattttcaaatatatgtatcaccaggttttcaggagtctccctatatatggaacaggcttctcgtttattaaaaaatgcggggtttcataccagatggatgccatgtggaatgcagtgctctcttctgatgtctgtgcacttgcagtgtgtgcagatatcttccatttttgcctgtggaaagcaattttcttccatccagagccttcggcttctttgagccattgtggctgagaactggcagttaggaacgagactgtgtctaagctggagatgttctatgctgtggccttgggcaggagttaaaggcaagagatgttgaatatggagcaaaaaactcatgaacagcatggcgataacattccttatttactgttatttgggaagatagttgctactgattgaaattaccagccaggcatggtggcttacgcctgtaatcccagcactttgggaggctgaggcaggcaggttgcttgagcccaggaattcaagaccagcctggacaacatggtaaaaccccatctccactaaaaatacaaaaatgagctgggcatggtggcgcatacctgtagtccctgctattcaggaggctgaagtaggaggatcacatgagtctgggaggcagaagctgcagtgagccaacatctcaccactgcactgcagcctgggcaacagcgagaccctgtctcaacaaaaataaaattttgttaagctattgtaaaaacaacactacaaaattaatagacgtaaaacttaaaaattaccctatactttcagcaccctaacaaattgaacaactgtgttaaagaatacaaagtaaaaaccggacgggttttttttgttgttgttgttgtttttttggagacagggtctttccctgtcacccaggctggagtacagtggcacaaccttagctcactacatcttttttttcttgaaacggagtctcgctctgttgcccaggctggagtgctgtggcgcgatctcggctcactgcaagctccgcctcccgggttcacgccattctcctgcctcagcctcccaatagctgggactacaggtgcctgccaccatgcccagctaatttttttgtatttttagtagagatggggtttcaccgtgttagccagatggtctcgatctcctgacctcatgatccacccgctttggcctcccaaagtgcttggattacaggcgtgagccaccgtgcccagcccatctttatttttagacagagtcttgctctgtcgccaggctggagtgcagtggcgcaataggctggagtacagtggagcgatctcagttcactgcaacctccgcctcccggattcaagtgattctcctgcctcagcctcccgagtagctaagactacaggagcacaccaccacacccagttaatttttgtatttttagtagagacggggtttcaccatgttggccaggatggtctcgatctcttgacctcatgatccgcccgctttggcctcccaaagtgctgggattacaggcgtgagccactgtgttcggccagctcactacatcttccacctccctaggctcaggtgatcctcccacctcagcctcccaagtaactggactacagctgtgcaccaccacccctggctaatttttttttctttttttctttttttttttgagacggagtttcgctcttgttgcccaggctgcaatggtgtgatctcggctcactgcaacatctgcctccggggttcaagcaattctcctgcctcagcctcccaagtagctggaattacaggcatgcaccaccatgcgtggctaattttgtatttttagtagaaacagggtttctccatgttggtcagtctggtctcaaactcccgacctcaggtgatccgcctgctaaagtgctggttttacaggcgtgagccaccgtgcttggcctctggctaattttttgcagagactgttttaccattacaggcatgggccaccacaccctgcaaaaactggaagttctttttcaccctctagatcctgctatctagtgttaaccattattaaccagtaccagtgaatatttcttcttctagatgtttagctctgcccacataaatatctcacatgcataatcttttctctgcaaaaatagaatctaggtattctttttgataaaatatgtttttggattttttttcatactagcacatctaaatctatcctgatctttgtaacatctgcatgctgtttaattgtatggatgtactataatgatttctgttgtggtggttgttgttgaaataaggtcttgctgtgttgcctaggccagagtacagtggcgtaatcatagttcactgcaacctccagctactgggctcaagtggtcctcctagtctgagcttcctgagtagctaggactacaggtgtgtgctaccatgtctgcccaattgaaaatttttttgtagagacggggtcttgccatattgcccaggctggttttgaactcttagcctcaagtgatcctcctccttgatcctgtcttggcctccaaaaatgctaggattataggcatgagccctgcacctggcctgcataatgattttgaccaggttcctattgattgtgtcaagttgtgtcaaatctcacactactataagcaatactgtaatgagcatcttcctccatgtctctttttacctaatcctgagtatatctattctatggtataaattcctagaagtaaaatagctgtgtcaaagggcatgcaaattttttgtttttatttatttatttttgagacggaatcttgctctgtcacacaggctggagtgcagtggcacgatctcgactcactgcagcctccgcctctagggttcaagcagttctcctgcctcaccctcccgagtagctgggattacaggcacacgctaccacacccggctaatttttgtatttttagtagaaacggagcttcaccatgttggccaggctgatgttgaactcctgatctcgtgatccaccctcctcggcctcccaaagtgctgggataacaggcgtgagccaccgtgcctggcccaaattttttgtttttatagatattgccaagttgtcttcgaaagagtttataccagttcatgctccagtgctagtgtgtaagtgcctcttttctcatgtctcagctcttgggtgttctgatgcataaaaatagtatctcaaatagtggggtttttttgttcgtggtttttgtgtgtgagtgtttttggtttttgttgttgtttttttgagacagggtcttactctgtcagacaggctggagtgcagtgatgcaatcacagcccactgcaggctcaaattcctgggctcaagcagtcctctgcctcagcctcccaagtagctgggtctacaagtgcacatcaccacacccagctagttttttaatttttcttttgtatagacggtgtctcgctatgttgaccgggctgatttcaaagtgaccctctcacttttgcctcccatagtgctgggattacagacatgagccactctgctgggtctcagatggtatgggttgtttgtttgagacaagatctcgttctgtcactcaggctggagtgcagtagcatgaacacagctcactgcagccttgacctgctgggatcaagcaatcctccagcttcagcctcctgtaaatctgggaccacaggtgcacgccactgcacctggctaagttttttgattttgtgtagagacagggtcttactttgttgcccaggctggtctcgaactcatttcctgtttcatttactgaagcgatcctctcgcctcagcctcccagagtgctgggattccaagcatgagccaatgcacctggcctcaaatggtggtttcatttgcaattctttacttatgagtaagactggacatcaagaatagggcactcccaagtctaaagccctttggttagaataagtgccctttttttccccttcagcaaatgcaatgaagtcagagtacttgactctccaagaatgccacttttcctcataacttccttatcacagctatcatctcgaaggcacctatttaaccactgactgcaaaacaaagaagcagtagaatttttaccgtcagtcacagaatagtttctgctactgaaaactttctgatgcttaaaaaaaagtgtcttaaaagtacatttgtgggctggacgcggtggctcacacctgtaatcccagcactttgggaggccaaggtgggtggatcacaaggtcaggagttccagaccagcctggccaagatggtgaaaccccgtcgctactaaaaatgcaaaaattagctgggcacagtggcaggcacctgtaatcccagctacttaggaggctgaggcaggagaatcgcttgaacccaagcggcagaggttgcagtgagccaagatcacgccactgcattccagcctgggcaacagagtgagactccatctcaaaaaataaataaataaataatacacttgtggactggcgcagtgcctcatgcctgtaatcccagtactttggaaggccgagacaggtggatcacctgaggttgggagttcaagaccagcctggccaacatgccgaaccccaatatctactcaaaatacaaaaattagccaggcatagtggcaggtgcctgtaatcccagctacttgggaggctgaggcaggagaatcgcttgaacccaggaggtggaggttgcagtgagctgagatcgtgccattgcattccagcctgggcaacaagagcgaaactccgtctcaaaaaaaaatacacttgtgttaagtagagcaaaattcttgctttgcatagctgattgcgatggcagaaaaccattctccctcacgatgggagaaaggggtctgtcctaaagggattctgaggtcatggtttctctgttcaatcccagagcagaaaggggactgtgtcagcaaatgaaaaatgtgcttttgtcttcctttgtttttcaaaaggtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgtaaagggtgctgactggagagctgatagaaaggcgctgcgttcgaaaaggtcttaagagttcactaacctcacattctaatgaccattttgccttcctgcttggtagaagccccaactctgctgtgcatttttccattgtatttatggagttggcgtatttgacattcagttctggggtaggtttaagatgttaagttatttcttgtaacctcaaaggtaaggttatctagcactaaagcaccaaacctctctgagggcataacagctgctttaaagagaggtttccattggctattaaggagttatgaaaactccctagcaatagtgtcatatcattatcatctcccccttcctctggggagtggaagaattgcttgaatgttatctgaaaagaggcctggtagtaaaccaggccctggctctttaccagcagtcatctcttcttgctctggggccagccaggaaaaacaaacaacccggggcacattgggtagactcagtgtaggaaaaatggtggcagctccactgtttatttttggtgacttcgtacgtcattatgaaccgcaattaaggaggaggcttaatggctgttcccaaactcaaatctcagagtgggtatcctagcatctagcaagactgagtggggagatttctcatccgtgtgaaaatgtagagtgaggcctctgactagctaattgtgtattttgttgggtttagtattttctaaatgtttacaaaatattgggctgcatgttcaggttgcagctagagggagcttgggcagattttcaattacgctttcaagatataaccaaaagctgtttctaaatcctaaaattagaatttcaacagagccccctttagaacagtcatataacgcttgtgtgggccaacagaggggctgtgtactctctctggaaccataaatgtcaaataatttataacctgcagtaattgagcaaacttaaaataagacctgtgttggaatttagtttcttgaagaggtagagggataggttagtaagatgtattgttaaacaacaggttttagtttttgctttataattagccacaggttttcaaatgatcacatttcagaataggtttttagcctgtaattaggcctcatcccctttgacctaaatgtcttacatgttacttgttagcacatcaactgtatcactaatcaccatctgtttttgtgggatgtgctgcagcatttcccaaaaaactttacgtgtaatgttgcaaaatgaatgtactcagacattcttaatttttacttagggcagaccaactctttgagtctctcttggacttatatatacagatatcttaagagtgggaatgtaaagcataacctaattctctttcctatagagattctattttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaaatatgtcccagaaaaaaaaaaaatcttaccaagatacgtaaagaaaaaaaaatttttttttaaacagtcaaagagtcatgtttgaatttcacaaaatcacatcagacagaagttgttttcttcaggagggaaatgaaccacttaatatacccatactaccttgaacaatgaaattgaattaaaatagccaaactttgaaattattctgccccgtgtgaaatgtgtgtctctgactgacatttgcttgggagcatgtctctaata

SEQ ID NO: 16540 - DNA, 7447 bp, Human
cttctttgaactctaaggtgacagcagaggtaggctgaaggttagggataccaatattcctgtctcactagtgatgggctcttcccttgagcccttccccaggcttccagacccctagtaggcccttaccttgaagaagaatgatagccaggatgaggacagccaggcccttcccctgttccatgtcagtctctgtcctccggcaaaagcgtggagcagcccttagcagccagccagccagccagcctgtgcagcagctagactggctccacccatcactgttggggctggggcctttgagagaaggcaagaacccagagcctccaccctctgctgcaagtgtgagcagcaggggcctcagcagggctgcaggtgcagatgccttttgtttttccgttaaggagggtgaaggtggtggggaagaagagggagagagtgctggattcccactcagagactcatcttgcacagggaaccgcaatggatgctgggtgggagatggtcctgggaccgtttcttcatgagggagataaatgtccctgtcattagttgttaggatcgtagccagttgttacttgttgctagttgttgttgctgtaggtaatgaatttaggagggactctcagatgcttggggctggacctccaaatggaaagccacctcagtccaggccttcattcaggaatttttttcactttttttttctttttcttttttgagacagagtctcactttgttgcccaggctggagtgcagtggcgctatctcagctcactgcaacctccacctccggggttcaagcgattctcctgcctcagcctcctgagtagctgagattacaggtgcgtgccagcaagcccggctaatttttgtatttttagtagagacggggtttcaccttgttggtcaggctggtctcgaactcctgaccttgtgatccacctgcctcagcctcccaaagtgttgggattacaggcgtgagacacggcacctggtttcactattcttttgagatcatgaaagaggcgcctggaaggcaataggtggaacaattccgaggacaggccagcacattttcaggggccagagcccggactgaatgtccaggatctcaggcccctatctccctcagccagtcagtcagtgagccaacaaaaatgtgcagagctcccgttatgtgccaggcacaagatacagcagtgagcaagacaggcatgactctgtccccaggtaagtgacagtctaactgcagcagcgtgaagagtttcagatcctcgtaggccacaggggaaaaaggtccatttgtctcaccgggaggctcaatattgcctgtcagtcaattatattattattaataactaccccttaatgagcacatatgatgcgtgaggcaccatgcaaatatcttgtttgaatcctaataatggtactaatggaataagactctgaaaaattttatggctggcccaggccccacaggtaggcagtattggacccaggattcaaatctctggctggggtctctaaagcccaacctcccactgacaagaagctgctagatctggtgtccctggctgcctagtgaagggtcctgagaaagatcagcctccatgagaaatctagctgctacggcttgcgctatggggccgacggcttctctcaaggggcttcgagatgtggcagtgtttaggttgtgtgtaaatgtggttgcattgtcaatagggacgctaaagttcaggccaccttttccatattctctgccagctccctgctcagagatagagcaatttacaccgcttccttcctaccctacccctagcccacccccactctgaaaatttcccaccatcaacggcagaaagcagagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaaggtaaggctactccaggtgggtgggggaagggacctgagagggacattactgatgggagtgaggcccacttgaaagtgtttcttgccaggcacggtggctcacaccagtaatcccagagctttgggaggccgaagtgggaggatcctttgaggccaggagtttgagaccagtctgagcaacatgatgagactctatctttacaaaaaacaaaagaattagccaggcatggtggtgcacaactgtagtcccagctatttgagaggctgaggcaggagggtcacttgagcccgggatttcaaggcttcagtgagctgtgatcatgccactgccctccaacctaggcaacctgtgagaccttatctcaaaaaaaaaaaaaagtgcttctcggtgctagcttcagttcaccaggcaccccaggggtgtcaggagggcaggggcaggatgtagcatagagtctgggaaacaggctcttggctttgactgactccagccatgggtgcatgtgggcctagaatgtctctcagaaggccttaggccagagatctgcagaaaatagctcagtacgtatgtacctgaatctgggactggccatgggagcacagcttcctgcactactccttttaggcctgatggcctctggaatcaggactcttgtttgtttggccatgattatgtcatccctggaggcatgtcctagcacttatgtgaatgctttaagagaagttaactttaggttgagcaggacggagggaagatttgaggggttgttacatggtaggattttaactcatctcagtttgccaatttcagttttaaaatggaaagtcccatgtccgaggaaccccttcaacactaagcaaactgggtccaatggtcacctaatagttggctgcactagggcactcaggatttccactggagacagatccctgaagaggacgcgactgtaggacgtgaagcatttgatgtgcatgtgtctccctgaggatacatgcatatacttccaacctgcttcagaagtgtgagcaacagctgtttcagggttttctagaagatgctcttgtatccaaatttgggacttagtgtgaagcccaggatgaatgaatgtagcctccacttttccctgtgtttggaggcatagactgtagtgcctctgtggcctgtggagatgtgctcaggctgtcagaggaactcactgcatctggaatgttgctgcactcacctccagccctaaaagtctcccacaagacttgacttgtgaggagctctagggatggattcaataaaatttttttcctgttctcctccttctaaccaagggtggaaaactgtacatgggatttgccctggtcccgttctggaccacttggctgataattcaggggctggtaaaccagctggtctccacccacagccatccctggccctgggaaaggcttcagtgttgagagccccgctttcttggttgtcaatggagcaggggcaatgaggaaggatgaggataagaagctgaagtgggagtgttgtagatggctgggaagtggaattagatgtttccttgaagaaaaaatgcagacatttccaatcgaggaatgttcttctgtctttccacatcttccaggtgcttcagtggtccgtgctccccctactcctcatcagtggtctggattcatttccaggaaggtgcttgggtcaatcctgctctgaggggtcctcttttgcaccaaggccccaagacctgtcctctgcttgaatggcatcctcatgtcccccttgacccctgcagttggtggggaactttctgaaggctttttcttgtgacttctgtctctcttgatggaagccataaactgtcctggaccaggaaaatggtctctgttaagtatgagcttccgcagaacaaagggcttggtgcagatcaaagagctgtctccaactgtgatattttttcccctttagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaagtacgtgcttcctgaaccctttgggttggaatggatagggcttctggatgtgagaactttctggctagagagggatatggtgaacccatctgttctctaaacaaagtgaggtcactattgtaatggtacaagccagatttggggaccttcaaagtggaagagagagcttaactcagcaagacagagcagtaggggtcatgttactgcagccttggttgggtgagaggtttggcccaccaccttgttcaaggtcccaaaagctgagattacttcttggctcttcccagggattccttaggatgcagggtggaggaaggtgtggcaagcccatcaccaggcctttctcccagggtcttattgaagtttgggttttggcataagagatctaagggttgccctaggaggcagaggatggttccctgatcttaaaggctctcaacctctcctctctcctcccttcccccacagtgtgccagagctgtgtggagctggatccagccaccgtggctggcatcattgtcactgatgtcattgccactctgctccttgctttgggagtcttctgctttgctggacatgagactggaaggctgtctgggggttagtggaagagcagagcatgagagtgtgtttgtgtgtgtgtgtgtgtgtgtgtgtgtgtgtgtaccagtgagcttatgcaccagctaaggaatggggctggtggtaggtttagtctcagctgggagttactcttgcaatctcctaaagactcctagaactttgactgttgaaagaacttgtgtgttcatatcactcatgcagacttctgagggtgtgggagggtggatctcacagtcccatctgctaggccattgatgtctctctctggttcttctagctgccgacacacaagctctgttgaggaatgaccaggtctatcaggtgagcgttgaggggaaggaggcaggaatgaagggagggtaagtggggatagagaggctgacactgaatgctgtttgcacgtgggaagggtcctactggggagttcattgctgggtgtgactggagaggtcaggcaggagctctcatcgtcagggcctgctggggcccttccttgaagagttctaaccctgcctcctgaccgttttctcttctcctctcttagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagcaggtgcctgggcttcttaaggctcctgggcaaggcgtgggagttgtcctgacttgcttgggatctcgccctcctacctacctgtttcttccttcatctccttccttcctctgcctcacacagacagtgtgttgggcagtctctcgccacatcctggctgtctggtgtttctagcccacagggctccctgggtgaagggtctgcgccaccacgttcccacagctacttgttgactccagtccctatcacaacccttttagggttttggctgcctcatccagccgagggcaggctgctgtgttcaggagcccagccgcacagaagtttccatgatgtcatgaatgggagtggcagagacaacaaggggccctgggactagtttctcaccaagactcagagggtgtgtgtaacaaagtcccactgctgctaaggggatggcctcaactctacggccctgctgaccaggtgccactagctgtaaggaggtctcacctaagcccctttcgtatccctttcccctgtatcaaaggcaccattttagcttcctttcgccaggacctgtctctggcttgctcctgccttctgcatgataaatggggatcagaaacccttcaccaattaaagcacattatcccgctccatctacctggaaagcaggagtttgagacagggattttttttttttttgagatggagtcttgctctgttgctcaggctggagtgctgtggcatgatcttggcttactgcaacctctgtctcctggagtcaagtgattctcctgcctcagcctcctgagtagctgggattgcaagcatgtgtcaccaagttcagctaatttttgtatttttagtagagacagggtttcatcatgttggccaggctggtctcgaactcttgacctcaaatgatccactcactcagcctccaaaagtgctgggattagaggcatgagccactgcacctggctgagacagggatattttcaatagatgtcatcttctattacttctaatggtagtggttctaggctgggcacaatggctcatgcatgtaatcccagcactttaggaggcagaggcaagaggatcacttgagcctaggagttcaaaaccagcctgggcaacatagcaacatcccgtctcgaccaaaaaaaaaaaaaaaatcagctcagtgcagtggtgggcacctgtagtcctagctatttgggaggctgaggtgggaggattgcatgaggctgggaattggaggctgcagtgagttatgattgtgccactgcactccagcctgggctacagagtgagaccctatcttaaaaaaaaaatagctatggttctgaaactttggaggcctgagggatttattaaaaatataaatgcagccaggcatggtggctcacacctgtaatcccagcactttgggaggtttaggcgggcagatcacaagatcaggagattgagatcatcctggccaacatggtgaaaccccgtttctactaaaaatacaaaaattagctgggcatggtggcgcacgcctgtaatcccagctactcgggaggctgaggcaggagaattgcttgaacccgggaggcggaggttgcagtgagtcaagattgcgccaccgcactccagcctggtgacagagcgagacttggtctcaaaataaaataaaataaaataaaataaaagtgctagagacgcactctaggcagggtgtttccagttgattctgaaacagcccaaattcagagtctcttgtttagagggagaatagaggccactttctctcttatgtcttttatgcctgttcctggatcccagagcaggggattccttcttttgttctctgattacacaaataatttaaagagcctctggaaagtttaatgactgagaatttcatagacctgggttcc

SEQ ID NO: 16541 - DNA, 96327 bp, Human
  misc_feature (1)...(96327): n = A,T,C or G
tttatgttgttgatttggggcacacatacctactctgtgtatatatgctgaaccatttagaacactttaacctgtgaattcaccctcagtacacagttcaacagatactgtagtactattgtgactcacaggacattttatacatttgctaaagaaattactttaaaagtttacttaactgagtattgttccaccttaaggaattatagttttaacatttgtacttttctatttcatgtattttcatttctaatagctgaacgtattcatactcaagtctaatggattatgcagtgtacccaacacatattgttttatgatgtatctgtattttctgaagtgtgaatatatatgtatgtttatatgtgtgtgttcatgaaacagcatcttggacagaatagttttaatcttgaaaaatgtaaggttattttctttcctaataatttttcacaaacccatttattcttggactttgaaacccagaaatatagcttattttttggtctgtatgtctactctgcctagttctgtctcactgtcaactctagtcaaagattaaagattacattgaattttgtatttggtaatatgtgttaccactgtgtatttattgaagaacaaattgattaaattatgagttaaataaatagtgacacattagtcttttgcataggtgtgaagcatgaacttctcaggtaagccacttaaaaaacccaaaccagaacaaaaaatacactactgaaggcttggtagtgtagaggttgttaaatgtgtaaataggcagacaaactgtatacctcaccatacacttgctaaatgtctctttgcaaatctcttaagaggccaaagaaaaaaagacatccctttgaaggagagaagcaaaatcacttatttagttaagcaaaatgaacactctgcacaggttttgaaatgaggctgttgtcaaaagcatgttttacctttctctaaaggggtaggagaatgtgttttagtggatttttaaaaattcagatcatgttcctatccaacttgaaaaataaattcatttaagtaaatcattcatcatcctcagttttgaaaagctcagacagaaggcagaaaggtagaggctgacagctgcccctcccttacccccaccattttttttctttttgtttattaggaaatagttttctgagacaaacttgtatgaacctagttcacggagcaagcttaatccccaacttgcttgcttttgaaatgttggccatgttagctggagaaggagcattacttactaaaaatcagcaatatctggaaataataaagttaaattgtagatgaattagcacattaaagtgcttttgttgtacctttaagcctacaggcagatcattaaatatgcatttcgctagaaagcaactgtctagaaagataaggtggttgaaaatattctacggtggaaaagccctccatcagagaggtggcacggttcggccctcaggatgggaaaagaaggaccctcccactgttagtttaggtttgcaagcctccagtgacctgcagttgttacagtacttttgagctgggaggagggaaaaggtaaaaatacaagtatggctgttgttgcttcagccgggccttaattaccagacacaagaagcagttcagaaatctggtctctgttgttgtagaggtcaccaaatcattaacatcgtcaatctggcagtagctaatttaaatagcacctgatgttgcaacgcctcccttcgtttccccagccaatcagatccaggcttcggctgacagatggtcccataaatggatgtaaaaaggggaagcttcgagccaatttcagcaaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatggtaggtatgactagatttataatctgttgtttgtgttgctggagggaagaaaagcatctacaccttgaccagtcttatgcttgcacaagagtttagttctgtgctgctgtttggttcctacatttactatctcttttgtgtagagagtgcgggtaggtccttttattgaaaagcaatggggatataagattgtcatttttagcaagtcgttgtcagttttcccttcaacataaaggcaaggggtggagggggagggctgaaataattgctggtttattgaaagaggttatattacttgagacataatggcaaaagaagggttttcttttttgtaagggagagggggtttgtctacgtgcctgggttttgtggggctgggggtggatgcagcggggttaggaatctctcaatttccgtgctggaaatttaaacctcgagaggcagctcctggatactgaacactgagatgggcagttgtgtttcgggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatggtaagtgaaaagaggaaggcagcctggaggtcccagccctgtgtgtgtgtgtgtgtgtgtgtgcttgtatgtgtgtatgtgtaaggatgctggactgtgcatcgtaaatcactgtgctgatcgtttgtgtgtgtatgtatgtgtgtgtttattagtatttctcttttctgaaaaccagaatccatctccaagtgtaatggcactgcatgcacacaaggcacacacactgcctcttccagcaaacacacattttagccaaggaaggttggtgtcttttttgacaatcaatgtcaccgtcactgttggctggcgtgtccaccgcctctgtgagccttcaacggaattacacgactgctaaagttaaaggcacatttctttttcagtctcatgctaggagtgatggggaaggatgggaatgaggggtggaggaggtgagattcagtaccagccgatgcaattgtgaaacaggactttcggatgtggaaggggaagtggaaaacctttctgccgaagtagtaaatctatttttagcatcatctttttctgaaaaaagaagcagggaaactccttgagtgccgcttctgtcgcctgatgttgaccctgaagatatggcacaaaatggcatgattagatgccacgagtgcccactttgactttgaattttcaccagcaataggtttcacaaggtttcagagctgggtatgggggcaggctgtaaattcataaccatcttacttatttttccctagaaaagcctggggaggactttttgctctgcatagatgttataacaaagctgtggtctttttcccattcttagaggattgcctttgtctggctgcttgttttgatgggtgtaaaacaaataagattagaccgagcagcccaactgaaagcgatagctgggaggaaaacccaatgaaaggttgccggggaaacgaacagaggagaagccgagtagggagcaggtggctatcatgagaacacactgcaaacagtgtaaaaaaaaaggggagggggacaggacctcgattatctttgctgttctttgtggccagcccaactttaattatacgttattaataggtgttaattacatttctaactctggtttacagtgatttttagaaatctatttttaagcatctgttctgtctcccctgtttttgtgtgtgtgtgcgtgtgtgtgtgcgcgtgtggtttttgttgttgttgttgttgtttaaaaaacccagagaggaggtgagggggaagggagggtagggaatcttgcttttttttttttcctttttcccccttttcccctggtgtgaaattgtacatgcgaaaaatcgcaaggaatcctgtgagaccatttgaaaaaatgtaaattatattgaatgaagttgacggaagcataatagtgaactcccacagctgataggttctgcaaatgatttcttagaaatttccagcaaatattcataggaaaaatataggtagaatagatctaccctaagcaatgatttggggttaggtgattttggtatttttactaaatcggatgttgatactatagtttcaggggaattcattgtacctctcatttttttcctcagtagaaattactttacaaaataataaatgaagagctttttgctttccttctttccccatgcccacagtcacaggatccatcaggcttgcactctcataaccactgccttccatttggcatttggtcctgattctggtcttggcacaaactgagtgaaaagctgatttttatattagtgtctttggacgtctgggacccatgtgtgcactgggtgacaagcatctctcttttttctctaaatgtgctttactaatagtctctttttctcatgatggtgggtaccataaggattgaaaggtgtagtatttgggtgaacaggagatagcgtaaaaacaattgaaatggtgatctgttagggttttttactaaaggacaaaatagatgcatgatcagggagctaattgtaagcccaaaaatgagagatttaaaaatgctgaaatacactaaaagattaggaaatataattggctttattgaaagtacacttaatttttgctctcttcattgcaaatccccccaattcttttttccttgcagatgcgtctttttgttttctcttcttattaggggatttaaaaattttattttcactcttgaggtaaaaataaataaacttgtattttttgtcatacacttgaaacttgcggccatatgttgagtgcataagcctgtgtcacctttaaaaaaatagaatttttttaagtctccaatatagtttctttttttattttctgagaattttctggcaatttttagttaggggaaaataatttctgtaagaagtgtcatcttggcttgggttgtaaaaaagacacgtggttctgatgctgacctttctcgatcctttgtcttaaaaatattaatgcctactaccttcatgtggagttgtgctcttatggaagcacaaggctgaatgtgcatttattaagaagtgaaaatccaattggaaatatttctgcaaaaaacatctgactaagtagcagttttaatgatcagaatgtccatatatctcatagtaacataacagctaaatcatttaatatttaaatttttgaaagggtaaaattaacatagatgaggaagtagctgaaaaattactttgagaattgttgatttacaagacaatttaatatctcattttttaaaaagctaacaaacaacttaaccattcatttgtgatctcagtcccattcatttttacctgccattcattcaagtcattctcctggccagatgtagatggccttgcttctgtttgatggtttgcacaaaaccttaaaactttttctctcccaatactccttccttggtcctttgaaaattagggtgttgttatgagaggaaggccagattgttgtgagataataacaatagaatatttagaaagagagagagagaaagaaaatgaactgcgcatttgccttttagttctaaacttagtcttgaaattggatttgggacactttggacttcagatattttaaacttaggatttctattaggtataagctatttgaaatttcacatctagaaattattgtttgaatggtgctttgtatgtgtgtgttcaatatctctaaaaggacttgtggatgaattgagatgtttttctcaagttagagttactgtgaacaacaatgggatttcctcagagtaagtctttttttttttggtttgatttcttccctttacacttatttccttattataggtgggttcttttcctatatgtaggccaaatactatttcttccatgaggagatatgctgcttcatttagccctgagcatcttaacaccttattttaatttttttaaaaaaagaaacaaattgtctgtatgtacctcaagtaagaaatggttgtcttcatagaggtcatcatacatagacgaaagtactttggccttgacaaatttcttcattagctccaatgatctgtggccaccaggcagttaatttatatgcctagacatttaatatgtacatttgttggtgagctggccagaggatgctaaacacacgagtatgcgctggcaaatgctgcaatgcagtatttttttcccaatgtcattgggaattttggggctaggaagggacatgaacattttcaagcttttatcttactattgtccagtcgatgggccatgttgtacagatttggtcaattctccttttgaaagtaaagtcaaccttttatttaccactatccattcccccatccatgtaatgtatatgtggaaagtgtgtgtgtgcgagaaagagaagcagagagactctgtgtgtatcagtataagtgtgttgcagattcctgcacctgtcttaggctttccttatttggtattactaaacatgtatacacacttacttgcaagtatatgtgcatctataaatggagagaaaaccaaactgggctgcttcccataagaactggtttctcttcatgactccaagagttctcatattagaaaaatatgaaatttcaaatattcattaaaaaatatatattcagaccctgcagtctgttagtaaccaaacacctttctttagctgccacttaagaaattataagtgtgcaaatgcataacaatgtttgtgagctaaaagccatcccttcaatcaagggcctgggtatgaattaaaatgtgtgtatgtgagtgtatatggatatgtgtatatgtatggggggcggtgggcaggatgtttttctttgagggcatttgaacctagtctttaccattggtaaaaataaggaggcggtaagatggaagtgttaacatctgtgctttgctttgtaagttggtgtgcaagtgtgtgtgtattaggaacatccttatatttgtgaaatctccacgtattttaggggtaaagggcttttataggtcactggctttctaagggtaaaaaaaaaagaaaaggtgatctgtgggtgggtgggagtcacaagcagtaattgtcttaaattagctatttagcagtgaaaaggaaaaaaaggctggaagacaagagtgtagaagagtaccaacatgtgggtctgcatctttccggtataggagataatgagtgataaatttgaactggtgcagtgcaagatgcccgataatttctctgaaccttgactttgcaggtccattacttccttgcttgcttgttcacacctttaattatatccagtttgggatgctagctgggggcaccacagataagccattttgtttgttgtttacttcattaagtattcaggcagtgtattcacagtagctttggagcatcagtgttaggaattgagcagtttggaaatggaattgttaaaaaagaacaaaaaaataagacagcaatcagccagctagcttgctttggatgttcacatccactctgcttaatggtaatatttatgctttcccttgcacattaattaagaaataacttacgcagtgtcagggctcttaataggctggtgactttctctctctttctctgtctctgtctccgtctctctgtctctctctctctctctgtctctcactctagctccagctgtctctttctctccaccccacccttgagactgtctttgctcagaacattttaagaccaaccaattttgctttaggggagctcatattcagatccttgttgtatctaataccaaaggtatttctcccctcaataaagatccccctctacaaggatcaagaaatgctgagagccctaaaggaatccttaaataaattttggttgagaaagcagtagaagtgttgaggaaataaggtcagtgtaatttttgtgcttgcgtttttgttttttgttgtttttggaaagtcttatttttaaccccaaaagtaaaatgcaaaactagcatatgggatttttttaatgaaaaaaatatatatgtcttaggtctctcctgaaaataacctcccttggactcttcatttgaaaaataacatgtaaactttagcttaatttttgaattactcattttaaactataaaatatagttcataaatattttttccataggaagtttagttcttttttcaggctatggggaagcagagaaatgacccagcgaagatggtgaattctgaaaaaaacacagcatggaggtttcctctgtttgcacttcgtagcattgaatcttctcctgcttctatgagttatcctttagcccttaaagttgttttgccaacagtgttcataatagagactgactgtcattccttgttgggtgaagatgtatttgttgaggacttactatgtgcatttctttggaacgtggaatccaaggtcaccatttctttttcttttgacaatgatcagaagacataattaattagaggataagtccctgtgattggagatgaagttagggtgagggatttttaaggtggcacattgcacaatgaggtttgtgtcaaatagtaagaaaaggtctgctggaacattcaagtacataaatgtctttccttctgtatttataagcatctaggtgtgactccaaaagatagaaataagagatcttttggacattttagtctataaggtttcatgtgtccacatcttcagcctcaggaagaaatatagaagtttggactgttgaaaggaacttgtctttcagtcagcagcccatgaagcttggctgaaactggttaattttacagaaacacgaatgtcttgcctccttgcttctgatgtaagtggctttttgaattccttttcctctgttacctcccaggagcatctgaacagatagtgaccgttttggcatgccaaattggaagtttgctagtggagcagaaatcatagttactttgtcatatacatctaaatactgtggtgtgtgtgtgtgtgtgtgcgtgtgtgtgtgtgtgtgtgtgtcatgtgttgtagacagctgggagccccggtgtgccgtgggatgtgccaataatggcttctcaagtactctgtgttttcctaagctgccagtctaaaccctttaaaggtttgctttctaatttgtacatgaaaaataacaggctgagttgaactttttttttcaagtgccccctttgaagatgcagcagtagtaaatactgctctaatgataaactttagttctaagtgctacttaaaagtctgtagtagaaaggctgagaacttgccatctttactaatgaagctttccttaggaaaatgctcacttaaaagggagtaaatgaccaagtccctgaaatttgtgatttttaccagatttgacttatcttttcttattttactttttgtaatgcagccaaccacacatccaaaattcttggtattatacatgtcttcaacattaattatctctgttgatgcactgggtacagatagtacagttcccacaagtccagattcttactgtaacaccaaaacaaaagtgatatttatgaataatattgggaaagttgtcctcatagtaaccattccccaaaggaagctttacataaatgtgcacttattattcaggatattaaaagggaatcgttagcttttactttttaatttgggctaaaatatgtaaattggttttattttggagtttctctgttttaggtgactttgggggaggataactttctagcttgattatattttaatcacctctctagtggaaaagttaatcttaaaagcaacctgcttattgtgattaggacccagagggcctgtgttcagatggggctaaaaacatattatattgacctgtacacacgtagaaaaattagatttatttctactagataccgctattaccatgcctttgttggcaaggctatctcagagaccagagaaccgtgagtctgcctctggcctccgaggaacatcacggtgtgcctgtacaggcaagcctctaaaaagattgttctttgtcttaagaaactggcaagtgcaaaggacttcagagtcagttgaacttaagttggaatcctagctcttccagttactaactgggcaatcacagatgagttacttcaacatgagccacaattcctcatctttaaatggtgatgacaatatctaactcacagggtttctgcaagaatcagatgagaaacagtatttgaaggcaccagtcatacataggacttgaaaattgaaggtgctttgagggtgttaagtctctttcagtctgtcagtctttctgtcccttggcaaaagcccttccccagaaagaggcccatctgcccatgccagatgtcctgggcagtgacattgtatgctaccctcactgtctccatactgtccccagcatgcaagaagggtggcacacagtgttgttgtttttttctatatagacaagccctcagttcttcctcggaattgtatggctttattaagttttctgcatcctcctaggatttcacaagctgtatccatgatctcctttggaattagaattcacttgggatttagttgtcaaaagagaaaaacgatgaagataaaattaattttaaccagtgctgtttttttaatttcatgaaagagcctgttaggaaagttaaaagtcagccagaaagaaaataaaaataggctgagcttaattgatatggtcccatctttgctgtctgtatattgtaacttgcaaattatttgactttttcccagaaaccaacttacttcagatctattttttttccttttcactgtatcagctgttttcctcctttccccttgttttcccaataggctgaactttgaagttctgtttctcacggaatggtgaagaggttgaggcaaaaagtggcttaatgagatttttgtaacttgccatcagttttccttctgcttggcaaggcagcatgatggatggctttggcagtgtgaacacctctagaagtgatcagattgactgaagagatgtgcaggatgtcagcagaatgctgaccctcaattcattaccctcccatttgaaggaaaaaaaaagagagagagagaaaagaggaaaacaaccacaaaagccttggcgtagttgttgattacacacacttgggaaggggtaatgggtcgcgtcaggactggtgttaggttaaacctaattttgtaccttttccccaagggtctgaagggggaaataaataaataggcaccataaattaattcacaaattgttctaaatggggacctgttgctgtgacctgttgccgttatgaagaaataatacaaattgtcctgaagggattcaagattcaaattgaaaacacaatcttgaaacaccgattttgaattctacttcatatgcttacaggaaggatataaagggaagtcgatttttttcttcaatgtaatccttaaagtaggggaaggggttattagttgatctgatatcccaaatgccattttgcaggtcctatgctaaaaaaagaaagagagagagagagagagagggagggagggagggagggagagagagagagagacagagagaaagaaagaaaagaaaggaaagaaagaaagaaaaagaaagaaagaaagaaagaaagaaagaaagaaagaaagaaagaaagaaagaaagaaaaagaaaaagatcctttgctatggaacaggcagacaataaaacttttctctttccatatgaatctattttaagtcttcaccaagaatctttggaggattttgcaggtgtgtgtctatacatattgtatgtgatgtgcaagctctctggaagaatttggttggtttttagactgtgtttgtatgggcagaaatatatctgtaaaaagcgggagggacttgattttggagaagggatggtatagaagatgtttgtccatattttagccttggaaaatctcatgcctattaatgaaggacaaaaaagaaatgatttactgatttgagcaggcaaatgagaaggttggatattcttaggaccttcttgctaggtaggtgtttgtttatttaaaagttaaaaattcatccatatttaggtcaatacttgaatctcagttccttcttttttttagatttctggctgaagtttttcatgagaagaaaaaagacttggagcttagaactgctttagtaagaactattaaacaggtctccagtcattgaattttggaggcatgggcttgcagttggtataatcttaacagtattcttcctgaactatcccatgtccatttcccaagaacagaagaacaagttcgcattctagaacttcagctgttctcagcatagttctgcttgtaacagatctgtgaccatagagatcatctttcatgttcactcagccttgtataatttttgccctatggtgtcagtttgatctctttaatgtaattagggcaggtactgttaactcttttttatagaaaataaagcttagccacttgactaagcttgcacgtttagtaatatcagaagtcttcgctccagagtgtttgggaatatgtccagctcagccaaagtttacttttcttgggggaaaaataaggtaatttctcttctatatcaaatttttcgttggagaatcaacaaatatatatatatatatatagcatgtctgttgcatataaaccatattctagatgcatcctggagcatcatagtatttaaaatatattatagtaagcaaggacaatggcaagcagaatgatgtggacagtgtctcagcagaggaggtacaatgtacaaaagagggagacattagttcttgttgggggaaggagacaagcttcatggaggaaatgccatttgagtagagccagggaaactggatagatggaaaaattagaagaaaggggaattccacatggagagaatcatatgaataaaggcatagagatgggaacttacaaggcctacttaagaaactgtaagtaatctggtgtgaatgcagcatatgttgtgtaaagataaagctagaaagagataggtaaaagctatgatttaggaaggttcagttgttttgacttggttttgactttgaattggtagctatggaatgtcttaggtcagaggactgtcctttcttaattctttttcagggtcaagacctgtctttattaagccattatttctcagaagttgaagtcaccctaaagatacttctaaattagacattggttaggggaatcagcattagagcactcttctggtcataatgtgatgttatgatgatgatgctcattggtgaagtcacattaaggactgcttttagggttatagtggcagaaagcagtaggaggaaaaatatcgactttacttcagattgtaaagaagtgtgctattagaggagtacactgcattctctcaccaacaggtctccagtgctcattttgtgggataatgtgtggccagagagaagatggtggtgagtggggaatatgcttattttctccagtataaaaatgtacccacttcaaacttgcaagtacacgtaccaaagcatgcttgtcttgactggtcatctgttagccctggagggcatagatcatgtcaaatcctctcttacttcaatgtctaatacatagtaagtactcaaaaaaaatgtttattgaattaggttgtcataatatggcttttgttgggggttttgtttttatctctgatttttaaagagactgaactacagagttagacttgtggatcttggatctgtcatcaacttctaggagcctatttagcccaactaacataacctttctgaccttcagtctcttaatatgtaaaacagaatgaatacaacttcatggcttaatgggaggatccattgaattgtatccttgatacactctattggacaggataataatattagtaagttactagattctagttttacctatggatagtttattgggtctcgaccggcattaaaaattaaaacaatggaatgatagaattgaatgaaatagaaaagaaagtatcattgggtggtacttattaagggttagtattatttcatgaatctttgcttcagttacctatgttatgagttgtgatatgaagctgtggtgttccatatggtgttcaatatgttccttacttttttattttactttgttgggtcatggtcagaaaagtttgagaaatactgttctagataatagtgagctctgtattatacaaaggaaaaataacagtcagcttttttagaactatgcaatgcaagatctctagtatcttctgagttattaaagaaaggatgacttctagttgttttagatttaatatgaagcatcatatcctacatctttgataactactgatgtctgcatgatatatgttggggctctttattaaccaaagtatttattaactaggaaaccttatgccttggttgtgctacatagcaaaacctggaatgtaataataaaagtgacaataatcagtagtgaatgtgacctagaggtgggactagaaataataagattagttttcatttcttgagctcttgatatgagtcagacactgtgccttacaaacaccatcccttttaatccttagaacaaacttaaaaggtaaatgttaatttctctattttatggacaagctaactgaggttttggtgggtaaattacagccagtaattggttgggccaggatttgatttgaacccagatttgtctgactccagaataaaatttcaaaaatttattcagttccatgaaaatgtattaaagtgcctactatgtgttagctctgtactcctctacaaagataagtcagtctctgtccttgaggctttactagctgccctttgtattttactatgtaagaagatgaataaggatttattttatcacagcaggagataggacaggcacatagagtactgtatattttacttcagaagtgttaagaaaagtgcctgacacacagtaggcattcactaaagatttattacattgaattgaagttggattaattctcctctagggattagggaacctttgtactaaagaaacactgtacatttttatatgtttagctgtatatgcctagtggcatgggtattcttacctgcaatgtgggcagatccatctgtcccaaatccattcagtgccttttggagctcctaaaactggcagcacagaaaagccaacaagagctcaagaactcaaattgtaaacttcaagtttcattcagccagagagaacattttccatcttagtgtgaaaagcaaatcccatggcagagacatttggagaatgataaatggaaggtgggcttccttagaatggaaaattgttattatcattgttaatgttatttttacaatgccatttactagctttataaattcaagcaagttatattacctctctaagcctcagtttccacatttttaaaaggattaataccactcaggattgttaggattaaatagacccatttgataaaaacttactgagacttactatttggtagtctgtaaatatgtagtagtaaaggagacatggccccccgtcctcaaagagctgaatatctggtgaatgtgctgtgagaagtgggattcagactcccaccacctgcacaggtcactattgataggatgcagcactctacagtcctccttggggtatgtatatattgtcatatacatgtctcaattgcatcatcagaatttcaagtttattgagggtgagtgagctcaaatattcatctgtttatctccacctacccctaagtttcatccttgcctgttgacacaatgttaccttatacagtagttgctagatgaatccagcccaattcagcaaatatttaccaagtggctcagggtacagtgctgggaaagggagggtaacatttgctgaacagagttgaatttaaaacaactttagagcataaaaggggaacagtgtcatgaagtggtgatatactacactagtgctaaaaatacctgtgatctactcaggaagaaattagggctctaaagaaaattcggcagtaagcctaaaaataatgtattttttcactctcccagtgctgttttgtttgtgtttcatggagaaacagtgtatttgctataagcacacaattaagatgagatttcagagatggctacttaattcatctgtggctcaggaccaagtctaggtagcttcacaaaacccaggagcccctctgtggccagactcctctcctttccagcctcccatcttgggtctctttgccttctgttcatgctccactgtagaactgcaccacggtgttccctactgttgctcacacagatccctcggtctccaacatctttctgctttcttcacctggcttcatgagacaaataggaggcctgtgtcacccagaaaggcttgccttaactcactgtgggttgtagccatctctgttaacactgccagcatcattccatcattggtcttccacactccataatcaaatgtttatttttctaggtttcaccactgcctcaacaatcagcactgagtttatctttatgcttggcaccaagtaggtgctcagtaattgattgttaactgatgtagtcagatattaattaggtgtttcataatgtgttcccatcaggtgccccctagcttatgagtgggatattggacccaaatcccccttgttgtgaagactggttttgacacagctattgctcaccaaccccagttctgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagtggttattaatagggatatttttgagatagggtctcactctgtcacccaggactgcagtgcagtggtgcaatcacagctcactgcagcttcaacttcccaaggtaaatagagacttttgatcaagactacctggattcaaatcctggctttatcagttgtgacctaggggaaatcatttccactccctatgcctcaacattttcatctgtaaactagggttgttgtgaggatgtgatggaccaatgaatattaaggatttaaaacagttacttggcatataaagtgataatgatcatcatcattattgttatcatacaatattaatttgtgtcccattcttcaaatttttgttgagtgcctgccagacactgttctaggtaatggtgatagcagtgactaagacaagtccttgcctttatggagctttcattttagaggaagaagacagagaatagagtaagtaagtagtaagtagaacatggcatagtagtgtgtgcctgtagtcctagctacccaggaggctgaggtaggaggatcacttgagcccgggagtttgaggctgcagtaagctgtgatcacaccactgcactccagcttaggtggcagagactctgtatctttatttaaaaaaaaaaaataaaagtagatattatatattatgtcgtgttttataatttcacatagtgaaatgatgtttaaaaaataaaagatgctagattagagagttacactaacgagtccttgtttgtggcacacagtgaggccacaatagttcagccagtgccttgcttctgcttgatgagctggaaccgtcaatgccctactctgaaaggctgagcttcatatgtccaactactaactcttggagacaggcttgcctgacctgcatgtggtgtaaggtggtcatctgtggaatgattggacaattggactgaggtgtctgagcctcaggaaaacttaagatagagaactcataaagaggccaggggtcccagcctttgaagagaggtcctattctgtgaaatgggacaaatgttccaggagggtcaggaggaggatttggccaatcattcaactaagaacagggtcagccagaatgtcttctcaattaaggcttttaagatctcctgatggctccttgcaggagcctgaacctagaaggtgagttagccttggcattatcataggattctacctttccatgagtgttctgctggttaagggcatcttaggagtctgcaaaatggggtgtttttttccttcacttacttgtagtggggtcttggtaaagtcattagcctgtctgagcctcagtttccttatctgtaaaattgggctaataataccttcctccaaagcttgtttagaagatgaactaattaacatgtgtaaagaacctgaatcggggcccggcacctagtaggcatctaataaaggaagatttttaaaataagctcagtccccctagggtgtgcattttaggtattggtaatttattttggggctcacagggagagaagagaaaaatgagagctacttcccattctataactttcaaaaaagtgagcagataatctcaaaaccaaagatatgtcatctcagaaaggactgtgaagaaaataaaattagatttgctgtaaatcagtatgattgagactggtctctgtcaaagactgtgttggccccatcctcttggtgtcacaggcttttagaggcctggggctctgtgaagaaaagcacttggttaaaatggctctggagtcttaaatcctgagtccaattctttctagtaataagttagaatatttactttttagtgggggatgaaggggatggatgatttggttattttcatatgtcaaaaatttcaaggaaggactcctgtgctaactggaattatacataaacctaattgatgctctggtgagagcaactggaaagcactagttttagaatgtagacataaacctttatgtattgtatctcctgtctccattgtgtatactgttacataaaattaaagattaaaattaaacttttaaatttcactgattaaaatcaatttacctgattaaaattaagattgaagagaaagagagaaaaaagcacagtttattctcatcccaaacctcctttgttttcattagcaatgtgtagacttgaaattaccttaaaaacaaaacaaaactcccccatgaaacacatttaagaataaaagaatgattttccaaatatttgtcaatgcactttttgtacagggcactgaatgaaactttaaatatttttttcctcttatggttagtgacatgttagtattgtgattcactcagaatttatttgacccccttgatcactagttcacatttgttttaatcttgatggctacactcatctaaaataaacagagcaggaagagtaagagaacgcttaaaaaaaaagcattttaaaataaagagtcacccattcctcttacgattatctcagcatgctgagaaagaagcctgatgggttggagataaggatgtctcctcctatgtccccgtgtgctctgcctctaaactctcctagcaccctgcacctgcctctgatagctgatccattcagtgggcattggttgaattccccatgtactgcctgctgggagtaagaagtcaaccaaaattcaggccttattttcaaggcattccctgtcagtggggagacaggcaggtaaaaagcgactcaatatagggtggtaagtaccaggacagaggagagagaggagttgtctgaagctatgtaggtcagggaggtggactccagggagtcttgcaaaatggcagggtaatttagatggtgatggcgaaagcatttcagtggacatatatgcaaagacatggaagggacatactgccaaaggcattcagattatggtacttggctcactgcatctggaactttgttttcaaatgtctactaaccttccaagactaaattcctagagggcagtgatcaagtgccatggaactcagttatccaacagtaatagatttaatctttgccacattcctgtgaaccacatttctgtgaagcctataacattatcctattgatatgccccaagttacatttggaaaaccgagacacagaatggttaagtgacttgtccaaggtcacacagctaaacaggaatttaaacctgggcagtcaagctctagtgactgttttcttaactattatgctatgcaattagtatttaataaatgtttgaattgatgttaattgaatggatgtagaagtgattatgtgataatttatttattcacttatttaaaagaaataacatgccaggcgtgcccagatctaatagttgttgcaggaaaatgtcaagagcccccattggctttggctttggctttggctttgtgacttacagaaactcttaaaggtagaaatgttctgcagggctgtgaacctcaagatggtacttcagatttcagccaaattcagactcaacgtggaaataaaatatgagtttaggcctgaaacagaggagatctaatttcctatgtggagatgaagaaacaaaggctgtaaacatggccttacttggaaaatggaaggccctaggttttgaaaacagcctcttgggatagtttgaaggaagttgagtgagacaacaatgatgagggcaatatagctttaaaagaatgaattcactcttacttttgcattgattctgaagaggagagataagcgaggtttatggtgagagcaaagtggtgatgaacaggcaagggaagcagatttggctatagaaagcaggtgaggacctagagagtcatccatttattcatttattctaccagcaaaatcatgagctctgcgctgttccctgggattacaaatgaatcaaacacagtcgcagtcctcaaggagctcacagtccagtgatagagaaagataggaggctggagagtttcaatgctatgtggcacatgtccgtaatggaaatgtgtgtgagagacaaaggtaagagccatgatgggggattggagaaggggcatgctaggtctgatggcagagagaggagggctttccaggccaagggagtgcttatgtgcagagtgtggcacaggagagaacacagtgtgttctggtttgtcattgctggctgcagaagcctacagaaggctgtggcctggaatgtgcattccagggcttatggaacttgtagtgggtaaagaaggaagatgggagtcagtgaccagaagatgtcagttcagatccaggctctgcaccatgtgaatattggctagttagctttacctttcatttgctccttaacccttagtttgctcacctgtaaactgcaagtgatggcaagggaagacaccacctatctctcaggatcttcaggaaaattaagtggggtggtgagtgtgaacgtacttacaaaatcctctgagtccagcatgtaatttaattattataaattattataaaaaattattttattattttgtaagtgagggttttgtaagggctttgtaagagtctcatttcttcagggggaatgacacttgctctgttatctctacacttcccaccacacctttctgactgtgccctggaaaaatcctctggaagtgcattctgtcagtttagctgcttattggggtatacagtaagaaaggagcagtccaagtggaggatggaccaagaacaaccctgctcttccaccctgagtttccttgtggggagccggaaaagccctctgctgtcagtatgcagagtgcactgtggcagtgatctgaaatttcccaggaaaacatgatggttttccttgtaggaaagcagaaaccctaatgactcttattaacatttgaagtacctcacttgggccattcacagtggatggctttttgaaagggcaaaagataccagaaattgtgtttgtaagtgtcaaacatgctactttcattatttctttttttagaatccacatagcccctccccctttgctatgtgtttactggtttggcattattgtgagagcttattagtggatgtttgtggagcattgtgaagatgaatagctattggcataggtgatgagtagtaatgtttttaagtatacttttctatttcagaaattaaattccaaggataaatcttaccagctcttagattagtcaactttgccacctgcagcacattttaatgggcacatatttcagaatgttaccttttggacaaggaaaatgaacatgtactgagtgcttactgtgtactgagctctgaaccaggtgccttcagatttgttgtttttctcacagcaaccctgcaagacagatagaattgttcacatttttcaaatgagtaaacttaaattgcactgcagagagtctgaactggctaaaccaaggtcaaggctggtggtggatttccaacccaagtcggatcacctccaaatctcatgctttttccattataccatgtagaattttgaattttgaattatggtctttcctgtaacacccatttattgggcagtatttactgactaataaacagcagatacacaggctagttgattttaatagggttagataatttacattctctaagattactaggttgcatttcatagtgataggaaaagtcctcagacttagagattgaagaaagggcacaaatttggtttcagccttgagttcaagttacaatcctagttaagtgacagtggactctgcctgaagactcattactccatcatgtgtagagtgacagcacttctacatctgtaaatgagaggaatgacaatacccacttctcaaagttgtgtgagaattaagtgaagtgatgtatgtaaagacacctctcaccatttcttattagtaccattggaaggacttaatgataattacttgcctaaatattttcctgtgtaactcaaagcactttttaatcagcattataacaggatttccctttactgagtgtttgtcatattccaggcactttgtatgtactttttccattactacacttatgacattagacagtaatttcttatttacttatttatttacttccttgcaggcaggaactctttctctctccttcatatctctggcattcaacataatggtttctggcccatcgaaggaactcattaatgttaggaaacttagcttggcttttgttccttcttttgagagctaacttcagtttgggggaggggctgctccaatgaagtactaaattaacatcattaaattgtgtctcataacttgccctcaaatatatacctgtaactaaagaaattttagattgctctaattgacaatggatgattctgaatatgtgttaacattttactttttaaaaaaggtaaatttctgggataaaaagaatatattaagagttgcaagagtttaccaaacaaattttctttgtatctgtgattcaaaggacaagcttaccctactcagaaaagtaatgttttagtttcaaaatacatgtattatatccatttgataaatatacatgataatatacatgtatcatatactaaatattcttagggacatagtaaattaattctaaaagggtcttatctgagaattgtagattatgcagcttgaattataatacaaatgtaatttttgaaattttatcatgtcttttttataatttaaaagttttatttttgatttttaaaaatgccaacttgacttttgcccaattagtgagtgtgacctttcaaaagcatattttgaaaaggcaaaagattgtgaagacagaaatactaacttatttattctcttataatctaaaattctatttttatgtggcaaatcataaaaatacatacagtaggagtttttttaaaaaaatagaacaatgggccgagtgcggtgactcacacctgtaatcccagcactttgggaggccgaggagggctgatcacaaggtcaagacattgagaccatcctagccaacatggtgaaaacctgtctctactaaaaatacaaaaaaattagctgggcttggtggcgcatgcctgtagtcccagttactcaggaggctgaggcaggagaatcacttgaacctaggaggcggaggtttcagtgagcagagatcacagcactgcactccagcctggggacagagcaagactctgtctcaaaacaaacaaacaaacaaatagaacaatgaagaaagtgaaattaagggaaactaagaggattttaaaaagataaattcagaagtaaaatttatgtttaaaaaaaaaaaaaaaaccagaagtttgcagtgaggtcccatgctctttacacacagaaaactatagatttggcacccattttcctaatattgaaaacaaaagcaaacccatcatgcagaggacagagaatattagtggtttaatgtcataaaaagtgcttgcctcagagcagacgtaagtattccgatacttgtgatttctggattttgtttgtttttttccatttctactttgcttgcttcttgttcatgatatttttaatcgatacgtattagaaggatgttcaaatgcaagaaagagagagagaagcttaaaaagcgtggtatggaatgccacttgacagtgtcatacattcacaagatgtccttgaagatggagcacagaacagagatcagggaaattttgtcagctgcagttgggaaaataaatggctgttgtgtgattgggcagatcctgaaagcagactcctgctcaaaccatgtaattaacaaaagtgggagcttttgtccaagtgcaaaatgttcataatatcagagtttgtcagcaggagcttttagaacggatcagtacttttcactccctgatccagggaatggttttcttataaatcatcttctctccttgctgtcctcatgaaggttgctgccgggcgataggcagacttaagattgtaaccttgctaattcacagtgatttaggtgaaggggagactgaaccagagactgtttctagaaatgtgatttttattcatttgggctcccatgagtactctaatgtaggaacaaacagagtgtgtccaaggagagatcctacaggatagctctggggaggagacagaatcatttttaatactgtgactccaaactggtttgaaggacttgacattttctttcttttttaaaaaacaacttcctttcagattataaaactgctgtattctcactgtaaaaacaaaacagagttgacaaataaagatggagaaaagtgtaacaatcacctgtaattctgccatttattctagtgttttttatttttccctcctactctgtacttgtttatataattgagataatcaatcttttatttcacttctttttctacattgatcatatacattttctcacattataaaaacccattataaacataactttagcaattgcagaatactgtatcaaaaaactgcacaatgagttatttagccatcccccttgttagactcctgggctgtttccgtttttctcactcctcttaatataactcattgtatgtacttctggtctgcagaattttggattcttttctgagtttcagaatggaccagtgggtccaagaatatgaacataagaagagatgtgccaatttatccttatacccataattatgagaaagactatttcactgcatcttagaacttgacagttgcaaaccttaaatttctagtttccatgtaaacatgttgcccacaaataattcaaaggcacacttctcctcacccaggcctgaattctcaccaacattgatttggtggagtccagttttactcctgcctccactaccttcccagggaatgtttaggggcaatggtatccaactggccctcagaggaagtttgagggataaagttctcctatcaagtcaaaatgttctttttttctaacatttatctcttataaaaagaaagaaagagagagagaaagaaagaaagaaagaaaagaaagaaagaaagaaagaaagaaagaaagaaagaaagaaagaaagaaagaaagaaagagaaagaaagaaagaaagaaagaagcagtgaagggagaaattaacaataaactttcaagtgtgataaagtaattttcagatttaaaactactctatcagaataacattcaggatcttttcatgaatgaacatgtagctatatgaggctatatgaattgtccatgagtataatttatcacggccagttatatatgcattgaggtgctaagaaccattttatttcacttattatcttcaccttcagaatgacttaattttttgaattgcacaattagaagagccattgaccttacacaatttctcttaaaaagaacaagacttctacacagatttttctagacacaaactccctctactcccttttactcctcccctcttcctcaccctggttatgttaagaaaacaagtgttaattttcaaaataaaatatatttctatgtagatttctgaagaatttaatctgagtgtgcataaaacttaatttcagagatgtgacctaatgctttagatcatgatacatatgtggaatagcacattgctgtttacaagtaaacctcaagagtttgctgcgactgagccactagccaggcattttataaatatacaatactaatgtttacatgaattgtgccattggctattgtttatgcatttaattggaaagataagtctggcttaatcagtttgtgggcagtttttcaaatgattcattaattatgagaaagactgttctttgtatggaagatgaagataatgtatttcccatcacaactggttcccatcccaacaagtatccagagattattattaggcattttagttattttatccacattaaaccttcagagttcagagggtcttagggagcagaatgggaagaaattgttttccaatcgattttctttttattagagctgatacttttgcaggaaagctgagcttgcccacaaaattgtatttttattaaaatgcaaacatttgtctttttcaaatctgacttaaacaaagaaagcttattgaaagtacggtactgtatttatttactggccattttggaaaggagaaccgaattgtgggggatgaaggaaacgttccctcatctttataatgtgctgaatgatcaagctgtccctcagctatggagagtttgttgtaaaagtcagttaaaaccaaatacccaggggtcttaccagaactgcatcaggatggacacaccaggaaatcatcttaggcccaaaatgaagctctaaagaaacactgtaaaatgtaaaggaggccagtatttatttaggaggggaaatgggtgtgatgtgtctggggaagaagattaaaacttggatttccgtgaatttgagaatgatgcctatgagaaattaaattttgattatgcttttcatatccgtgctggccctgctattttaagtattaatgcctcttgttctctccagtggctgctgattttttaaaagccctgactaccaccactgagaatacttttggcatgcctggtgttcatctccagagcagaagttgctgtttgaaagaagggatgcctcacgcttacctcattgttacaaatataagttccttttagattataaagcgctatattctcattgtagaaacaaaacaaagagttgacaaataaacaagtcatttgtttaggatgtaggcatttataccaggaaaaggacagtcagttcagtatcaaaacaggtaggattagtctgagtgtatacgatttatatgcttttgctgaggagggggtgtcatttgagaaactctgaaggagactgcttaaaacaaagggatatacaattgattttaatgaattatttgtttgcctgccctcctctgccatcctcccagcttcaaccctctacagggagggaccagattatttttgttttcccaccttctagaagaatgccttggcttataattgcattcaataaacttgtgttgaattgaatacacttgttttaaggatatgctgagaatttattaccacataacttcccagagtaaataggtctttcaggttatttgtgcctctgcccaaaggtattattaagctgtcagcatgtgtttcttggatggaattaaatatttttttctagagttttctagttaccttctggcagaagctacagaaacatggtatgaatggttttgggaaacatgagtgcagtctttagccacagtcccctagtccagtggtctttgtgagtcatcacctgtaatttggttggaagggtggtatttccaagttcccttttcctagagttatcagatcatcagtctcagctcctccccttgggtcccattaataacatatgtctccttcacagttgaatcataaccaggaaagtgttgcatttcaaaaaaaaatattaacctgaagggacttgagcgaattaaagcctcttgaaaagaaggacgggagagaatagattttatgagctgatctaagacactttaaagaaatatgaaattggggaattgtaacgacatttttagtatcttttaaggagcaagaagagaagtgaggaattttacaaaaaaaaataatgtctgtcttcaggaacacagagcctgctgtgtaattttctaactttgggaatttgtttttcaggcttggaaaggtgggtgagatgcagtagtctgggctattgcatccaccagagtctaacatactacatgtcagaattttacaagggttaagtgggaaattcctacaaagagaattaggacttttatttttgttctcattaataatttaaatctatttctttaatggttcaattcagtgactgcccttggtaaacattattcttcatgcacctgagagagcttgttctattacataagggttagctttatacatatattttcaaaaatccttccaacatggtaaaagaaaacacctttacatactcattaaaatatttaataaaatacatgcatgagtctcaggtgtacacacctgagacatgtttgcaatcagtacattcctttaacatctttctcgtttctgggaatactgacttttaaaggtagctgaaagtagaggataagggtatttgtaaaagaaacatcatgttctgtgaccttctttggttctttcctcttgatcctttcgcatgaattgtgcagtgaggctatatctccgccagaaaaccaggagttaaggactgccaaaagtatggtgacaggtgtacaagaaccctgcactgggctcttagatgatgaatgtcagtactgagttctgtatcaggtcagattcctgtaatgtaaagttgtaacctttgatttgcctcatgaagtaaatcctgaaagtaggtgtaggttaactagattaaaatatctaaatgcaaaacaataacgtggggtcgtatgtaggtaaagtggaggggatagggtaagacagggttctaaaccttgctattaagaagtaaaagagtgttagtctacactgaagtattccaaaaatgtcacaggcttgaatgggaaggaacagtttgtggactttccatctttatttttatactaccatttttagggaaaatattaggacaaggacacaatatggtgtggttggcaggatggtaagaagactatggtagcaacaatgattctcctccactgtgaggagggggatcaatcctgtaactctagcctgattgccccaaacttgagaaaattaaagctttgtgaagagtggaggatggaaggaggtgtaagaaagtcatgagctaatggaataaatattaactactcaggaggttgaggtgggaggatcacttgagcccaggagttcaagtccagctggggcaacatagagagacccagtcaaaaaaaagggaaggaaggaaggaaggaaggcaggaaggaaggaaaaaaagttttaagggagctttaaatacatttttagtacatccgtacacttttagattttagaatagtcttgcttaatatacttcaaagattttcctagtcacaagacatgctgctgtctcttctctgacatgtggacccttcatcaataaatatttatttgattagtaaattaatgaattctgagagcaagaaatcatatgaaaagagtggtttgggaaggaaggaaaggttttacttttgattatattgctaatcagcttttcttgtctaactcttaacctagtttcttaggtattggtttttatctttctccttgttctcttctaataatattagcatcagtcaccactagcatctgtggagggattaccatgccaggaatagtgctgagtgctccatgtacattatctcactgagtcctttttataccagtaagagcaaaggctgccctgaaccaccaggttctattcttttccttttgactcattaaatagggctgagataaaagtgtggaggggccgagtgaagatgattgacactatatgctgccaacatgcttaattaacagttctcagccaccttggtgtgaggtaggtagagggcagagggtaggtcagtggaagggctggggtaaggccgtattctaaactttcctatcaagaagtgaaagagtgctagtctacacagaggtgctccaaaaatgctgcaggttcgaatgggaaggaacaatttgggaactttcaatctggagataatagattggctttagtgaacataaaatgctgtttgagtgtacatttttctgaggatatagggccaaggcattcaataggttttctgaggatatagggccaaagcattcaatagtagactcatgccagccaaagctttaaccctcctgcttgaatgagtgcttttttttttttgaggtggagtcttgctctgtcacccaggctggagtgcagtggcgtgatctcggctcactgcaaccaccgccttccaggttcaagtgattctcctgccttagcctcccaagttgctgggattacaggcacaggcacccgccatcatgcctggcaaatttttgtatttttagtagaggtggggtttctccatgttggccaggttggtctcaaactcctgatctcaggtgatcctcccaccttggcctcccaaagtgctgggattacaggcatgagccaccacacctggctaatgagtgcttcttaaaatctgcatttgacatagagatggaaagtagaatggtagttgccaggagctggggaaagtaggggaatgaggaggtattgtttaatgggtatagagtttcagacttacaagatgacaagaattctgctggtggctgcaaagcaatatgaaggtacttaatgccactgaactgtatactttaaaactatttagttggcaaattttgctatgtgtattttaccacaattttaaaaattgaaaaaaaatctgcatttgaaagaatatttaagtgtatgcctggcatataataggtgctcagtaggtgactggttgcttacctgtcctgttcttttgttatctgtaaaatggggatgatattagtactttattggcttgtacttcacagggttgtttgagagatccagtaagctaatggacatgtaaggactttcattcattctacagtcctttatctgggacctaccgattgttaggctttattctacattcaggagatgctgtaataaacaaaacagatgtgatctctgtgctgtggacctcacagttcaggtcatgaattttaatgaactgtaaagtgctatactcagaaaagtatggaggtagacatgtctccacaagtctgttgaagtacattctggtcctccactttaaaattacagggttgggcttcatggaccctaatgttctctggtatctgttgaattcaagaagggtctgctctttgtctttgttatctctgtatccccagagttcagcacagatctcggctccatctctgtttatctaacatacccagatctagccatagtggaagtaaaccctttttaaatgtgcgtatgacctgacatatccaggaactagtgttacaggtaacttgggtagacaaaaggagcctggattgtgttgagagaggtgccagaagggaacagaggggtggctttttagtttccaagagcaggaggctggctgagcctctgctccttacctcccctctgcagatataaacgaccctggtgatgatccggcagctgcacgtctgaagccttccctcttgcttttgttgtatattttgcagaaaagagtggtgggaggggtgaggttaatgcattgagtgtgagtaattagtcattcaaaccatcgacatttacgatgacaggatttgagtgcctacgttattgtgcaccgctctaatagtttatccctgaaattttctgcctgtataatgtttcttaaaatatatcacagaaacataaaagatttaatgtagtgctttgtacatccattagagttcgaagtcaactgaacctcctcaatgatctatcctggatgctgactgtaattctgttcttaattgctattcaaatgaggaaaggagggcaagtcaggggcttggaacctggtcagctgcaaagttggctgtgagacccacacagaatgtttcattaaagtacatatgcacacttgagtaactgatatatttatttgcaatgaaaattgtgctgttagaatatcaaaggcgttagcctgaggaagcaagtgttctgattttgcccagccagcctctgtacttactggaggatgtgctttctaccaacacacatcttttctactcctgttctgtccctctgtttcccaagcagagagaacaggtgtcctgtctttgaggtctatcatgtaaccttaaaatgctgtagtttcatattcgtgcatttaatatctttacatcttggcaacttctcttattttccaggtaatgttttaaaatcctcttgtttcattcacatgtcagatttgattctgatgttttacatttctgattttttttttcagcctgtgttgcatcctaagatgcatcattaagacctgtgaggggtcttattataggatgtatattaacacatttgcaaatgtttctcagctttcagacagcacacttttattgagaaaactctctttgtatgtgtccatttgtgtgttttcatcagttccttctggatacacaaaagaataactgtgtagtgtagatgcagagcaaagagagctccatctacattggatgagaatgacttgacctaatttatagatgtggtcagctaaagtagctcagtagtgagcattgtatctcatggctccttttagaagctagttgggaccagttgggctgtctaatctacagacaggactcacctcctggagtcaacatagattaggaaatccacatagaatgcaaggaaggccacaaagctgatgcggggactgaaattactttgctgcagccttgttacttcacaggccttcctggaggaggtggacctgtgagatgttcacatggacaagtgctggctttcaccacgtgtctgaaaacgaaagatgaacctgactatcaggtgacctttatgagttttggtcccacagaatctcaacatgaaattcttccacatactccatcactagcaccaaataagctgccttggtgtgggatattttctaggtgtttgttggggagctgaaagaagggtaacctgaaaaaggtagaaaacagagaagagtttctaaagattgtgggcctggggggtttttgccattaaatcgaatgtagtagtccggcctcctgaatggataaattctgattttcatgttcattatcgagttggcagtgcttcttatgtttgttgcctggacacctgactcagtgaagcagtgagacaacacagcaaatggaggcactgcaaagacccagaaggccccacagcttggcagagctgaaacctgcctcctagccaggagttgtgctgatgctctgtaatgccatccctttagcatgcctccttccctggggaccatctccctgattcttttcctggacccttgcctcgaaggcaaagtggctgaataggctttgctgggtacaacttctatcagtcctgaggggagcttgatttaagattcttctcagaagctttttgctttctccttgctgtctggaccagccttctagaatcctaaagttgacctgaagccaagaagaaaattctggtgatgggagaagtggagccacttaaattacttacatgatggtaaagaatcttagatgctccccatctttcttagtctgctttatttccttggctcctcttgagccatgttttcctttttgtttcatttatcatttgtgaccatcagaagatgaaagaattagaataacactcacctacgtggggcatgatgaggaataatagttatgatgcctctgggccctttgtattttagacatttaatgtacattatctctcatcctgaagataaccctgcgtggcaagctttttattccagttttgctgaagaggaagctgaggctcagagtattgaagtaacctgcctcagatcacacagctaataagtggtaaaactaagttttttgtttttttgttttttgagacggagtttcactcctgttgcccaggctagagtgcagtggtgcaatcttggctcactgtaccctctacctcccaggttcaagtgattctcctgcctcagcctcccgagtagctgggattacaggtgtgcaccaccacacacacacagctaattttgtattttcaatagagactgggtttctccatgttggtcaggctggtcttgaactcctgacctcaggtgatctgcccacctcggcctcccaaagtgttgggattacaggtgtgagccaccgcacctggcctagaactcagattttaaatcacctgttgtcttgactcaaacactcattccatttttactataccactctgcttcagatgagaaaataaacaaaaacaaaaacaaaaaatagtctctgaacattgatgaggatgtggagcaactggaactttcatactctgctggtgggaatataaatggatacagccactttgaaatactgttggcagtatctactgaagctaaatatacatacaccctatgatcccaaaaacagaatcctaggactatccccaatagaaatatgtacatttttgtaccaaaatgttgtacataacgctcatagcagcattatctatagtagttcaaaattagaaacaatccaaatgttcatcaacagataaataaaatgtaatatttccacacaatggaaattgctatagcagtgggaagaacaatgcattgttacatgtaacagagcagatgacactccatacatgtgtgaaaaggcacaaaagagtatgtgttgtatgagtccatgtatataaaggtaaaaaaataggtaaaacaaatctgtggactagaattcagaatagtggttacctttgaggggtgaggtaaatgacagggatggagaacctgagaaaggcatttggggtgccagtcatgttctgtattgtgatctgaaaggtaattacccagttgtgaattgtgttcactttgtaaacattctttgtgttgtacccttaagatttatacactttattacatgtatgttatagtaaatgaaaatgcttcccccctaaatcctctgagcaggcaaatggtaataataatggaagctactagttatcagatgtctgctatgccttggtttcctcatctataagacatagagaatattagaatatgcttcattgccttcttgtgaggagacagtgagagaagtcacattggatgattggcagagtaactaataaacatcagtgattgtggttatgtgcccaccactgttctggtgctttacataagtcatatcactggatcggttcttaccgctttgccatacggtggcattgttcccatttttcaaatgaggaaaatgaagactcttaggatttaagtcccttgccaaggtcacacagctagtaagtggcagagtatgatttcatttccaaggagttgatgatcagtttctgaggagatggaagccattttatgatggacaaatagaggacggtgtaagacaaaatggaaagttgcgaattatgggctgcgtttggggccaggaaatccgggtgcaggcctggactttgcccccatttttctatgataacagagaagtaactggacatctctgggcttcatctcgaatgtgagtgttgagctagattttgttcccttatgtgccttctggctctgcaattttgcaattctccatgtttgtcattccatacagggcatcttcatgacctgacttcatgagcttaaactcatttttcatataaaaccctattccagcattttctcagaactgtccctaaatctccctatcctataagcagaagtaattgcttctgtattgcatgatcactgccctataccagctgtttacctgtctgtgtcctctatagactataagctccctgaggatagggattcattcatttctttattctcatacgtgctacctggaacattcacaccagccagaaatctttgtttaattaaatattttaatcaagagaaagtcctttttgagtaatatgtgagtggacagcctcaggcggtgctggacctaacgtggagacctagagaaaagtttgcctccatgttttttgttttattagaggtctgggagaaacaataacagaatggctagattaaaaaaaaaaagacattagatgactttgcagctccctagaatgtacctgtaaaatctaaaatttgatcagtgattaagcatcagtgaaaatttaaacccttcccatattgaacaaccccacttaatttaatgtcattttattttatgagatagttaataaacaggtactgtatttgatcttgtgagtgtagtcctctatatttagctttttcagctttaatggaactataattttaatcatgattattactttacattttaattataatttggtgtggcttaagtatacatttctgagagtgattgtgtaatgaaaacaggaattagcttttcattaacaaaataatgggagagttcctactgcattctagtctgtgttcaaaatctatgggctggcctaaaaatagaaagaggagtttaacattttggttaaaaacatgcttctaaattggctgtgttcacaacccagtctcttgctccatcttgctttatcttcttctctttcttttcaaaaaaattaataaacttttaaaagagactttgtgtctgagatttcaaaaggctttttcaattgtttttatttttatttagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggtatgcacaggatttgaagctatgttgttccattagatgtgcagatcttagcagaaatgcacatgtgtgatggtgcacctgaatgtctatatcatgtaccctgcatgcaagatggcatggatacacagtcataaactcacactacatacaccacataagaccttattgtagattggtactgctggggagcagatgaagattttggtacatcttcatcttcatgtaaaatgatcctttgattttgtctccttttattcttaatcagccattccttccctttgttctatagtttccagtcccacaactctgccctccctatactatacactagtttttgctcatgtattctcctcctctcaatatttgcttcatgtgtgcccagtgttcttccatgtgcctgaaacaagtgttttaaagggggccactgtggatgtgtggacagttgacacaactgcccttgtccctggggagaaacaggccctaaggatagcagattattctggaatacaactactctgcagtaggagggaaatgcttaatgaagatctgcatttgaggtattttgttttattttatctgtctgttcgttttgaagatactctttgagatgtgagggcatttttacttgaaagtgaatcaacaccctatacaacttcaatacatgagatttttaggttctgattttctcctaattgacaactgttcattgagaaccaaatgtttgccagacactgacactataattctttgggggaaagtttccctataatcttattggcagtgagaatattttcttggaatatattaggctacataatgatggcagtgaagctgctactctctgatactccactcctgaaatcattcatatccaactttgaatacttgtcagttttgagtattgacttttgtttccctttccctagacagtttaattaatcagcaactgtcctagagttttttttttttaaaaaggaagctgcatcattaaaatagggatatacatcatctttattttaaatcagagaatacattctatatgtgtgtgtgtagatatatacattcttctgttctcataattcacatgtaaatctgttccccttataaattaagtagtttgcaaaatcataaaacttaaataccactgctactttccaaaatacaagtcacctaacactccagacataattttcttatttgaaaaactggaagataatgcttgtctcaaagggcttattgtgaggattaaatgagagactagatatattgcatctagcacaatgtctactgcacagtggtccctcagtaaataaatctattattgtaagtacagctagtatgcttcaaggaaagtggccagaacagaaaaaaaagtatctatcaaattctccaaatagggccaggctttgattatcttgtaccagagcactggaacatctatccttaaacagaatttcccatacgttcagaaagccaatatttagattcctgaataatctttatataataggatgataattcaaaccaaattaaaaccagttaaccatatgattcttcctcctactcctatatagaaaatgtatttttagtatagccttaccttcaaaatacagactctgccagctatattagtgaatattattaatcaccttttcagaattccttcagaactgtagcgagatttttgagaagtactgattcatggtgttgttccttgttttctaaagacacatgtttaaacaagcagattcctttactgaaagaatgctaatttggtagttcaccgagtggatttgaataggagtgacagcttcgaagacagcctttaatttggtatacaaaaccaaaattgtcaactttggtttgtttagcaccctctccagcacaagcagagacatacagtagcatctgagcttaaagaagaagcttatggggttgaaagcagaaatacaattcaggcataaatttataattatgcattcttcttaaattcaggcccaaaaaatttttatttgtagagagcttatgggaatgaggcagggaaatatagagagagaccagagatatttgccctcatttgacagcagtgtttaatagaagtaaaacttgtggttgtaaagagtgcttattaaattcttcatttacactacctaattaattctagcattttaaattaacagtgaaactagtccctgctgtaccattccatagatgcagcatatttcctccatccacccgttgttcaggtttaattggctatgctaaaagtcagagaaggagggagagatagggctgtggggaaatggggaaggagtgggaattgctctagcggaggacctccccgaggccaacatttggggttaggtcacaatgcaggctggaagaggtgaggtatatcacaccaggcaagtggagaggctgcagctggtggttcagaagtcagggtaaatgacatcatgggtatttttgttgccctgatttttaacatcctagtccccctttttcctccaacacctcctacagatctcaatgcatctcgatcctgtgaagtttacaaggagttctaaatatccagtgggaggattggggggtgggaggtggcaaagagataagaattcaagattaagattttccagccccaaccactccctaagagaatgtaatggattcccttagaaggttctggcttctgcaatgttaaaatctctttacagagagaggaagtgactctgttgatagccttaccagcaggctagattcatccctggctgtgaattgtcaatgaattctccgtttgagaacagatagaagaaatttggtcatggagttaagtgttatgtgctggggacataaacatcaccatttatcaagcacttcatctgtgctggatacttgctaagcgctggacataccctatttcatttaacacggagcctccattttcttagatgaggaaactgaagcttggtgatttccccaggcagcatagttattagcaggtggtggagctgggagtcacccctactttccaaaagcatgattttatttggaggcatgtacagggtaaagaccctgcctaacctgcacttcataacccaatgcaacattgtgttctgctgagcagaggttgctgggcaccctctggagagtctatctaatgtaccatggctttaaacaagactcatgtgtataaagggagcaaagataacaatatttatcatcctctggggatataactcagcctttgtcttccttcagagtagaaccaaatttactgaaaatgccagttttaagataccttgcttttggacatctctgttacttatcttctcagagacattacatttttctttttccaattgggaaaggacactcaccagaataatccaggtaccagggagaagaaaggcatatcctgagttgcttttgtgtacagccgtgacacatcatggcattggaagctaagtctttagcttttcttcttcatctacctgcagcctctgctgctggggaaaacaaaggaagtgtcatgtgacccacagagttcatgcaacctagaaactcaggcaaagaacaccaaatacctggtagaaattatattattcccatggactccaaggagttgatttagtttcttatttttttgttttgttaccattttggttttggttttgttttgtaaacattgagattgccttactgaatccaagttcctatgtgatcagtattttaggggagaaaacatgtggcttgaccagggcaaggttaggtggctcagggtatgtcttgaaaccagcagagctgaattattattattatttctttgccttttttgcatttttataagtgtttatcttgttaccgccccaaaacaaataaggaaagaaaaaaaaagaaaaatctctagaaagaaattaggccaggcgcagtgactcacgcttggaatcccagcactttgggtggccaaggcagatgggtcacctgaggtcaggagtttaagaccagcctggccaacatggtgaaaccccgtctctactaaaaatacaaaaattagctaggcgtggtggtgggcgcctgtaatcccagctactcgggaggctgaggcaggagaattgcttgaatctgggaggcggaggttgcattgagctgagattgcgctccagcctgggtaacaagtacgaaactgctgtctcaaaaaaaaaagaaaaagaaaaaagaaattcagtgtaagacaacaaacagttttgacctgcctatttacattgtgtgattatttgcatcacagtgataaaaaaaagaattgtatttttacttcatgtcactctctgtgtacccatgcattgtcctttttttttttttttttttgagatgaagtctcactctgttgcccagactggagtgcagtggtgcaatctcggctcactgcaacctccacctcctgggttcaagtgattctcctgcctcagcctcccgagtaactgggactacaggcacccgccaccacgcctggctaatttttgtatttttagtagagacagggtttcaccatattggccaggctggtctcaaactcctgaccttgtgatctgcctgcctcggcctcccaacgtgctgggattacaggcatgagccactgtgcctagccacagtgtactttgtttttgaggacaggacagaccaaactgaacattatcaataacaaaactgaatctattaagagacaagtatatggaacatgctattaatacgtaagtgctataggtggttggaagaggtgaggttggtgttagctggagctgttggggaaagtttaaaagatagggtaaggatttaggtagaggaaagaaaagcaaaggaatagagctaaaattttagtcaaagaacaaaagcattttttattcctctgtgctttggacaaaagaagtagcgctggaacatgtctctttggaagcagtggtctaatatgaagcagcatggtcaaatgaagttaagcataccaaaaaattcagtcagttagagttgtaccccaatggacaaagacaacatttcctaaacaccacttctaatccgtgtcttcatttcttcctttataatacgtctctttggtttaattaatatcatttagtggaaaaagaataaggccaaataaatgaccttcactactgtgggcaagagggtggatattttgctgctgcctttgtatctgaatttacaactctaattaaaggaaccaactcagttttgatgcagtaacactgggtaacttgtgttctttcttgaatttctgaaagtgctaacaatcctgagcgtgtctctctcagtaggtgagatgtgggaaatggaccacagcggtggccacagtatctattagagcatctaggctttgagtcatgacagagtacagtctattgggttgaagaggagaggggagtgagggttctggattgttttaatgtaccttatatactttcatgtactggacttataggaacactatgggaatttggttgaattttacttctgagataactatataaacaataaaaggctctgaaaaatcctaagatataaaaattccttgaactcactcccaaaatgtgaattcagccccaaggtgagtttattggcataatttcttacaacacccagcagacatataagaataactgcaacagcttttattttttgtgtgtgccttaatatgtttactgggcactataataatgctttaaatatagtagcttatttaaataataaatcaagctatcttggagaatcataatggccaatgcttttgagtacttactgtgtgccaagcattgtgctgagatcagtagacggagtctcacataatcctcatgatggccattttacagatgcagaaacttgaaatcaggagcagttgaattactggccaacgtgacttagcttccaagttaagggaggtggtacttgaacccagcactgactaattgtgaattgtcaaatttatactttatttctggcagtttgccccaaaatactaaactgactcctcccctttacaaactaactcagcttgtatacctagggaatgaaatttttgaataccgggaaaacataattagagctcagaatcttttgttttggaaaatagcacacagtgcattaaaaagataaatttttggtattaaacaggtcactgcttagctaaacaaagaagactagacttggagtggttttttcacttctgatattctcttttcgtgaaatactcttcagtatgttcaccttttctttattgtgcaggcactgtattgaaatggatgctgcctacaatttaagcataataaaaacccagcctcatttaggcatatccaagaaaatcccaagatattgattagctaaatgaacttttctacatgcacataagacggaaagtcattagtgatgggaagagtacagcaaatggtagcatttatcagcatattttgctgctgatttggaaaatgtgcttagtacaatgtgatgtatctcctgatttcagaggaaaatcaggcagattcgcatctgtcattttatttaccacctccctgcagtcatacatattctacaaagaagaataaaagagttttgatttgttgactcgggaagagggggttggctattgttggaggtgagtggaaaatttttaggtatggagaagatttggcagcctaatggggttgcaaaacaggagaattggagtctgccttattaaggggaacttgaagaacgtcagaacgtgtagtgcaaacagtaaaccatgtaatcattgtgcttcttacacactcatcagggggaatcagagactttccatcctttctaattagggcaggttggcagttgagtggagctgtgaggtttagggtttgtgcaggtacattatgcatcttctgacacaattttttcccaggatgtctgtagtcaggattacagaccaggtatggtttccttttgcctcctggctgtgttccccttcatcttaccttccaaatcagacagttctgccctgcttccgaactcagataaccgtaggaaagtattctcacatcccagaagagatgtctcaaaggatttttacctaggatgtgaatcaggctgggtattttaagaattttctatttctgtactttagctgactgtttggttcgtaagaccaattccctgttcacgcagccttctcttcttcccccaacacacacacacacacacacccacacattcactcactcactcctcccttctctgtagaatgccctggttgattgagactaggaactaaggaggaaggtaatgtcaaactgaaatttccacacattatctaaaaatgtaattcatcagcttcagggtaggaggaaagtgctttctgaaatgtgttaatgggaaattcattttcttcttgtcttctgtgaggtgtagtagtggtgatttctttttccaatctgccccctcgcccccattccacatctccctgactgctcttaactgataaactctgtatctgtgtttattcctcgtaagaactaaagatcattaagttgctttttcgttttttctacagtcccaaaattgagctttgataggagaagatatttctagtttggagagaagataaaattcagatagagatcatatatttgtataaggtttttatatttgtaaaacattttcaatcaaccaacagtatttatttagtgtctactctctcagaccaaatagatattattccctttccttcccttctctgaaattctgtatcacagtctgtgaggaggtcaaaatggataagtcatagtttgtgcccatgtgttgctgcaggaccaacgagccagggaaaccagaacaaatgacagcccttcatgaaagtctggaagtgacggggagctggctgcttattatgcatattaactacacatctaccttgctgttttgtgggcgggggcaagagggaagtggaggttgttttgttttgttcttcaccaaggcccaatcttacttttccttggtcctggctattaatgtcattggaaggatggtgaaaaaggattcataatgatacaatgaagttggaggtttgatggaatgcctactgcgtgtcagctacagtgctaggcatattatagatgttatctcattgaagctttatatcagtgttgcctgatcagtgattttattcccattttgcagatgcagaacccaagacctagaattagtcagctggtgagtggggttagggcatctgactgcaaagtctatggtctttctgttaccataccactctgtctgtgctgaatgaagacaacatcagttatgggtgttcaaaggagaaaaagatgacaatagactgagattctcaaagcaagtgtcaaagaaaagcgagccttcaacttggccctgaatttggtagagattagattgtaggagaccagtccatgcagaggaggcagctgagcgaagctccagagacattgttatggaatgaatgtttatgtccccgcaaaattcttatgttgaagttctaacccccaatgtaatagtttttggagatagggcctctgcagaagtaattaaggttaaatgaggccataatggtagatccctgatctgataagattagtgatcttataagaagaggaagagagactggaattttctccatacatatgcaacaagcaagaaggcagctatctgcaagccagaaaaagagccttcactagaacccaaccatgctagcaccctgatcttggatttccagactccagaactgtgagaaaataaatttctgttgtttaagccacccagtctgtggtatcttcttatagtagcccaagctgcctaatacagacatcttcaagagataatgaatagaacaggcaggactactctgtcgggtaaatggggataccacctttgtgtcagtgaaatatctgaagctcagagatgttaaataatttatccagggtcacagttaataagcggtggagctgatatttgaacccaagtctgattctgaggtctgcgttccttctactttgctagtaactaactctacctaacacagaaggaagttgacagctttcagacttcccatggcgtctgtgatctgagaaccattatttatctctctaaggtgatgtacccatttgctcagtgacttgctttccacctacttaaagttcttgcggatttctaagttgagttttctgcatgtcccttattttgtagttgaatgtctggtgagatacaaggcctcataaacacaaagtggatacagctagctagggtaataactctaattcctatggccgctaatggaatttctcatcacaaacttctggaatcagattaaataattttattggtgatataagcataaaatatacacttagcaatccctgatatttgcccttagtgtttgttttcagaggcttttatactcagtacttcctttgacgagtcaagagcacttggctgcttatttttcttgctctttcttcctctcttttctttgcctggtttgttgttgttgttatattttgtgtgtgtgtgtgtgtgtgtgtgtgtgtgtttgtcctgcttcctctttctgccttcttgttttttgacatgtcactttgatccaaaaaggattttcattggcttattagatagtatggaaaaaactaaaattgaaatagccatcaatttttttaaaaaacagaatagaaggaaatggatatagaatggtaaaaggagaccagaggaaatttagtaaattaattgtggttaaatgactcaaacggaccacctagtttgagttttctttttttttaattattattatactttaagttttagggtacatgtgcacaatatgcaggttagttacatatgtatacatgtgccatgctggtgtgctgcacccattaactcgtcatttagcattagttatatctcctaatgctatccctcccccctccccccaccccacaacagtccccagagtatgatgttccccttcctgtgtccatgtgttctcattgttcaattcccatctaggagttttctttacatcaatgaaaatgaatggtgacaactttggttcctttctcaagtagttaccagaatccccacaccctctcccaccactggccctgtagccctttctctggagacaggcctctgattgtagagacacttgcccactgtaatgcaggattggatagaaagcctgaaatcatatacatggaattttcctcatctttcttgcctgggtccattttggattgattgacttgctttttatggctagggcaggcagtaacacagagaagctgcctgagtggagttcttgtttttattaatataaggtataaacaatgtgccctatggaggaggtgttctgaagcaggccttccttgcctgctgccctgaactgaggtattactgaagtattactgctttctgagtcacttcagtctttcctctcccttcagaccccaaggctggacatgcaggaacttcagttttcagcttccgtctttctcgtgagggtttctgcagtgagttctgtctggtttctcattacccagagccctgagctggacaacaaacaggaaactcaaatgtcactctcatatcctggtcctaactgtggaaactggaactagtcctcaaccacctttgctcttcccagtgcccctcaccagtcaatggacacagatcaccctctaagtacgagagagagacagcactacccaagagctccgcacaccccagcacacacacacatcccccaaacacttttctggcatgcatgtgcgtgcacaggcacacacacacacacacacacacatcccccaaacacttttctggcaggcatgtgcgcacgcaggcacacacacaaacacatcccccaaacactttctggtcagaaataccaaacccagtgcatcagactaaccagaattgagacagacttcactgaaagtcctgccttgccttccccaccccatacttgatagatgtatttgaaaccttatgtaagtcatgttatccctttggatctccatttcctcaatacacagtagagaagataaatcttaaccctaccttctttggatggtacttgtgaattcaaaccaggtgatacatgcgaaggcactttgtaaatgaaagcagtctataaatgggttgctcctatctcgtaactcctaaccacttctcatcaagggtgttagccctgggccaacagatggataaagggggaggagagggaaggtggatgtctgttcctggttcaatcctaggttatgtaattccaagtaggaagtaggagatggcatctgagaaggcaggagaatagaatggaaacttacgtttactaagcacctgctagatgccagatgttagatgccgccttatatttatctcatttaatcctgaccacatctacagtaggtacacattagtgacccccttatttagacaaggaaaccaaggttcctggagtttaatgtgactagcctaaggtcacacagcaagcaagtggccaagccggctgcatacccatgtctgtctgccagctgggacgagagaccttcacaagagagggtttcccacattcttgctgtttcatcctgagtcatgaatgtggctgtacattgtattccagtaaacctcaggaatagctgcagaaataatgaacaccaatttcagtggttctggaagattgtaaatgaaagcctttagttcaataagatgctcctccatttacagtgggattatatcctgatacaccgtcataaattgaaaatatcataagttgaaaatgcatttaatactctgataaacccattgtaaagtcaagaagtcatcataaatccaaccattgtaagtcggggacggtctgtagttgaatatgtcaggataatttctgagattttttttaaaattaggccacttctataagtggtaacatgataaagtggaaggatccactaagttcttgttctcgggctagctatgggacttttggtggatcaagccattctgtgcctcaggttgttgtgcataaaatggagataatactgacttttcgcacctttctgtgtgttgtgagatcagatgatttgctaatgtgctggtaaattcaggatattactgtggtcacctataagataggacattgtaagcaggggatttatgagggtaaaacaaacccttaaaccccctgtgataagctatctttccttcctagtctgccttccagaagttttgctcagttatctgcgtacatctcaacaaaagctgattaactctctcagacatcagtgtctaactgttattaatgctcaagctgatcaaattacaatgccacagatcctacttgtgctgttaatattagattttggattccggtctataatgaatgatttttcctccatgcattgggaaaattggttagcagagttcataagaaagtttaattagcaggctgtttgtgaaaatagcggctgtgagtcatcattcagaatgaactaacatttctcaggcttgaatttgttcttttgttccttgagcagccacataggatccttgtgtttgggaagctggtgtccacatgttgcccatttgaatggcaccatgtaataaactaataaccaaaacatcagatttaaaaaaccagagaggaagaggaggtatagggtgtttgtatatatagatatgtgtatctgtgtctgctaagggaatattttaggcctaagctaatccagcacggtgctagacaggatagtctagtgattaagagctagactacctatatctacgtctctgccttatcatttactagctgtgtaacaggcaaattcttaacttctctgggcctcaggtttatcatttataaaatagtgatactgataggattattgtgaacattaatttatgtaaactacccagaacaacacctggcatatagtaatataattcttacaggagttctgtgagatgtaggtattattagctccattttatagatgaggaaacagctgtgtgatcttggataagaaagtaacttatctaagatcacacagcttctaagtggcaaagtcgaaccaatgtttatttgactccaaagcctctgtttgtatttactatactgtactagcttccagggtcgtatgcctagttcattaagtgtagatactctgtttgtgtgtgtgtgtgtctgcatgtgtgtatgtgtgtacctatgagagtttgctcctgcttgactatccatacagccacacacaattgttttgcatttttttccttgggtctttggttctcctagtgaaacttcaggagctcactgctgactactcacacagtgagctagaaccagacttgtacaacttgtaccaacatgaaaatgtgtcttcagatgtctgactcccctccccactatgcaattctgtcctgtgtctagattatcccagaagcaagactctgtgatgtcatctgagaagccaaatcatagactgtcacagtgaaaagagaccttaaaagtactccatggcagccaggcctggtggctcacccctgtaatcccagcactttgggagtccaaggcgggtggatcacgaggtcaggagtttaagaccagcctggccaaaatggtgaaactccatctctactaaaaatacaaaacaagctgtgcatggtggcaggcgcctgtaatcccagctattcgggaggctgaggcagagaattgcttgaacccaggaggcagaggttgcagcagtgagccgagattgtgccactgcactccagcctggacgacagagcaagactccttctcaaaaaaaaaaaaaaaaaagaaagaaatactctgtggcttggtcttattttcaactggcaggattgttatttcaggaactatagttcaggtttggggaccagatcccccaccttaagtaaaaatcttgagacagtattcagtcctgtttcaaagggtaatattcatttgagaattccatctaaaaatcttttccaaaggcgcttaattgataatgttttttaaaaggggttctgtgaccaaatgagtttgaaaaactgaagtgaaccaagtttaaaagtgatttattggtggggcatggtgcctcatgcctataatcctggcactgtgggagaccgaggcaggcggatcacttgaggtcaagagttcgaggccagcctggccaacatggtgaaaccccatctctactaaaaatacaaaaaattagctgggctttgtggtgggtgcctgtaataccagctacttgggggactgaggcacgagaatcacttgaacctgagaggcggaggttgcagtgagctgagatcacaccactgcactccagcctgggtgatggagcgagattccatctcaaaataaaaaaaaaaaatggggggctctttttatcagtacttctctgaacctgtgctaacacgacgtgaaaaggaatggtataatatggagcattacccaaggaacccttttccctccagcattttgtatactctcctttctaagccagtagagaagaatggagtccttggaggataaatttgagggtgggagacaaggaggcagtttgcaacagttcctacatgaagacctcatttatttcattaagaaagaggggagatcttctgctgccccggggtgggcaagtaaaagcgttggtgtcctgggaaagtctcacctactcccaggaggaacagaaaatgatgccatatggatccaaactctagcatcagcacagtcccatctcacactaggcatttttttgaaaattattgagtactgagcacgttctgggtatgattcaaaccgtgggttcatttggtgtcctgactgtcagggtgacattccattttccattgcctggaagagctgagccattagaaggtcttcgtattttgcaatctcactcgtattcctgggcactccttcattttcacatctgccacgtacttgactccatgtaatgaagctggtcattcttgctttgtgtagccattccccaagaatcccgagctttttagaaaatcaaagaagatgacgttcccccgcaatttctaccctaaagacctatttctgcatgagttgttcttgggtttttatgtctttattttgccttatttcctacctgcaagttaaatagcaatgaaaagggaaaacatacttttgtttcttgttttttttcttcttcatggatctgggaatttctttctttttaaacatttgttgaaatcaaactaagatgttagaacatggtggtgagcttcatgcctggcactttactatcagcgaactcctcgatgataaggacagaggtgtccatttctgcatttcacacagatattagtggtagatccaaggccagagagcaccttagtgttatttcagaaaggacacgctgacagaggttttcaaagtccttcagctaacatttggcatcctgacttatctctgtatggacaagttatttatctcatctccttgagtgagagccataaatgtctttcactttgaataaggcagttttaatggatttatattctgttaatgtttatgaagtattactctgtgccaagccctctcacataacttatcccttttgatctaaatcccaacatgatatcaggagcttctacatgcgctttgtaagaatggtgtctggtgggagttttagaagccattgtcttagtgttaaatatagcagttcctttcatgcacagacatttcacccacagaaagtctcattttgcccaaaggctaattacagtgtatgtaattagtattaacctgataattttttctatctcttcctcttttgttgctaaaccctcgtggttaacatcagctgcattgctggaatcacctgttggtttgcatccactctgggtggaatgtcttgtctatctgacacccagacctttgtttcatgtgagagtaagccaaccaagaattaggaattctggttcatttttctggctagctgggagtttgccaaaatcatcctctttttttttcaacccttgttaaaaacatttttaaacgtgtgactattctttcctgtcttgtaagaatattctgaacataatttaatttaatgttgcttcgattaagaatctttcattgccccagggtcatcagtctgaatactccttctttttgtatgataaatgctgaaggtgagatagttgtcactgaggcttctattgtcctagtgcactacttagaatatcttttccttttcagtttttttttaactaagtacttgataccagcttttatcttacaaatttcctttcttttctgaacaaacagaagaaaaatcaagttcagattagttcagtttttcgtttattgaggtgtatttttgaaatgtgtatttaaagatctgtcatttggagcaatttattttatataacaaaccaaaagggtgggggagtggaagacaagaaaatacctcctttgagaaatagttggttggcctttcttttgtttgttttttgagacagggtctccctctgccatgcagcctggagtgcaagggcaggatcgtggctccctgcacctcctcctcccaggcccaagcagtcctcctgcctcagcctcccaaagtgctgggattatacatgtgagccactgcacgcagcagttggcctttcttaatgaatagtgtagctttgtaattggtctttctgcttttgggactgctagaaatgaatgtatatagtctgtgcattttcatgttcagagacatcattttacatctgtgtgaacaatttggctatcttctctgaaatcagaaactctattaaaggcctgtatgggctttggagctggatggatgttcagatcttggaatctgaggcctccttgattataaattgcaatgataatgcttaccttgttggattgctttagacaatagatgaaatgatagaaataaaatgtttagtatactgactggcactcacaaaatgataactgtttttgttactattcattcacttattgaattcattcattcatccatccattcaacatagatttcttgaaaatctactatgtaccagacattggtcataacaagatccatgtgggtcataataagactcacgcgcccgcccttaaggaacttagggtctattgagaaatacattcagttcaacaagcttatattaaatacctactgtaggccaggcactttgcttgttgccatctttatgccacatgatgagtacaaacatctacttaggaagccagaatataccctctggaaataaccaaggactggcccaaggtaattttaaatactttgggaattcgggtcctgggtttgttgttgttgcgttgatgttattttgagagagagtcttgctgtgatgcccaggctggagtgcagtggtgtgatctcggctcactgcaacctctgcctcttgggttcaagtgaatctcctgcctcagccacccaagtagctgggaccacaggcacatgccaccacacccagctaatttttgtactttttgtagagacagggttttgctatgttggtcaggctggtctcaaacccttgacctcaagtgatccacctgccttggcctcccaaagtgccaggattactggcgtgagccactgcacccagccagtcctgtttttttaaacaatattgttggcagagagcagacacactcaaaattacagatgcttaaatgcttcctgaatctctgccagagatataaggagatctcatatacacatctgagaatggattcaacttagaaatggtattgacagtacaggttgacatcaacaacaagtggaagtgatgactataaatttcgtgacagttctttcttctcgaggaatgggtgctcattgtgtcctctccttctggaatgctctactatacctgttgcccttgactgcctattgcctggctgtctcctgtcaattttttcaaattagtctcaattcagatatcacatcctccagaaagccctctctcatctcactattgtaacacttaactatactctactatcactgataattcatgagtctgacttttctactagatcatgagctccttgcttctttctttgtcctcagtttccacatctgtagaagggatttgaagatggctgatactaaagtcttttccaagattgtcattctatgatgtaccagatccagtttgaaaggcacagccaagttgggagatgggaatgggatactttgggatatatattggaattaaatgggagaacaaagacttggagttggtactagaaaacccatgctctctcgccgggtgcagtggctcacgcctgtaataccagcactttgggaggtcgaggcggcagatcacttgaggccagaagttcgagaccagcctggccaacattgcaaaatctcgtctctactaaaaatacaaaaattaggcgggagtggtggttcatgcctgtaaccccagctactcgggaggctaaggcatgagaattgcttgaatacaggaagcagaggttgcagtgagcccatatcatgccactgctccccagcctaggtgacagagtgagattcagtctcaaaagaaacaacccaaacaaacaaccgcatgctctctcaaagtctcaggcatactatgctaatgtcaggtatttagcatacaaatgagcacatattcaagaaaccagggcacagcagaaagtacactggctctagagtcagatgggcctagccactattttctagacaagaaagctacttctccctctgggccgtaatgggccttaatttcccctttagtaaaacagatatcaaaatacctgcttcagagggttgtaaagattatgtaagtaatgatataagtgaagtgcttggcccataatgcgtgctcaaaaaatatttgctattatttttattttctcagttagaaataagtataaactgaaacccactatgagcattgagtctaaaataaatataatttagaacctttaaagggatcttatgggtcagtcttacctactgctctagcatcctcagacaaatagtaggtctggcttctgtttgcacatgtctaggcatggggctctcgctacctcacaaggcagcccaccccttaaaaaagcattattagaaagttatccttttataaaggcaaaaatctgttccctaattttcttccactgcctgactctcattctctccttcagggccccacatagcaagtctacccttattttcccatcatgacctttgaaaatattagaagggactttgaggtcaggcacagtggcacatgccagtgctttgggaagcctaggtggaaggattgcttgaggccaggagttcaagaccagtctgggcaacacagcaatacaatataaaaaataaaagaaagggctttggatacctctagagtcttctctccttcaaactaaatgcccacaggtctttcacatgtgtcttatgggatcgggttccgcttaccaacttcctatggacatgggtaaggctctggtaaaaaaaagattttgctgcttttcccggtccttttatgtttggtatttgggagactgaaggtagttaagagaatgtaaatatccatgtgaatagataatattcattagtttacccaacaaacatttactggatatccaataatgtcatgggccctttgttagttcctggggaaagagaaatgaataaagcagcatcttgttcccatgttgctcccagtctagcggggaacagagtacacattaccagacagttttcaaaggatgtgtcagtgagaatgttcgcctgatctgcaagactgaggggagggggccactgtagttttttcatacatgtcttattcagcagcatggtaattcagattgaagaaactaagggtgcccctttcctcttttcagtcatttgacaagcgtgatgatggattgccctcacattcacttgtgccactgctccaacatgccaagcacgttcctgcttcagggcctttgcacatgagattccttctccctggaatgcccttttctctaacagaagtgactggctaccacccttcaatcaccccagccctttccctcagatctctgctctaacatcatgttagcagtgaggccttacctgaccatctgtattagtgagggttctctagaaggacaagaactaacaggagatatatatatatatagatatagatatagatacacacacacacacactcacatatatatgtgtgtgtatacatgtatatactatgcatatatacgtatatacatatacctatatgtatatatagtatatatgcatatacacacattacacgtatatatgtatacatatatacgtgtatgtatacgtatacatatatatgcataaatatatgtatnnnnnnnnnnnnnnnnnnnnnnnnnnnnnnnnnnnnnnnnnnnnnnnnnnnnnnnnnnnnnnnnnnnnnatacatatatacttatatatgtatatacatgtatatgtgtgtatatatacatatatgtgtatatgtgtgtatatatgtgtatatgtgtgtatatatgtgtatatatatgtgtatatgtgtgtgtgtatatatatatgtgtgtgtgtatatatatataaaggggagtttattaagtattaacatacacaatcacaaggtcccgcaatcggttgtctgcaagctgaggagcaaggagagccagttcgagttcccaaacagaagaacttggagtccgatgttcaagggcaggaagcatccagcacaggagaaagatgtaggctgggaggctaggccagtctctccttttcacgtttttctgcctgctttatattctaaggcagctgattagatcgtgcccactagattaagggtggatctgcctttgttaatctcttttggcaacaccctcacagacacgcccaggatcaatactttgtagccttcaatccaatcaagttgacactcagtattaaccatcacaggtccaccccttgtcagcttgaacccatacacatctcttgaggttataaataatcttcaaataaaggtagtaataagctcatgattacacctaacataatacaactatccttcaaacaaccagaaacgcacccatccccaacccaaataccattatactgagttaacaatacttaaatgctgatatgaagtcaataaatcttatgtcacatgataaaggaaaaggaaataaaataaagacattttcttagtacaagtgtatacatgcacaaacatgtctttagcaaaagaaggaggaaatacccatgacaattacagtccctgtttctgtacccatttgtattccctttgccttcagcaagcacctcagcaggtcatggtttttttcctggtggaatgacccaaaccttcattcctgaggtgtctgggccatttgcagtcctgcctggattggactgttgtagcttcccattgaccttaatcacagggcgtggtaatactaagagacaccctaatgaatctcctgtattccatgtatattcttccttacctccattgtggagtagtagactaatttcatcttgatagtctgggtcaatcaccccagccaacactgcaactcccttcttagcctgttgacttaaaggtaggaggagcccaaagtgtccaggcagcaatcttaacttctagtttaatggaattgttattgtgtctcctgttggcagcgttcctccctctggaactaagacctctaggccagcagaacgtggtgttgcaggaacaggaacaaaaattttgctagtggatcactagaggtgatggtgagtggtgccacttccacttccaccccttgattcctggacccatgaatcctggctatgggagaaacagtaccatatattggacactgattcagagcatacacagccttctggagaactttgccccagccctgcaaaatattgtcacctagttggttttgtaattgtgacttcaaaggccattccatcattctatcaatccagctgcttcaggatgatggggaacatggtaatatcagtggaattccatgagcaagagcccactgctgcacttctttagcaataaaatgagtgctttggtcagaggcaatgttgtgtggaataccatgatggtggataaggcattccgtgaatccatggatggtagtctcggcagaaccattgtgtgcaggataggcaaacccatttcgggagtaagtgtctattccagtgaggacaaacctctgccttttccgtgatggaagagagtctaatataatcaacctggcaccaggtagccggcttatcaccccgaggaatggtgtcatatcaagggctcgatagtggtctctgctgctggccaattaggcactcagcagtggctgtagccaggtcacccttggtgagtggaagtccatgttgctgagcctatgcataacctccatccctgccaccgtggccactttgttcatgacaggggtggctggggaaagaggctgagtggtgtccacataatgggccattctatccacttaattattaaaatcctcctctgctgaagttacccattggtgagcactcacatgggatacaagtatcttcacagtttttgaccactcagagaggtccatccacatacctctccccaaatttctttgtcaccaattttgcaatcatgcttcttccaagtccctgaccatccagccaaaccattggctacagcccatgaatcactatataattgaacatgtggccatttctccttctatgcaaagtgcacacccaggtgcactgctcaaagttctgcctactgggaagattacccttcaccgctgtccttcagggatgtcctagaaaggggctgtagtgcaacagctctccactttcgggtggtgcctgcatagtgtgcagaaccatctttaaaccaggccctagttttctcttcctctgtcaactgatcatagggaactccccatgaggccattggcgcaaactggggaagagaaggcagggtggcaggagtgtccccagcttcatcagggtggcaggagtgtccccagcttcattaggatcctcccacacatccccattccaagtttcagggtcccattttttccaatcaatgccctcactttaacagtagacacctggcgaggctgtgcatgcatctttagttgcgggtcagccactcacatgataagagctcatgtctgtttttccgtaatttcagctctttctctacaagagataagactctcactcaaggcaatctcagtagatttgaagctcagtatctgcttctgaagctgggagacagaatccctgagttcatcattttctttcatcactttgtccactgaacttaggagcaaccaaccagcttcattatgttccttggttctccacatacagtcaaaggtatcatgtatagagtcactaaactccttgccactcacgagcggtgaatcaggagtatcaaattcatttattttgcataacgctctaaacaggtcatgccaaagactgtcaatgttctctgtgctattagaagtagagttcttagcattttggggtctaatcatattaagcagccaactccaaaaatcccaaaactaattaaagaactccatccttaatattctgttcctctagaaccactcctggtaccaaaatctgtattagtcagggttctttagagggatagaactgataggagatatgtatatatatatatatatacacacacacatatatatatgtatatatatatatataaagaggagtttattaagtgttaacttacatgatcacagggtcccacaacaggttgtctgaaagctgaggagcaaggagagccagtctgagtcaaagaactgaagaacttggagtccgatgttcaagggcaggaagcatccagcatgggaaaaagatgctggatctctgggaggctaggcctgtctttccttttcacatttttctgcctgctttatattcactggcagctgtttagatggtgcccaccagattaagggtggatctgccttccccagcccactgactcaaatgttaatctcttttggcagcaccttcccagacacacccaggagcaatactttgtatccttcagtctaatcaagttgacgctcagtattaactatcatacctatttaaaaaccatcataccttttaaaaatcgcaactccaccccctacactgcctttccttcttctctgctttattttctccctacaactcactatcatctgaaaaacgttatattttatttatgtatttcttgtccatttccctcaaccccaatcagaatgtaaattcagtgatggcagaaaacaagtaggttttgttctcttttatattcctagtgaatggaatatgcctggtacataacacatgctcactaaatatctgtgggataaatgtagtacttagattcagccctcaagttcgaatgtcatcattgtgatagggaaactctatcaaaactctgctttatcttcaaagcccagctcaaatgtctccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgtgttttccttctacattataagctccctgaatgcggggacaattttttggtcattttggggtctacccatagtgtctagcatgtggtaggtgctagttatatgtgggatttgtgtgcatgttaaatattatatgctccaatgtaaaagaaaggcatcagaagcagcctctaccttcaagaaggttgcggtttcattgaggaataacattcacatagaccacagtgtcagacagtatcttgtggggcatgagagaagaaggaaaaggaaccaacatctattgagcatctgttttatggcagcgactttacatgcattatcacttttaatcctcctattaaccccttgaaaaaagtaatattagccccatcttataaatgagtttattggagcagaaagacgcaaagtaagaatgtaaattctggggacaaaaagaaatagcatataccaagaaattctgagagctttcccatcagagcttcccttctctgttaccatgagttgggtgtgtagtatccccagaaaccaaggcacagggaggttaatttaacttagccagagtcacacagcagtaaattgaagaactgggattcagacacacgtctgaccaactccaattccctttctttccagtgtttctcatcatactttaaaccaatgcttcttaatccttcatgtgcatttgacttacctgaggattttgtggaagtacagattttgattcagtaggtctgggatgggacctgaagatctgcatttctcacaagtccctgggtgatgccagtgatgctgatacaggaaccacaccttgagtagcaaggttttaaaccattcttaagctgggcatggtggcctgtaatcccaacactttgagaggccaaggcaggaggaatgcttgagcccaaaagttggagaccaggctgagcaacaaaacaagacctgatttcttaataaacaaataaatttagccaggtgtggtggcatgcacctgtaatctcagctaccctggttgctgaggtgggaggatcgcttgagcccaggagtttgaggctgcagcaagctgtgatcatgccaccatactccagcttgcgcaaaagaatgagacaaaacaagcaaacaaacaaaaaaaccccacatacttagtttgaggaaattgtgtgaatgaccaaaagaaaataaatcctctgactagttggctgtagtaacactgggcttgcaggaaataagccaagactcattgtaagcctctcagaggtgggatgggagggaacaatcataggtgctccagaaccccaagggatccccagtcagtgtgttaagaaggagaagagacccccagtgcaagtgaatgtatccccttgagtaactgcctgatgccagacactctgctggacacttaaacttgggccagtccctgtagagagaaagtgtgaactgagatatccaacagactggagttcattcaaatcctagcctcagagcctacttgctggttgacttcagacagattatttaacatttctcaagcctcactttccttatctgcacagtaggcctgatgatacccatttcacacagaattaaatgaggtaacattaataagccacttagcacagtgcctggcacaaagtaggcactgaataaattgtagctgctattagtccccatgttaatataatcttcacagtgatactttgattgtgagaattaagggattatctctgttttttccagataagagagcatactgataaagcttaaatgacttaaccaaggttatacagcaagtagttttgaaccacacacacattgatacatgcagtaacaaccattcatctgaccctttcttgggtgtgtttgggtagatttaagcctgctgaaagcaagaaagacctctcagaatgggcagtgaaggagtcccaggatatggagttggctgcaattaacctagtatgtggattattgccatgcaggtaattttgaggtgactggggattttatcatgcactttcagaacaggatttcagcctgaactaggggttctaacttccataaaaattccttactcaactcagaagttttcaacagcagctacccatctggctgcctcctcaggggctttgtagatgaggggagtaactgttcggtttctggagaatgatggtttttaaaaagcgaaagagcaaggtgtgcagattggcagtgcagaaatgctgaggttctttctggccagcttctctactgcagccatcaaccataaggatgtcaggatcagaataatctccaggatcctaaaggcaaggaaaagctacgtctatccagaatggctgggaaaataaggggttataaccagctatgctctcaacactttctagagattaaatataacaaaaatgcttaacacaaactactggagataatttactctttcacagcagattccaaaagcctctgatacatttcagggtctcagaatcattgttattataataacattttagttcaaatggagtaactagttgtggcagagagtacaggatttgaagtcaaatgatctagatcggaagataacaatctacagctcatgggccaaattgggccactactgcctgtttttctagaaaaagttctattggaacacagctacactcatttgtttacatactgtctatggctgctacacaatggcagagttgtcagggaccctaagacctaccaagcctaaactacttactgtcttgccctatacataaaaaagttttctaacccctgatccagactatgatctagctctgtgatcttaggcaaatcaccattttctctgaacttcaatatccacatctataaaatgataattatctctcaaacagggttgttgagagaatcaaatgcatagaaggatgggaaagcattttgtaaactcagaatctctgtggaaaggtggataagggtgatttttgttgttcatctgatctgtgccagaggagaacctacccaggacatttcttgtttgtgttttgttttccagcccccggagtcagtttattgttgtgtcctctctttctcacaaatgcaaaattaattccctgggtaccccctcttttccccctcttcccccaaacttaccaaacattctggttatatgctttcagtaatggaggactggtacaaatgcatacatccattctttcatttatcaagcatttgttgatgacttactatgtgcaaggatagaaacttttatgagctagttattatgggaagatgtgttttgtttctaaggggaaaagttggatatacaaattattataacagaataaagatgttgccatgtcatagtaggaggagacattgtgtatttgtgtgtgtgcctatgtgcctatgctttataaaaacagaaatattgaagttcagatttaagagcagcttgttaaaaacaaaaacctgtttaattcaaaatactctgaagtgctttaaagtgtagccattatgtatagcagttttctcttggaaagtacattctgaattataagtttccatctcaaactgccaagaatgcatttcctgcccatgcatgataactggtgaccattcacacatgcctgctggacaggattattagggactggtcacagtaagggttgtaggtcacctgggcaccaaggggccaaatgctcactatagtttctaaattttggaggcagtcttaatttcatatctcattttttaataaagaggattcaataaacgtaactttgatgatttcctttttatttgttcaacttcccatcaaaatagactcataaattgggaacaaaaatacagcttgttttaattttctgttctgaaaatactgttgccatccctatgttctcaaatcttgctactgctgataaagggagaagatgtagccatttggaaaaaaaaagaaagagtaataaaaagatattatttctggaatacagatacagatacactagctctgggctccagactggatccctcaggccctcccagcatagcatttctcttggtccccatagaaaaagtgttgctattttttgtgaatgcgtttcatctatttttttctaggtacacttagcatacagaactgcaaatataaaacccatcaccaatatatggccaccaaaattaaaacataaaatttttcctcattttactctcccttactactgaaatagtttctaaaagaagtaaagcttgggtttttttattttctacatagagatttaatcctctacaggacatgttaaaagagaatgcttagatccatagagtgctttttattagacttagctgaactcctatgatggtgagaagcatgttaagaaaacctgttcatgaactaggctaaccacaggtagtttcattgtggtaccagactatctcatatctttcaattcacaggcaagtttttctgcctctgtcctcctcttgttctatgcaatgttctgttttagagcttgaagttcattatttcatatcaaggagaatcatcatcatttttcctcttcctttctgaaatgatgttcatctgttttttgtttgtttttttttttttcattttcccaaaagcaccctcattcttgatgttaaatgcagtctctctctaaagttagagcaggtgataacacagttgtgctaattgcagtcaggaactaaggtgatggtggatttgggactgatagaagcaggtggcttgacatgatacatcttgctgggcagggctcctttccctcatttgaccttcagaatcttcctaggacttgaatgtattttccttcctccagaagcaaaggtctaaaacaaaaataaaatatagaatgtgaaaattatgcccattatatttattttagattttcatcaatatatgagtaattttagaaagatggatagtgtgtcaggagcatgtaccactcgtaagcatgattcctccacatatattccatcagtataaataaatcaagtactactccaatgtgagttaggtctaatttttgctgttaagtggtgttttgtttatatttttcataatttattttaattttacgcaaattaaattgggctggatagattgaccatctgaccagtttcctagaacttatgcataaggtttatcattgagataattgttttaaaaatatcctttaaaagcagctcaacttggtgaatgtttttaaaaagtgattataagaatacttttgtacagcaatttttaaagcttctcatatatgcaaggtaaatatgactgagaaatttgcatgatgaaaatgtatttaattaggtgaattatttagctaggtttgatgaggtgacaccaaatttcggataaatgatatttttaaaccaatgaaattggtctctgtatttttgtatttgcaaaatgaaatttctgggaacatatggcagggtcttgtaattcacctccccctgcccccaccacacgtacacacacacacacacacacacacacacacacgccactcacacaccatacttacacagtgagatggaaagagaagggtcccagcagctggagtgcacccagcattctctccttcctcttcagttactaatcctggctggtgaagggcatgtctggtaaagtttgcccctgtctttcttcttctcaccctgttcttccaaaacaaaggaatatcctaatggaagtgtcattttgggttttccatttggggtcaaatgccattgagctttcttgtgattctctttgctccatcctataacaaagtcacccattttctcatccagaacccaacttgttttcccaggtttcctcctacaaccaacacaaacacagacatttaccagcaaaacagaagctgttggaaagattttttggccgctgaaatgggctcctgtcaccaggacatggcaggctttttgctgtattatctcccagccctggcccccgtactccaaagagagctttatgtaatcagtctttgctgacatgtgacgtcctgtcattttcctccccttcggctctgctgccgcccacaaatcaataacattgcttgggaagttcaggctggttttgcagccaccccaagctctgtgtttcttaaagggtatgtcagaaaatgtaaagtttcctaatgatatttctggctgatgacacatggcagagctgatggactatttataatcagtggcacgattgcaagcacattatttttatttcacttggggggagccctgtcacttgctacctctctttgcagacaagttgatgccatctccacctaaagtagctaaatcctcttttcagagtttatttgcactcttagctttgtgttaggagctccctagctctttccagtagaaaccccctctcctttttctttattgttctttggctcagggaatgatgagggtaaagaatgatttgtagcaactgctttgaattctagccatgcctgcatccttaactatacacatctccagtctttgctactcaagtcttgctacatccctctgaatgtgggtgtggctggcatgaccgaggcaatagacactgctactgtgtccagcacttgcctcaattttacaggcctgagcagagcatagctgtcttttgttgagcacctactccaatctagacaatgtacttggtaggcattttatacacaatctctcactctctcaaacctacctgaggtaagtgctgttatctccagaacagagattggaggtgggagggggagagagattaaattacttccttacaaagtcgcacagctgatagggaaagctctaggactccagtttaagtctcttctgacaaaccacacctgttctctttccgctaccatgtcctgcctcttcctgattatgtggacacttgtgtatctcttgtgtggctgtgcaggggcacttacccagttttagcttgcacagctcctaaagtttaatagccaatgagagtgagagttggaggaattggaaacctctcaatctgggggtaaaccctggtgtaagaggaactgtataccaaaggagagttttgactcactgcagtgggaagtgttgcctctataaagatactgagcatgctctctctctctctctttctctctgtctgtctctctctccctttctctctctctttttaatatttccacaggacagagtttagggtatggatttgttaactatattgatccaaaggatgcagagaaagccatcaacactttaaatggactcagactccagaccaaaaccataaaggtaagaggtgatgtgctggctcctgattcaggaggctctggttaaatttcattctgttgatctggtaaatccaggctatgtgggggctggaagcagtgttcttgatttattcaaagaacatttaccatccactatactaaatgggagacacagagtgttacagaagagtgaggtgagggttgagtagagggaagggaccacaagctgtgagacctccaattaagagggcagatgggatatttgggattcaagaccccacaaagagggcctgtgagcctgagtctgcaaagatggccagagctgagccaagggaaaaggctgaggccaggaagctgttccaggcagaggaaacagcacatgcaaagctgtgaaaatgtaagacgttgtgagcagggacagcatataaatagtgtggcctaagtttggatgggaaggtgaaaagatgaggatgggaggtggcagggccaaatcaggaggctttgtgtgccaggctgcagcttggctttacctaagggtggttaggaccctcctaatcgagactcgaaaagggagcatcagttataaataaacgcaccagtgtaatagggatgggtactataataaaattgatgagaacatagtatgggaatgacagaaaaagtaacatttcagcaatctgaaaataattaggtgggtagataatatctcaggaagggttgttttaagtcaaaaaagaaaaacagtaacccagagcctgctcctctagaaggaggtttaagtttctgtcactggatagtcatactctgggtccagacttcacctgtgggatccttcaggaggtagtgctgtttgccttgggggattcccttgggcagccggtggtggtctagtggatggagcctgcctcctcctcggccttccttccctttcttcccctacctccaggcagcgtcctgcttaggggcagctgccagccaattaatgagtccccatctttcatagcctattaaactgcagggaagtgtctcctgggcgctcttatcctcacgacagcaggtctgacgcaaagtaggacaaaagagaaacctctcccagaatggaaatctatagatggcaccagctctcagcatctgaaaacacaaaaccagaactttttagtccaacaaagctacttttccaacatccagcctgatagaggagactactggtataagataatcttagctggaaggtaatcaaaacaaaaacaaagcaaaacctttctctttttagaatatgtgattatctttctttcttttttaagcagctttacttttgcaattgagtttagcttatttctaaagatgattgctttccctgatctcatacagcctgatacacaaagatcccaaaatggacctgattcaggctcctcagtctaggcttagaatcatttcctatgagttctctaatgaggaaataatcaagagttgtttaattatggggtagtcctctgagaggcaggaggattaatttctttcaaagtaaaaacatacctattttcatgctttaagtaaagacggatgctcatgtcacctgactctttgatgaggccacactagactgagagctgtatttgtaggtttgattgattttctgtgctatccagttcagcattagaatgtcagatgtctactcttcccttgacagacaccctgaccttgaactgaaaaaggtacttttctttacagttttcttgaaaccccaactcttctccaggggcttaggatcaaataatcaactttccattttgcttttttttttttaagtattccataaggccactgtggttccccaaagactgagtagacctggcttttctggtctcagatgtaccccctagcccatcatgccatcagatgctttatctaagtggatcttagagacaaggatcattgattattttctttctgtaaagagtcagtctgcctccttccgttatctatattcctttccccaccccctcacccaccctgtatcaaaacgctgccaacacatttgcacccagcggtaatgtgggcttctgagacactgtaggattcaaaatgcacgatgccatggctgaatcaataatttccattctcctctacaaatgaaaatttaatgtgcaaacctggggacttcagccctttcattaaagcagtttatttgctgtactaaaaattaagtttgagtgataggttcctttattaacttttcttcccttttctaaagggacacaatgtttaaggtaaaaatcatattaaaggaaagaaaaaagcaaaccccttttgtatgctgtttaatagtctcatcatttattaatttttttaaattgcttttttgtctttcaggccactgtttacctctgcttcagtttgctttgataagtgacatgagatctatctctttgctctgactcccatgaaggaatagttaacttgcctatctggaaaaaaaccaagtatcttctttggaagcgtacattacagaggtctcaggaccatctagtacatgtttgtgaactttggtcaaatttccccctccttttcaaatttctggagtgcaaaacactctactttaaatgttatgcacaaagtaggttcaggcaaatcaatagttaattccaaagctgtgaaggttaatgattaacagctggattcagggaaggttctggaaagctctaaggcatcggtggagactgtagtgagctgtaaagaagacagctattctgctgctgctgctaactgtttaaacccagattgttgccagatctaccagttgtccaatacacatgaaaatctagatttttttcctgccaatctcccaatttttaaaagctagaaaataactcaaagaattttaagaattatgtaggtgggccaaacagaacttaatagttgaccttttgacaggcagtttgcaaaccaccccccaacccacccccaccaaaaaaaaaatgaactcaaatttaaatatgaaaacatcgttttgccaattggtagtgaatggctcattacaggtccactacaggctgagcatcccaaattggaaaatctgaaacccaaaatgctccaaaatttgaaactttttgagcacctacatgacactcaaaggaaatgctcattggtgcattttagatttcaagtttttggattaaggatgttgaatcagtataatgcaaatattccaaaatctaaaatttgtggtcccatttctgataagggatactcaacctgtactaggaggtacccacaaatgatggttcccagtcaacaaatatccatttcccttttattaggggcagtgttacatgactctgtgtgaatactgacagcattcagagagcaatctgacctctgttctccagaagcatgcaatctaggcatcggcacagcaccaaagcagagaaagagcatgatgtgtaattaagcttccaatgcatagtgtggatggtgactccaggggaattgttctttgggttataacttctttagtgggagaaagttcccaccacacatcttggagatcaggctcagagacactaagtgacttgtccaaagccatacaacaggccagcagtggagctcaagttagcttcaaaagggcctctgaaggattctgccagaagaggagctgcttaatatgttagcatgagcttgaaataataataataaagattaatagtaatgctaatttatagtgagtattcactctgtatccaatactattataacccttttacatgcttgatatcatttcatctttgaaatatccctggagctaggtgctttacacacatcaactctaattcttaaaatagccctgtcaggaggtactattacctcctttatacaggtgaggaaactgaggcccaaggaggcttagagacacacccaggatgacacaattgataagcaagacttggagtaagaaaaaatgttctaaaaataactctctggcagtaggtcgtaagtgttggaatgtcacactgcctgcttgctcagcaacacgtgcattctgtgagggtgtgtgggtgtgtatttggctctgtgcacacatgggttatactctctggcatgggaaggagaataaaaagcaaacaaatgaattgtgtgtctcctccaggttctttagtaaacagacatggctcagggcttctgccatcaacctagggacagacctgacttcatttcttcttgggtccctgctttccaggctctgtgctaggtcctcggatttaggtgaatcagaaatgacagtgccctagagattcttccatccatgtgagtcagagagctatggagtatggaccatgggcttacattcactagcctgccagagcagcctggaaccccacttaggaaactgggtcattgttcagtgtttcagccctgagcccagcccagtggagatgacttgcctcatgtaggagtttgggatgctatttgtttagctttgtttttggtttgtgtgtatgtgtgtgtttgttttgttttgttttgttttgtttttttagacagagtttcactcttgttgcccaggctggaacgcaatggtgcgatctgggctcacagcaacctctgcctcctgggttcaagcaattctcctgcctcagcctctggggtagctgggattacaggcatgcactaccacgcccggctaattttgtatttttagtagagacagggtttctccgtgttggtcagtctggttgcgaactcctgacctcaggtgatccacccgcctcagcctcccaaagtgctgggattacaggcgtgagccaccgcgcccggctagctttgtttttaaaagtcgtctccaatagggatcattttagactctgcaaatggctgtggattctgaaaaattattcctggtactccttgaccccacacctgatgcctgtcccaggcctgaccttctgttgggctccaaaagaacagcttctgaatttacattgtaattttatccttttactaagaactgcttcagtgaagttgcatttggtccagctctgtcacattaatcaggaacaaagaaaattagtaccttcaaaagagaaatacgtttaccaaagttttggattgatgttcaaattacattgagaaccttcagtaaaaagtgatccaaaatggaatgtgagggtttggtatcacacccactaaacctttcggagtgttgggacacctgtttgcgttttgacctaaatgtcaggagtaggattaaacaagcgttcactgctggctctgcctccagaagctcctgtctcatgggggacacagacatgcaaaggaccaactctaaagcagtgggacagggcagtcatggggctgcagaggtttctgtttgatattggggttggggagatagggagctgtgcaaggtttgagtgagcaaaagatctgatcaaagtaaagttccaagaaagttcatctgtcaacgacgtgccacatagaatgtttgacagatgaaaccagagcttgcaggctgctgtggtaggtttttgtcagccttagacattggttttcatcagctctattaggagccttatccactcatttttaaagcaaaacatgcttctttgtaaataatttggtatgtacagaatcatatcatgaaggcaatatcagccattcctaagccaacagtgttaacatttttatatatttatatatttccatccttttttttttttaaattaagacagggtctcgcttgggagtgcagtggtgcaattccagctcaccataacctccacctcccgggatcaagcaattctcctgcctcagcctcccgagtagctgggattacaggcacctgccaccacgcccggctgatttttgtatttttagtagagacagggtttcatcatgttggccaggctggtctcaaactcctgacctcaagtgatctgcccaccttggcctcccaaagtgctgggattacgggtgtgagccactgcgcccggccgatttccatcctttttttattgtattatatgtgcacaaatgacttagtgacttacctttttctaataattatattaagctattacccaaaggattaaaatatgattttaaatgaaatatttccagaggacaggtattgtgagtgattgcagcactggatctgggatgaaggggtaaaagagctgctcctgccactctgagcaaatctatgagagttagcactcaggcaggcagccggtgagagaataagaaagacacttagccatgaggcagtggcccaattctggagggagcaggagtagagaaggggaaggtgtgtgagggaaggcttttcagaaggaaacaccttccttctctgggaaggagagtgagctccttcatttccacctcttcctgttgtgatgctgcttaaccacttctccattttcgctttattcttctaataccactaacagtgcctccgggggtctttccacacttgagctttgcaggttccagtttgcccctcccacttctttctcttgccaggggtcgtcagggagctgcgcctccccctctcctccctgcatccacctgccttgctaagggcctccattccgctgaggcatcttttctttgcattcggcataagcaattatttctcctatcactgctcttaatgcttcctggagagttagcagatcattttttgctgatggatatcaccccacacagaaatgatggactgcctccctcagtcttgttaatagtaaaaaggcattttctctcctcctccattaccgctagtcacaacctgggcgagaatgcttctctgccaaggtcagcaggggcggctggatcactgaatccccagggagccaagagagagcatgtggcaatgccagcagaaaccagagacacgtttaccccagttgtgctagcagccctctcttgtgggagattttatttggctgctctgcttcccagtgccctgttcacttcctttgagtgaataatttcaaatacaaggataggagttggagaaatggaaatacaattcccctcttctctctgctcagtgaaggtgatacgttcccagtatcttgaagttcattcatagtgtcctgtgtccacatctaaaaaggaaattagaccggtatgggttgggaaggcacaggttttcagaagtacatggaatggggtctgggggctttagctgtcttcaagtgtaaaagaagccaacaatgtgatgtgagctgcttcaaaaaaaaaaaaaaaaatcagcacaactttagttgtgttgggagaattatggactccatatcacagaaaatagtggtcctttcttgtccactctggtcagcccatcctagtgtcttatgtcccattctcggcttcatattttaaaagattgtctaaaggtgaatgacaaagatgggaaagaagtctctgcacccacccacagattcacctcacaatggttgcttttctattctctaggaaagaaaattctgcagtgaccctgaggcattagtttgatcctatatttcaagaatctgggaagagaacctgtgtagctatcagagtagaatgtttgccttgggtggtaatgaggctccgatcatcggaagcattcagatgaactcataagggatgatgtagacaggatttcagtcccacagtggagtctgactaaatgatcctaaaggtcccttctagctctaagatgctataattttgtgttatttctgattgtagagctgctctgtccagcatagtagccactagcaatatatggctatttatatttgaatttaaattaattaaaatttaataaaattcaaagttcagtttcttagtcacactaggcatgtttgaagtgctcagtagccacttgtagctaatggctacctatattagacagcacagatagagaacattttcctgatcccagaaaattctgtgggacagtgctggcctaaaacatcagtggccctgcggattaaagactcatttctccatggtgctcctgcagcctctgggcaggatggctggtctgtcagtgatcatagagcaccacactcctcttccttctccccttttgtccattcaaaagagctctgagttcagatggaaagtcaagttccagctctgtcaaaaactgctaaggatgaccttgggcaacttactttacttctttggactggtttcctcatctgcaaaatgattttttccagttccaacagtataactaacaaattatagtgtgatctttctggcttggtaacctttcagggaaagtaacagtttgtgccaagcacacggcttttatttcactgtctggattagtgtgccatagtggaaacatcccagaacatggaattatatcccagtttgtctcttagttcagctgtgtgaccttggataagtacttgatctcactgagccagagtttgtcatctggaaaatggaactaatgatatcttacttgtagggaatcgtagcttacagtggatgctcaagaaatgctccccaggatgaagatgatggtgaatggtgctatccctaaagtgaacattacatgaggagagggggggacttttttccatctacatgtttcagtgatgagtaagggagtaaagaatgagtctgaattttactaagattcgggcaacatatataaaaagctttgtataggggaaagtattatgaagcttccagctggccacagtaatcgtatcagtcttttataaagcaggagccaggagttgcagtctagtgaagagactgaatctggggccctgagcccaagaccagatattccactaaccaggccatgagacctttacacagctctcccttctgaaggccactagatagacagagagaacttagtacgtactaagtatgcctctttgataatttgatagatattttaaaagaagttgcaagacacatgaatctatcgtcacatcttttctattctttaaaagaaatacttgtctggcctactaggtgccagacacccttatgatattcgtagataccctttaactgcatgattctttctggcttcttcatcacatcagagtcagctcttagaaaagaagctaaaatccgcggcataaagtatatgatacatttcatttcacttgagagagcatttttttttgagctcttgccctgataaagctttgagactaggtgccacaggggtctatggagatcaccagaatgctcagactcatagggcaggtaaggtgttatcacacttgtagtgcctgggatctgggatcaggatgcctgtagtgggaggtagggtaagtgtaactattgccactgaaatatactgctgtgtatcttctgtggagtcaaaggagaggagagtcatttgtgcctgggactcgtggaggaggtggcattcagtatgggcttagaaagatgggcaggagtttattctgccatgatggtgaacaaacagcaaaacaaagacatagaaatagaaattttcgggacatattcagaaaactgtgacatgtttttgtctgaactggagcatagggtgcatgaaggggttggcaggagatgagaggttgggccagattccagagggctttgaatgcccaggtaaggggtttagactcccatcacaaaatggcacaatcggaactcattagaaccatttccatgaagtttcacctctgataaaagaatagcacgtatcaggtggcaggtaggggaagtgtaaagagtggtgctacataagcagatgcctgtcctgcctgtgaacaggcctacagccacaggcacagaggtaaactgatcctcacaatcaaagctgcggtttccaggaaccagttggcttctttcttctgtccctgctcctagaggtgggattgtaggtccttgagaggatttgttcctagaaggccctggcagcatcagaatctgttccctgattccattctcctcatctccccagggacttgtctgctctggggagtttgtatgcactcagagaaaagggtgttacaacagattggggaaaatctgcagcctgatcttctgaaatgattggtttgtgtgtgtgtgtctcctctgctagactaatagtcctacatgtcagggactgttgtattcatctctacacccttggtgtctagcataaggcctgattatacagcaagtgtatcaaagccattgtttattgagcatttactgtgtgccaggcattgtgcctagaagtcttaaatgcattttcttgtttaaccctcaaacagctctgtaacagagcttctaaactatgtattcaagtgatgcagctcagaaaggttaagtgactcaccccatagtcacacagctaataacggtcaggtttcaagtccacatctctccaaccccaaagcacttgctcttaattgctgcctccttttcattctagagcaggtgctcactttcagttaaagtaacataaacaagaacttctttggagtgatttgtctcaaaatatagttacccaatactctaactagcacctatcaatgagacccataggataaggggtggtaaggacagaaaagatggccctggggtgtgaagctagaataataatagaagaatggaagctacaggggagacagatgtgaactcagtagaaggaaaaacttttcaacaattaatgaggctgggcatggtggctctcatctgtaatcccagcactttgagaggctgagacgagcagatcatctgaggtcaggagttcgagaccaacctggccaacatagtgaaatcccttctctactaaaaatataaaattagctgggcatggtggcgcatgcctgtaatcacagctacttgggaggctgaggcaagagaattgcttgaactcaggaggcagaggttgcagtgagccaagatggtgccactgcactccagcctgggcaacagagtaagacttggtctcaaaaaaaaaaattaatcatggccagcaatagtgtaggatgcctcatgaggtggtgagcttcctgtccttggaaatgtatacattgaatggtcggctgtcttggatcatgccatgaacttttggggccacttccagcaccaaatttctgtgaagcagatttcaggaatataactttctgctgagttccccattgccactgtatgtcacctttatgtgacacttactatgtctccacttactatgaaccacagttatagaaatttgcagttttgtgaacagaatgcctggctcatgaaaaaaatccagtcaatgatagaggccacgtcattactctaatccacaggggcccaacaaatggcgttgctgttttccacatccaagttctaaaccaattgagaagtaagacaaaagagaaaagtgtatggaatcctaaggtcatctttattgccaattaaggcctggatgggttgcatggacacagtgggctccataacactgaactttacactttgacagactgacacaccctgtcacaagtgctctagaccccacaggccgagagcagagcctgcccccataagactgagagcctggaacagaatgtgtgcttccagctggcgtctggctcccagaagggaagaagcaggcagcatttgagcctcacatgcccatttcttttattgaagcctccattcagaggagtcacttcttttccctggggaagagtggatgaagggatagcaataggcctggtctgttgctgcagggggttctctccacatggaaggaaacactgggagtgggaaatgagtatctccctgttggaagcagccctctgtattgcatgcttcatttgtttactttcctttccagactgggattcgtgaagcagagacattcccaacacccatcccagggcctggcacatagtagatgtttaggaaggggaggaatgaatgaactcccatcttctaatgccagtgtttttctaaaggagcaattttctggggctaaaaaggatgccttttccctctcattttatcctcctcattgcacccaacatgcctttatcgtgttttccatgtcctctcccttttctgtattatggaggacagacaaggagtgaggtattgctggatgattcagggaacattcttcctcaggtcatgctgttcttcccaccctgcccaggccaagccctgtgtatgaacaggtaaagggagttgtgggtgctgcatgggaagaggcagccctcagccctcgtcctgatgccccatctgtgatgaatgacaacgcctgctttacccaccttggtgagacttgctgagagcagaattgggaagtcactttggaaagtggaaagtactttgtcggcataaagcagtgggatctgtggaaatgtgttagaggacattcatgtcagtaaagtggtaaaagatggtccagaccccaccagggtggcagaggagggcagtgcctctacaggcattccctggtagtgttccacatgttttttttgtttgttttttgggggtttttttccggtgaaattggagggtatgtcccaatgggagctagattcccaggctggcccacaaaagcctgtatgactcatcacataataatatgtgtaagtatctactaagttctaggtatgtgctagacaaatatatcaactcagttcttacaataacccatcaaaggataattgaccccctttttacgagcaaagatgttgagacttatcaagatcaaattacttgcctaaggtcatgcagctagtgagtactggagctgacccacagtcagggatcataagcatgatgctatagcatccttctggtggaggatgggaagactgtgagcaccagggatggggagagctgaggagcttggagggacttcagatcttccatagagatcatctgtaaagtcagctgcttacagtcacctggctttgagccacccctacccagagagaggagtggcttcttcactcccagccctttctgagttccagaaggaggtcagtgctggcctagagatgccagtcttgtcttcagagattctggatgaatgaagcaaacaggatcctgactgaggcaaggggggttctccagggcgctggctccagtgttggaagccctgtgactccaggccactggcccaggggcattaatatgccatcaatgctgaccctgaaaattggcaattttttggaaatctttcagcctaaccaagggcctgaccactgtagtcattcagttagaatttaatacatgtatatggaaagttgaaaattttagatactaggatgaacatttggatattcaatgcaggaagatcttttttctgtcatttttgtttatccatacgccacaggtttcatggacaggaaactgagagaacaatagacttaaggttccatataggtgagaaatactaaacaggaattagacttggtagagaatgattgatgtgctgttcacctttgggatttgttgctgcctttggggatttagggtctgtctctggagatgtgttgcagtaattctccctagctgagattctacctatgttggaatcaacttttggggaaatggtttttgttgtgtcaccaactttcaagtgccagctcctcttccctggcagggttcaccctgttccctctgtaccctagctctggctgtgcggaactaatgggagttaaggtcatgactatccattatgcatttattgggtgccaggtactgtgctaagcccttgatcttcatcacctcatttgtcctcgtgacagaggaaggctattatcaggccaccattacctgactccaccaccacctttctcaccaccagtctcagctcagctgtgtctccttcccggcccttttaacctttgattaatctctccctcctctgtgttttagtcacactcatatgtatccctggcataacacacacatcttgtggcactgtgataattggtctgtatgtttactcatccattcttttgttcaacacattttattgagtgcctcttatgtgttgtctgttgccctctttggacttggagttcctttacagcaagagactatgccttgttcttgctgtgttgccaacacataccactgtacctggctcatagtagatcctcaggaaatatttgctaagagaaggcctctatgtgaggtctagtcctagaacaatcttctttcagtccttccagccccaggcattggaaaatgggaaatatgtcccttagctcttagcttggtggagaaacacagctgggattctgggtgcctgactctcagtggtccaccttactggagttacagttaactccaaagagccaataatatcaacatcatttctcatgagctgtgggtgtttattcattttttcagtaggtgttgaacactttataggtatcaggctatgtgctgggagctagagtcacagagttgaataggacacacacacacacaagacctacaacctaaagagatcatcagcctagatggagaggtggtcagttaaggttgaaacgggttaagtaccatggttcattgagaacactgctggggagatttttaggagaaggtgagattagagaaagctgcctagagaagatgtcatttgatctgagccctgaagaagagtaggatttggacttgaggaagtaggtataaaaaaaatgtctgtatgagcaaaggtataaaggtggtaggttgtgttttgagggagcacaaatgtcattcggataattaatttgtcagtaattggcaaggtgaaacaagggtgaccctcattgccatgggcatatcactatgatgtttttatttccttcttccacttcttcctcttactcaaaaaatagttctgctattgacacactttgtcccttaaagaacaggggtgggagaaccttctgtggagtgaagccctgtccagacagtcacatggggttcttagtctttcagcccacactgcaaatgcacacactgggaccccctatataaaggcccctctacatctcagccatgtgctgagaaggagcccacagaggcctcccagcccacccgtgagtttctagaagatggagatactgaaggcagctgcctcactccatcagcaggaggaggccagggaggcagattagtcactcacatcattttatctgttgagtcaacatctatttttaggcatggaacccataaagggacctggcatgtctgtcatggaaagggggagagtgccatggatgagggttctgctcatccttcatcttctttgctagacccattctctcccctgaaggtcacagaagcagggtccacattactgctggaggtttaggtcttaatgtcaaaggtctggtttaatgtgttcaattccttttgcacacatgcttttgtgtgcacgcacacacacacacacacacacacacacacacacacacacacacacacactctcacccctacagtcttaataggtcttatgaatcagttgtatggattaaatagaacttccaactgaaaaacgctaaggcatataggtctcttcctgtccaacgttgtcagatgtgctctgaaatgactgttttcatcatctattctgagccataaccaccccagaaatagctttagcaggaaagtgcttttgttagactagctgtaaattatatttcaaatgtctgatgttgttttcttaaaaaataaataaataagtaaatgaaagtctaaaattaatgactgctggggtttgctttgcttatgtgtactgctacagatttggcttcttgcagatggaatttcagatctgtttacacttctgtgttagcttttggggggaagaaaagcagttgagagatctgggaggacaaatttacaaagtcgaacttattataaccattggtgaggctctcttctctctctctactgccctttccctccctcctttccatcttgcccccattttatttgttgtggtttttatctgccctgcttcaaagttagaggcgactggtccttgcagatgtgacgacaaggtcacatatccagtttcgcaagcagatgttcattcagccctatttcaccagcactttgtcatttggtgagagcagacctcatgggaacagactggagcaacacaaaggatggaacataaaaaaatcttgcagagaacctgattgcttttatgtattcaggaagaaggggatgggggtagggagggtggcaaggagagaaatgtgcagagcagaatttcatgaggtttttttttttttttctggtttattcaaagattattatgtgttggatacagtaaatcatctatacacccacttccaggaggtaaatcttcagaactccatgtgtgggtagctctgcatttaacagctgccatacagtagctattttgttctgcacttagagacccttatctgtgcatttgttttaagttattgtcaactctcctgttgttcctctattgttgttctcctggttctcattactattacaagggtagctaaaaatctgaactactgagtgatttaaactgacaccatgagttgtaacggtagatgaggggctgtcatcttggttgtggactcagcatctactctgagggtgattgcctataatggaattagctcctcttgccttttcctaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggttaagtgtttctttgtaatttctttccttgtatatcaatgtcatcagccctgttactcataagagcagaaggctgatggctgcttaaagcagatgatatggatcatgaatagacagatttttgacttggaagaaagacttcttatcggtcaactgcccaaatttaaaatgggccatcttgggaggtaggagttctccatcatgggacttgttttagcagcagctaaactacttgccagggttgtaaaaaggattcaggcatcaggctgagagtggaactgtatgaccttcaaagtctgattcagccctcaaccaaataacattacttttgtatgtgaaaagaacctgtatgcatagctgtaactccaattcatagcattatagagttagaaggaattgtcccatttcacacttgaggaaacaggttgaaagtgggggatctgactccccaaagctagttagtagcagtacaaggatctgaaccgaggatctggtactggtgttctttgtccataataaagaaaggcagccaccacctctcagtaagaaatgtcaggtactctgggttgcacttttaatgacaaggtgttttcgcctacctccaatttgattccaatttagaactcaccccctgagaatagtttagcacgtttatcatgtgattcatgagacaaaccttcacagaagtctgctctgccctagacattgtgcagagggaccctggagaccaagaaagaagcaggcactgccccacccttacaggactccagtgtggagtccaaatacttgctagaagctgtcaagtgcccctgagagctcaggagaaggtgtgccatgcctggtgggaattgctaggagggccccattgaggaggcaatgtttgaataggagtttggaggatgtttcagaggtatccagcaaaaaggagggacagagcagtgtaagtggagaggagagcatatcccaaggcatggaatcgaggaagaacagtctattcgaggaggatcaggcagttcagggtggctggtgtgagcctcaatagggaatttggggccagattgccagaggcattgaatgctgtgccaagaagtctggactttatctgggtgcagaatggagccatggaagggtattttgtaggttttgtttgtttttcattttagaatgggagtcagtgaagaataggtactatgcacaaggtacaaaattcaaaaagtacaaaagagatacagaagatgtttttaaagcatatcatgtggtcagagttcacttttcaaatagattgcacactagctacatgtggaggacacatgagaagactagaaactggacagtgagtgatcagttatagtaacttttgggaggtgatgatggggcagagcagtggtagaggactagaggggccagatgcaagagagccctgtgttctgtggctgggaggcatcagtccagagccatgatagcaggaatgcaggtaaacgtgttttgattggtgagagagatcagggagctgggctcagccctggcaccacaggtgggcttactcctcacacaatatccacaggacccatctcttcccaaagatgtttaccagtttggtgtgttcactctttacaaaggctctttctctttccccaggagtgtccagaggggtgggattcatccgctttgataagaggattgaggcagaagaagccatcaaagggctgaatggccagaagcccagcggtgctacggaaccgattactgtgaagtttgccaacaacccccagccagaagtccagccaggccctgctctcccagctctaccagtcccctaaccggcgctacccaggtccacttcaccaccaggctcagaggttcaggtaggcatgcccaaagaggaagaagccctgctacaggggttcatagctgggcaagagccagggaagcccatggtcctgacaaatggggcaagggtaaaagcttccacccccaggaatcactgtgcaaaactccccccgagcctcagtttccattcctgtaaaatgagacagttggagcagatgcccttctaagccctcttccaatttactactgtgactgtataaacttcagattctttggtagaaacaaaatgtctgtatttaaccaaacatgaaggttcagtttcaacaagagttaatcacagatcagtgaccacattcagcagattagacttaaggctggacagtggcttttaataaattcaaaaaatagaccataaggcagatccttgccagaaggagttgtttttcctatcttcttttccctcggcaggtaactctgttgagttcaggggagggggaagtgcctttggtgttaaccttattatgttaagtcagtagattctgggaagatagggaggaagatcctgtccaagcctgattagtgtttccttcaagtacccaacccccaggaagctcctggggcaggggggcattgcccttctcctgggacttttctaaaagacaggtttctctccatgaaggcagtatgaccttgactggtctctattatacaagagataaaaatatgtttgacttacccatgataaattctaaacaattactttattccacaccacagcccagcttccctttgatgaaaatgtttttctctttgagaaacttcacatgggaaatagtaggtccttctatctaggatagtatgctccatctggctacatgaggagaaaaatcatcctctttcgtgtcctcctatgccctgtgaatttgaaatggttaatgatttcatgaagagtccaagtcatctaatttttattttgcttgagagcacatgcagtatttatgtaaaaagcctctccagcagacttctaatggtggaaactatcgttactactgccctatggtgtgaatagcttgtccccaagtaaggtagtgaatgtgaggaagattatagcgtaatggcagtttgctgggaggtgctatcaggcagtaaacagtaagccactttttaaaaatcttaacctgcaaactccccctgcctcccaaaaatgtgtgtagtaagatgatttagttaatgtagcaaggctaacagaaaagatctgttctgatacatattgtgtgcctgtgtattgttaatctggaacagagacctttatttacaagtttaattatagtaaaaaggtgaacaatttaagaagcccccgctttgaacaatttcactacaatataaaacaaaatccacacaaatgttctgagaggtggggggaatggtattaattcagaccttgaaagaaagggagactcattagacacttgctttaaactctagcaatgacctgaacatgaattacttgcagttagagacagaaaagggggaaactaccggtggatagactcctaagcagtggggaaagttgttgagcttttcttctttgaaaatggagcattcttattaatagttccattgagcgatcttgccatctgtgaggcattaacccagagaccctccttctctttgcaggctggacaatttgcttaatatggcctatggcgtaaagaggtaattaaaactccacagattgccagatgtccatgttggcacagactggggctagaattttttttttttaattcactaactttactttaaaagaaaaaaattcttcctttttcttccaccagcatgtcaaattcttaattttaatttcggacctcagttgattttgtttcttttagggcacacaaaatgtatttgtgtgtttcactttttcttttatttgcaggtgggcttctcctatggttcaggtgccacagctaccaagcccttaataatctggtcctttgaatggctcccctaaggggaaaggctccgactctttgctggctggttttgcaaacttgcagagcaaactgttttgcattagcaatgccaagattcagttaagagggcagattccagcaaatcagaattagaacattttgctaattgtggttgacaatcttatgatttttcagtagaaaaattagattttggactaccagctctggccaaaggataaacaaacacgtggatgactttctaactcctgcccccacttcagtgtgcatttcagagcacatcctgagaatgaagtgtatctgtgtgcacctcaaccaggggtttcttttgttacaggttttaacagttcttataaatcctcccttggttatatgttatgtgtgttttaaacttgctgttcctgtcactgaaaggctttttgtggggttgggggcccagagtcaaggcttttggggctctctgaatgcagattcaaagttttccagacccagtatgaaatctgaatcttggaaagttgggtgtgtgatgtcactgtgtccatgagattcccatatgtgcttctgataagctccactgcactgctagggacatagtgtcttcatcatcttgctcagtagagctgcacactttaattccccttcctacagtcaagggaaagagatgtagtctttaatagtccacatcacactcccagttctttcactggccatccatggtaagtaccctgactctgggaactggtgcatggtagaggaagtaacctgactgcagacttcactatcagaggaccggcctttcaaatctcaatcccagcatcaatgaggataactatgaattatctccacatttccagcacactgtttgcctgttcccagggattttacatctttcctagctctatctcattcctttgctcctctctgatgttagtgaggtagtgctaaatgttgtgaaaagagaaatgcttataaatagataagataggggaagacacagctgtagtaggcctgccaccacctcctccactgccccacccagagtaaacatcactagctgataatagcattctcttttcctattgaacccagatttggatttagaacgcttcctaccaaaatgctgcaattaactgtcaccaactaggatagaggctgtacttgcaatctctttgctggccctgacctttgacttataataaatacttagctgttttctacctataaacagaaagaggtcagttcaccagggtcaactcacttggttggaggatagaatattaaaaagacaatcttcagaaatgatacaagttacaaatagacatggatttgcacgtctaaggatctacaccatgatattttttggctttttcttgttaattgtttttaaacaagagggaagattgacttagtgaataatagcaaaaatattgtctattgagttgttatatttagcatatattcagtagccatttgattatccaaattctagttagatacagaactattctttaataggactttcaaatctccaagaatatttgcttatttttaaaaacagttgtagctcacactttacaccatgctcttccctagtttttgctttctctccttttcctatctcccccagtaaaaccctggccaaatgaaaagcaagaaactattcagtgtatagcatcaaaaatccgtatataagctcatgcctgtaatcccaccattttgggaggccaaggtgggtggatcacctgaggtcagaagttcaagaccagcctggccaacatggcaaaaccccgtctctactaaaaatacaaaaaaattagtcaggcatggtggtgcgtgcctgtagtctcagctactcaggaggctgaggcaggagaatcacttgaacccgggaggcagaggttacaatgagccaagataacgccactgcactccagcctgggtgacagagtgagactccatctcaaaaaaaaaagaaagaaagaaagaaagaaaaaaaaagaaaaaagtccctatgtaagtttgatatgaaacaaaacattaacaaatattgttctgctataggcactggtaacctaattgtttcatctggtacatccctcacaaattacacaaggatttatttcatcagacagtgaatagaatttaaagggtcattttttcttttcaggattgcacaaaaactgagaagatttctaaacctaatacaaaagcagttgtaatagggcaaataacaattctatgcttttctaatgtatagcgattcaagatatataaatgcacaaaccacttgcagtcttgcttcagtgatacttaggaataaattccagataacatagcataaaggagtaatacatctttattattattgcttgagtttgtgggggaaacccttttgaataaatgctaaatgaaacatgaaccacccatctgtttaatagcaagaaaggcctgttcattgtcacgtatctccatcctcaccaagaaacatttgacaaccgtaggtcaagggagtgcaaaaatggtagacttaagcactttagggccatctcctaatctgcctttaaaaaaaaaaacaatgaaatttcccaagcactggccaaagtgagtcacttattcaaccaataaatatttattgagcattttctatgtgtcactatatctgtgagattcccatatgtgctccactgaataaacaaatagagccacagaatgaatgaaatagaccctttcctccaagagcacattgtctattgttggggtggggtggagtcggggtggggtggagtcaggttggggtgcgctatgagcatatactgtgatagaactgttacagagccttgctctgggagccctgggagtcccttatggtttttagaaattgacctaggtctttctctcagcatgaacatgccctagccagtcaagccattcccatcagaggaaatgacatagacattagtttttacattttggtttttgaaccctgaagactctcctgtaaacactcactcagccctctgccccatgtctgtgtctgtgcatctgtgtgttatccttggtcagactgatgtctggaccagtccccccttctgcttgttcccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgttt

SEQ ID NO: 16542 - DNA, 92581 bp, Human; identical to SEQ ID NO: 12182

SEQ ID NO: 16543 - DNA, 12268 bp, Human
tagctttatcaccacaggaagaaagctgaccatcattgccctttatttgggcccagttgccatggttacagccctttagctaaattgggaatggtaaccaaaataacatttgcataacattcccttgttctgcccacctctttgcacatcttcaaatcaaggttttggtctgatcaccatactatgctgtagcctacttttaggaagtactttaggctaaatagatttgtttcatttatgctaaatgctctcctggacactaccatactcagcatattcctggaaatactaacgaataatatacctttaaaacacccggcctcaacagataagatctatgatctaacgtttttattcttttcacacattattattaatgtgtcaggaatttatgcctcaaggcacacttttttttagcaaggacactaccttgttaaggaaactagaattgtatttctacatgtccttttgatatataacattttatggtatttagactttgaaattgaattgcaactcagatcctatttttattgttgttgttatccagcatatcccttggtttttgcatgtactgtcattaaccagtgctttggggaggattcgttgactaggatttccaaaactgaaaatcattgattgataacgtaaaatgatagaaaattagctctgactttagccaggtgtttaaaacatggtttgttttttggtacaatgtgttgtgcagaattattcagctaaatatagactatacattagtgagttcctgcagtagacatgccaacagctatcttgtttttataattatttacaaacatgacttgatataaatgcacttctgttcaaacctaaagtttccaagcaaaccacaattatagataaaaacataatattaaatcttcatgttggagaataaagatatttgggacttcttttaagactcagagacttgccgggcacagtggctcacgcttgtaatcccagcactttgggaggcagagatgggcagatcacctgaggtcaggagttcgagaccaacctggcaaacatggagaaaccccatctctactaaaagtacaaaattagctgggcatggtggcgcatgcctgtaatccctgccactgaggagggtgaggcaggagaattgcttgaacccaggaggctgaggttgtggtgagccaagatcacgccattgcactccagcctgggcaacaagagcgaaactccatctcaaaaaaaaaaaaaaaaagactcagagacctaattctctgttttatatcgtagcatttctctcctagaagcatgccatattcaaataactgtgctgtaagctttctagccatgttgttgtgccttacagaatcactgaaatacaagcactttttcttgtagaggggatttattgaagaataaaggaattttaagtcaaagttggtctacctttctcattttctggacgtttgtgccagttagtagttcctttttctaaaaaggcagcagagcattagaataaattattaaactgcagtctacaaactgcttgggaagtatttctctaaaatgttttttttattatttattaggtaaagaagcagctttgaatctgagcttcatatcgaaagaagagatgaaaaataccagttggattagaaagaactggcttcttgtagctgggatatctttcataggtgtccatcttggaacatactttttgcagaggtctgcaaagcagtctgtaaaatttcagtctcaaagcaaacaaaagagtattgaagagtgaagtaaaataaatatttggaattactaatttgtcattaaatcattctatgctgattagcttcataaacattgaactttttgattttatagccacaatgctgcatattcatactttaattcctaaagaataatttttaatgttaaaacgtgataatgcaataaatagaaaaatgtggtttacaaaataaaaacggtcttcactagttaccacctgaagtaagatgtctcgtttggaagctaagaagccatcattgtgtaagagtgaaccactgacaactgagagagtcaggaccacactttctgtcttgaaaagaattgtaacatcatgctatggcccctcaggtaggctgaagcagctgcacaatggctttggaggttacgtgtgtacaacctcacagtcctcagctctgctcagtcaccttttggtcacacatcccattttaaagatcctgacagcctccatacagaatcatgtgtcaagcttcagtgattgtggcttattcacagctattctttgctgcaacctgattgaaaatgttcagagattaggcttgacacccaccactgtcattagattaaataaacatcttttgagtctttgcatcagttatctcaagtctgagacctgtggttgtcgaatcccagtggactttagtagtactcagatcctcctttgtttggtgcgtagtatattaacaagtaaacctgcctgtatgctcaccagaaaggaaacagagcatgtcagtgctttgatcctgagagcctttttgcttacaattccagaaaatgctgaaggccacatcattttaggaaagagtttaattgtacctttaaaaggtcaaagagttatagattccactgtattacctgggatactcattgaaatgtcagaagttcaattaatgaggctattacctatcaaaaaatcaactgccctcaaggtggcactcttttgtacaactttatccggagacacttctgacactggagaaggaactgtggtggtcagttatggggtttctcttgaaaatgcagtcttggaccagctgcttaacctaggaaggcagctaatcagtgaccacgtagatcttgtcctgtgccaaaaagttatacatccatctttgaagcagtttctcaatatgcatcgtattattgccatagacagaattggagtgactctgatggaacccctgactaaaatgacaggtaaaaatcactctttgcttttgcctcttacagttaataaatcacacttttttgagcagagatatttttggtttgtgtcactgttaacatcttgaaaaattgacccagcatgtgtcagtatcatttctggcagcaaaggtttctggaaaagatcctgtattgttcacatactaaaaatgcagtgattatagccattttctatgtattttcagccccctaatgtactatatcatctaacccccaaatattttacaggttattgagaagtctaacatccccataatcctaaggtctttcatactttacacaaaattcttcagcctcaattgacaaaacttttaaatcatgttatatttagaaagtaattttgtaactagaatgaccctttttcttcactttgtcataattccagcaaacttctgtacttctccttaagtagttgtttctaatgggagggggatgtacatgcacctatgttttacctatatcaaaactgttcccacctgaccttgagaaccaagatcatcttttactttcagcacctattacaggcctggcccactgtgggtgttctaaagtgtttgttgaattgaccgaaatatatttggtaatatacagaactaaaataggcaaaaaattcactgtattttacaaactcagcaaattaaaagcagatataagtactgttagagccaaagaaaaatgacaagctgaagagttcctgatgtgagctacttttcagtatcctttaactgctttgacaatctatcagaaagatgatcatttagtctgcattgtttccaatttttaagttactagacttaaaccattgttaaagtttatttaataaaagtcttagtataaattatcaaaaaggagccatatgtatgccaagtgttgaatacataatatctctgggttattgccctaccttggtaagactcaaatgactgtcaaaagtagagtttcttaataatggaaataattccttggaactcgttgttggtatggtaagtcagactgatagccttaaatatctactagctttgcatgaatctggcaatttccagtttgtgaatactgggtcttccagactcatttttaaaatatgggacactttagctgggtgtggtacatgcctgtagtcccagctacctgggaagttgaggcaggaggattacttgagccaaggagttcaagtccagcctgggcaacaaagcaggactacatctaaaaaaacagaaagggctgggcggtggctcatgcctgtaatcccagcactttgggaggccaaggtgagcggatcacaaggtcaggagatcgagaccatcctggccaacatggtgaaaccccatctctactaaaaatacaaaaaaattagctgggcatggtggccgcacttgtaatcccagctacttgggaggctgagacaggagaattgcttgaacccaggaggtggaggttgcagtgaaccgagattgcgccactgcactccagcctggtgacagcaagattccctatcaaaaaaaaaaaaaccaaacattttcccgtagaaaccatattgtaactgggggctgggtttccacactagcccataatatatacctaaacatggcattaatagccatagctttagtcctggatcttgggagcagagagcttttgagaaaaaaagaaaagggggaaaactaccaggcacatagcgcaggtaaacttttaggtagatgaagtatgtttttggccttacctatctcccctggtaatctaagttaacattacctcatttcaggccttcaaacaaaattcctgtttattaatgatataggttgtgtagtgggtgttactgtggatgggtgccacatgtgaagcatattgcagcttacagaggtttttgtttgttttaaggtggagtctcactctatcgcccaggctggagtgcagtggcgcaatctcggctcactgcaacctctgcctcctgggttcaagcaattctgtctcagcctccctagtagctggaactacaggcacacgccaccacgcctggctagttttttgtatttttagtagagacaggtttcaccatattggtcaggctggtcctgaactcctgagctcaggtgatccacccatctcaacctcccaaagtactgggattacaggcatgagccaccacgcccggcctggagcatttttaacatttgacttggtttgatttatttgtgaagtatgcattattatccccacttgcctctcatgtgagggaggcagaaaagttaaatgacatgagtgacagcatccagtggctgataagcagtagagccggtcttctcatgcagaatctgttgttcccaccatgtgaaagaaattatactataagattttgggttttttacttagatcacttttttaaagtattcattattcttgaatatttcagaagtaaacaatattcaaataagtgaaattgtttagtgattatattctataaattttttgagatggaagtgtttttaggcattttagctttttttttttttttttttttttttttgagacaaagtctcgctctgttgcccaggctagagtgcagtggcgcaatctcagctcactgctcactgcaacctctgccccccaggttcaagcgattctcctgcctcagcctcccaagcagctgggattacaagcacctgccaccacgcccggctagtttttgtatttttagtagagacggggtttcaccatgttggccaggctggtctcgaactcctgaccttaggcaatgcccgcctcagcctcctaaaatgctgggattacaggcatgagccactacacccggccgacattttagactttcaaactaaaccccattagtttgaaagaaaccatcttttaaaggtgagtctgaaagaaaaggaaactagctgaaaggggtgaatggctcagaattatagctttagactttagtattgtttcttgtaggagtttgatgtaggtttcttttcttacataacttccattacgtttggagatttggaaaattcaagtcacgctaacttctttattcatatttttacttgtggtttataaaacttcactattttacatgtgcaggtaggaggacaaaatacttaatatatcaaataatagcagtgaaataagcatgtcactttattttggcataattcagttagctattttataaatagttgccagacaaaaaaataattcttacatattcactatgtagcgtcccgaaggaattcaactacacaactatttggatagcagcatttattttaaattgaaaataataatgcctttaaaaaaaaatagcctgtcacatcacccgtaatccaaattagtgaagttcttaatttggggtctctaaaccctgaatgggctttgagggttttctgaattccttgaaaatgtatgcaaaattgtatgtgcccttttctgggaagacagtacaaaatgacttctaaaagattttcaaagagatctgtaaacaaaaataacttctactttactttatttgtatatcattttaatagcagaatataacttagcagtttaggaatattcatcttatttatcctgtatttcatattttaaattatatgcttgtggggcttttatgttggctaggaataaatatacttttaaatggttgtttgctccacttttgcttatacaacttgtattttctaatctttaaaaaataggaacacagcctattggatccctaggctcaatatgtcctaatagttatggaagtgtgaaagatgtgtgcactgcaaaatttggctccaaacatttttttcatcttattcctaatgaagcaacaatctgcagcttgcttctctgcaacagaaatgacactgcctgggatgagctgaaggtaggtaatgaactttgaattccatatgcagaggctgagggaggaattagtcactcaatagttattatgatttttttttcgtagcttccctaggtagtatagaaagcaaaaattaaaatgattgatgcaaagtcacaagtaagctaatttaaatgcctgtggcattataataaatttggcatgtgttgccatttattatttctactatttactagaaacctaaaaggcccttgacatgcgaacttttctaagaaattagcttgaattgtgtagtctttgatggtaatgtgtatgaataattcacttggaaaaatgagttccccagtcaatacccatcatccacttcttagcagagtttcctgttctctgccagcaataatacatgcaacttttatacaagggaaatgataatctatgggattggtcacaagttttaaagattcatgtatgctcaaggatatatccttagtaaatgttaaaggtctgtgtgattttttatttattattgctgggatgtaactgtattatttccaaatccattcaaaataaatttattatttagactgaaatgatttttttagtggaagtgtcagcaaaccttgttgacccagatattttgaggccatatattcgtctcagtttgaagagctaagtgtatatgaaagaaaatactaatctggctccgtgaaaacaaacttctgactgaagtatcttcccttaatctctaaaccttactattcagaatgtattaatcacatgacaaccttggcaccacacaagttttgttcttttgtaattaaaatcacactctctgtattcactatgatgctttgagagcatgattttttgtgtgttaatatgatgtgaacgtctgattctgatgatttgggttttttcttagctcacgtgtcagacggcactgcatgtcctgcagttaacactcaaggaaccatgggctttgttgggaggtggctgtactgaaactcatttggctgcatatatcagacacaaggtatgtaagataatcctcttcggattacctgaattctcagcaacttttgttttctgagataataagccaaaatcataatatcctatagtctttttgttagttttaacttttaggttcaggggtgcatgtataggtttgttatacaggtaaacttgtagcctttaacactgaatttttcagtagtctaaataaagtagataatcaaaaacacttgagggaaataacaaggtaaatataaggtaatatccttattacaatgattattataaaaatatttaagcaagcgatcacgttctttgagtattgtctacatgttctgcatgttgaagctagcattctgttattgggagttctcttagagatctcaactgctgcaatacagtaataattgatgttcacaaacaaaagggccaagtttctacagaatacttcagtatcttctagagcatcaagaaaagtttcatttatttaagcaattcacatattagattctattataattttaaaattggtatttatgtatgttatttattaattatactaaatagaattttttgattggtctaggaaactccatttcctgacagctctcagataagtttagtgcattgttgttctgattatttcataagtactggcctactttatttgaaaatggatagaaaaaggtataggtgttttccagatattagcaatcgattcattgggtaaacatgccctgtccttccccaaataacttagaatctctttgaagataaagcacattcatgaaaagttatcagaatatacattatggaaaacaaaatttgtgccaatctattggtgctgaatggacaataatgtattctgaaatggaattgataaactagagaaagttttttagaggaaggaggtgtcttgagtaggaaagtagtcactgtttttaagcagttaagatatggattttttaacccatcattcagttattagtttgctaatacagacatgttgcttaacaaagatatattctgagaaatgcatcattagacaatattgttgtgcaaacaatatagagtgtacttgcacaaacctacatggtagagcctaccacactcctaagctatgtggtatagcctattgctcctaggctacaaacccttacagcatattactgtactgaatactgtaggtaattgtaacacaatggtatttatgtatctaaacatatcaacacacagaaaaggttagtaaaaatatggccttataatcttatgggaccactgttgtatatgcagtctatcattgactgaagtgttggtatgtggtgcatggctatatattaatttttctttttatcatggaatttctaggataaacatttttaaatagtggaaccagaagactgtttaaggtcttattaccttttcattaatttaaagagaagaatattcatttttaaaacattgatatgaaaatttacatcatgatttccaaataaaaatatgtgcattcccattttaagcaaatctcaaacattttgcagagataaataagtactccatttgggacatcagtcttcaggaacttcctcctgtgtgcagaaaaacctgtaatacatgtattatgcctagtccttcatgtattaaggaggcactaccaagcctcattcagaataagctgatggtggggttattctgattcactcattctggtaacatgactggtagtatatacatttttaatacatttttactataaccaacctagttaagggtttgcaacccggccggctgacccatacaagcccgttagcattgtgccagaccccaaattaaatgaaagtaagtaattactttaggaataagattttgatttcagtatcttatttttctgaaacattttatattaattgctttgtatgtgttttcaatgtttttattactctttagactcacaacgacccagaaagcattctcaaagatgatgaatgtactcaaacagaacttcaattaattgctgaagcattttgcagtgccctagaatctgttgttggctctttagaacatgatggaggtgaaattctcactgacatgaagtatggacacctttggtcagttcaggcagattctccctgtgttgctaactggccagatttgctttcacagtgtggctgtggattatacaatagccaggaagaactcaactggtctttcttaagaagcacacgtcgtccatttgtgccacaaagctgccttccacatgaagctgtgggctcagccagcaacctgaccttggactgtttgactgcaaagcttagtggcctacaggtggctgtagagacagccaatttgattttggatctttcatatgttattgaagataaaaactaagagaatagcatgttcgtattacaagagaaacaaataaactagtctgttggcaattgagaaaaattgtgagtgtatttgttttctcccaaagccctgttctacatatttggacaaatgactcataaaattatagatacacttatttaggaaaaaaggtgattcgtgaatggaaatgccatgaaacaataaaaatatgaagcattatttatttaaaaatattatagttatcttagggattctatactggctgctgtacattgttctaaatttttgttatgttggcatcattttgagagcaaacaaataaaaaagactcctaatccatgctctagtttggatatacatattttagatattttccagttagcagtaattacatatgcttaaagtataaaactagatctcaaagtgtcacaaaacattcagtatatattgctcaatcaaaagaagtattcaaactgcacatttagtaaaatttcacttttctccatgccctttatctcaagctatattcttcagtggttaggtaattgagtagaacctggtttgcctgcaatttgtagtttatatcacaactccacatttttgttattttggggaaatgtttgcttttggggggaaaaagtagatttatatagtaaccaaggctaaagcaacattgtaatgtcttcatttttaaagtgggaagaaggactggtttgttttacactggggtttctcaactttggcattattgacattctgagccccataattctttgttgtacggaggctgccctgtgcattacagcttactgagcagcatccctggcctctgcacactagatgccagtagcaccctcctgttgtgacaaccaaaaatgtttccagacattgccaaatgtcccccgaagagcaaaactgttgttggttgagaaccatagactgatagaaaaaggaaggacaataaggagtattctagcaggacttcagaaagcagcataaagggaaggggaagttatttctctagtcaatagtatgaaaaagaaagtagaaaatctcccatgttcaaagtagagacattatgtttcaccaaaggatgtagtttgaattttatgcaaatataagatgtattgataaattgaagaagaaatatagaaggcagccacatgaataagcatggagctataacaaatgttgtattaaactttaggaaaatattttggaaatttttgggaaacaaaccaacctaatagtcaatgatcagatctatagccatgataaagagaaatagaattgttaaacaatttcctctgatattcttgtaatcaaaaagaatttttactctgagccaaaggaaaaaactagcaatacaagcagcaatgccatccatatatgttaggtatcagccccacctgaagtctcataaaatatttatcaaaagttttactccttttattattacaatcaaatagaagggcagtgtggtaggcagcctctaaggtggccccacctcctagtttcagaccttgcataatttcctccccttgagcatgggctagacttagtgactcctttatgtctcccatttcccagctttgtggacagaatgttatggtgatggttatggttatgccttatccataattttatgctgtgagtagaaggcagataacttttctctagtttcatgggtctacagatggaaagcaactgtgttccaggaactgtacttaaagaactacctcctgaggaagcctggggtgattccagttatgatatcaccctgacttgattccaattatgagattctgaactttgagctgatgttgtaatgcaaaagtgaaacttttgaggatctgaggagtaggggggacgtattttgcatgtggtaggcagcctctaagatggttcccaataatctcacttcctggtggttcactctctgggtgtaggtgggacctaatgactagcttctaatgaatagaatacagcagaagggacaggatatcacttctgata

SEQ ID NO: 16544 - DNA, 19523 bp, Human
gaattcccaattatcatcctgctcccctaccctcaacacctccagcggtaactgtatcttattcatttttgtgtctatgaagcacagtgttgcactttggagatactacatagaagttggcccaaagggtaataaactgtatttgccaagatgatagcatggatttacaataacctctgaaactttataaagaaagatgattgagttaaattgatacacctagcatcacagctgtggaagcttgtggtcttctttatgttaaaggtaaaatggatataatgaattagttgccatttttagatgatatagaagttgaattcctcttaagcctctcaaagagaaagacatattaaaattcattaaaaccagtaccataaactgcacagaacagcctggttccctagagcacttctctggggcagtgagttttcatttaaaaaatgaagtttggattttaaacataagttttaaaagtgattaggctccagcaggagttcttaaattcctacctacaccatgactcccaaatgctctgcctctgtcgcctaggaacaaaaattgtcaaggttgagccagatgcaatgtataacaccagatgatagatgcagctcattgtgttaaaaggtgttaaacacttaagtgcatgtgatatactctatatcacaagggtaaggaagttccattccatatcctgatttgggtcttctaatacatacttgtagtggatgtggtaatcagtctttgttctatgtcccattaggatcaatgcaaccagaaatccttaaaatggatttttattatgtctagctctgttttactgttctatttgtttattttaaaaagattttagaatggtgtttaggttgggctggtggctcacgcctgtaatctcagcactttgggaggccaaggcaggaggattgctggagcctaggagttggagaccagctagggcaacataaggagacattgtctccgcaaacaaacagaaaaaaaaaaagtaagaaagaaagagagaaagaaggaaagaacaagaaaaaggaaaaaaaaattaactgcagtaagtgcagaaatctctctcaaggatatgatggatggcaatgaagacagagtttttgacactggattatttaaagcataatttaagcctctttctctcccctcatagaattgtgaatttttgtgttttaattatatttaagccaggcgtggtggcgagtgcctgtagtcgcagctgcgctggaggctgaggccgattgcttgagcccaggatttggaggccagcatgcgcaacataatgagacccagtctctaaatgcatgcctctctctatatatttaaaattctgatgtgaaaatattttaaaatttaatacatttcaaatgtttttaattgtataataaacaaaatgtaaataataaaataatttaatattaaattcaaaaatgaggtagaaacaaagcacagcgatataaataataaattttcctttacatttttgaggcggtcttttgagttttccatttccttcttaaggtcactgaaatgtgctccttggagccagcccgcaaatcacgcatttagaaaaacataactatacactcctaaccctaagtattagaagtgaaagtaatggaatctcgatgtaaacacaatatcacttttttgatgagctattttgagtataataaatttgaactgtgccaatgctgggagaaaaaatttaaaagaagaacggagcgaacagtagcttcctgctccgctgactagaaacagtaggacgacactctcccgactggaggagagcgcttgcgctcgcactcagttggcgcccgccctcctgctttttctctagccgccctttcctctttctttcgcgctctagccacccgggaaggcctgcccagcgtagctgggctctgattggctgctttgaaagtctacgggctacccgattggtgaatccggggccctttagcgcggtgagtttgaaactgctcgcacttggcttcaaagctggctcttggaaattgagcggagagcgacgcggttgttgtagctgccgctgcggccgccgcggaataataagccgggtacagtggctggggtcagggtcgtgtctaggggacggccgagggcctcggagggcgagtattgaggaacggggtcctctaagaaggccggactggaggtcagggatctgcgcggggcccggctgggcctcggggggcggtgggcagggccttcgcctgggtctggccgtgtgagccacactgggctggctttagagggaggctatgggagcccagcctggcggggttaggcggcgtgggggtgggggttcggggctgcagtcatgagtcgaggtcggctgttctcaggaactgcctgaagaggctttcgggtcttgattgaagcaaaatccgctcccccacgctgagcgcctgcggagtagcaggctctttcctgggcccggcccctgcgcgccctgccatcccgcctcgggggtgggaaagtgggaccgcacctgggccaggtacaggcgcgggtccctagagccaggccgccctgagaaaccgatcctggaactcgtgggccttcttgggcttgctctgcccacggccccggcccacctggagctgttaagaacagtcagcccaggcacttaactctcatgagcagtgtagtgcagtttttttcatttaaaaagatacatctctgcttctttctggattgatttttctttgaagatgaatgtgagaaatagaacttaaaggtctattctgagtgtgctttataaatgattttatcatcagtgatgggtgttagaaaaatctaggtaattatgcctggagttctgacgtttcattggcaaacttcagaggaagtcttgaacttctggttgtcagcttttttttttaacccattcattgtgattcaagtataccgtttttctgcttagtccttgacattgtttaggttataattagaattttatctgtggaattgcacttttcattcttttgttttacggtgcttaagtgatatttcctactcttggaaaaagtaccttgaaagtcttgagcatgtttgtctgtgacctcagcaagcagaggaaaaagattaaaattgtcacgtgggcaactgtaaacacttaaaatgtttttgtcgttttaaacaaaattttcctaatgaacagtctgaacacattttagttctgtcctcataactttaaaaaataatgttttgaataaaattaggagtatcataaagcggtataaatttgttgaaatatttgggtataactttggcacacgcaggtactactttaaagtgtcacaaaaagggaacataattctggtttttgtttggaaagaatagacaagttgatacctgaatttgagggttgttttgattggaagaagctaaatactacactagtatagaatatacacgtttccaatgtctcaggagtcaagaaggatggaaagttattgtaggagtccttacccttgtaaatattgtttgaatgtaattaatatttatggaatacttatgctgcagtaggcactgtggaaaatgctttacatatagtgtttcattaatgcttaaaactactcgagttagtggcatgtaattaagtcagtttttccttcactttaggatctaccatacccattgactaactatggaagattataccaaaatagagaaaattggagaaggtgagtggttttagtaaaataaattttatggaatgatttaacaatgctacaacttctgtaatatgaacacatttaaatatttattaaaattcaaccattaagatgtcttgtagtaccagtgtgcattaacatatgttctttacttaataaacgcaaatttgctcacatttcaagagaattgaaattaccgaatccctaatgacccttcgcctcacccccatagtcttacagtcttctgatactaaacacttatagtagtacttgtattttgaagacactattgataacttgcatgtgtgttgaggggcagaggttagggctgcagaattatgctaacttcataatatatttttagttttagtctctttcaattgtttttaggatgataaatatttttatccagactttatagactggttacaataattgacttaatctaatttaaataaaatttctatttagttaccctaagtataaatgacctgtcatatatacatgtttaagctattctaaaattataacttatgtatataatccttccctttctgtggtacttgaaggaatgtttagatctatatatggcacaaatgaggggtatatcccttcgcctgttcctcgactccagcagaacattctcgattctccaggtacaaaataatttgctaatagaatccagtttatataggttctgccagaagaaaattcccaactatatttttaatgtgatcaaagaccccacttgacaagaaatagtgaaaaacaagggggaatactggagggaatttagtggaataggagtgacaagttagtgtggtgttcgattggaggtgtgtgtgtgtatacatatatatatatatttttttttaaatcacttaaatacctcatacccattctactaaacaaattttgctgctgaattaaaaatatgtgattagtatgtctaatgctgtgtagtgtgtttcttaaattcccagagaatttgtgttggttttagtttggcataaaaagagaccttcttaaagtataaatatatttttctttaagatgatagaactccaaacatacaggagactgcagatttgacttctgagaaaagtactttaattgctactagaaataggagcagttaaaagaatgtaattttaaatttaatccattacatacatgtaagtcataagacttccattctttatttctagcagtgtgacagtggtaaaccctcttaacttttctggatctcagtttctgcctctgcaaatggtgataattggacttaacacgaaagatatgattcaattgaacaatattatggaaagcatttgttatgagcgctttaactcagaaaaccttcaaatgtttatcatttgaacattgtattattactatgaacactgtctccaaaaccatctcttcaccagctccatctaatgccacttaactcttaatttggatttctttgatgtcctcaaatgtatcctgtgatttggcctatgagttttggcaatggctgttctttctacctggaggccagtttctactggcttcattttttatctcctcctctagtccaagagcattttgtagttccctttgcatcataccataggatccttgagggctggggtttttgtcttgttcacaactgtttgcccactgcctatcagtagtgcccaacccacaggagatagccaaatagataataataacatctgttttccttgtttgctcttctgaacactgttgtttctttttctggcttgtattgtcatttctactccaatgcctgattgttttggattatgtgctggatattgttttggaaaaaggaacttgtggaaataaatggaggcctaaatgattcacacagaattttcttttggttctgccaggtatctggttaaagtctagtattaaaatactactttaaaagttatattttttcccctcaacttttcattttgaacatctccaaatctatattgaaagatttatgcaatgaacttgtaatatttttaccaagatgttggtgttttgtcatgtttactttattatctgtatgtatgttagcattattttttatttttttcattgacattaattctgatttagaacagtctctgccttttctctcacttgacagtgagtcttgacaacctaattcatttcttaaatacctccagactttactattttaaatattacaaaaattgttctctggtttcttctgaattacagaaatctgagtgttgtgatactaatctttgaaatccttcctgtcttaagaaaatgtctttttggatcatagagtagcagtatccatgatggtggaaccttgcctggcatttagtaggcatttgataaatacttgcttaatgaaggttttctgcttaagggcctccataacttgatcatatcctacatatttttcttttgtttctttttgtttcctgggataaatcttccattaaatttagactgatctccttctaggcttacctgtgttaatgatttttgcctccttagttatttatacttagttaaataccctagagtatttctgtctttagaattcttagttcattttggaggatatgccatgtatttcaaaaataattttggatgattaaccaatagaaagttctgctttgtttaacccctcttccagtagttcagtgagaagtgatattatctctaaaattcaacacattgagtgttggccactggttaattgttaattctgaaaattatttaggattagatgagattgtacacttgagggagaagaaaggatgctagaaaaaaaattagttctgaacttaccattaactgtttatgtgactgtattatgcaagtgactaattttcctgagatcacttaaacagtatgccagatgattgtgctactggtttacctactttttgtgtttaatgagagctgaatttacatccaaaaaaatgtagattttaagtatatgaaggttgcctacttttaaggatggctgtgaggattaaatatagtcaattctcctttaatgtagagtaattttggttatcaaaaagttatacattaatccacaatttaatcaaaatagtataaaatgactcatgtcagtttatagttttaaaatgacaccagtatttaagaaaacatagacttttgtatagaggttctgtcaaaaaaattaagcttaagtagcatcaatttgctactgctcaaactgcttaattttttaaccaagcagttggtaatttgttggttgttagccttttttaaaatattgctactttcagagaaactcataaaagctatagaagaggccttcttcctagaacagtgcactctaatcacttttgaagttaaaccaatgccatggaaagcaagctattcaacaaaattttgtgtgtatttaaggggttcaggacctccctaaactccaactcgagtttaaaaagacttatctagggaattcagccacgtatatgacagattttagctagtcttctcccttattgccatttcattccctgtatccacctcctccctccctgctatcccttataattgatattgttgctcattacctgaagcccatatatcaaaatcagtattttcatcaacttgcaaatgggtgtgaggcgttcctaatatgtagtacatacaatgtgctttattaggtttaatacacaaacacctggtcttttttctccattcttttgagaatgaggactgttgactgtattttgagatacagataaaagtgttttgaaaagcataaagcactctacagtattttctgaaagtgtcataatgacttttatcagtaatatttcctgagcccaaatttttacactatattttatgcccacttcgttgcagggtaggatattgacagaaggttaattttaatttgcaaatgatctattttgttctgtaaaatatgctggaacattaatggtaatttagatgtatagaaaacttgtgatgactacatgaattttatttttaagccatacagattgtagttactctcaatttctttttggaagcaatgagggtatgagtaagatacttcccatatggccacaccagacatttctatcatgtgacccttatgggattcaatgatcttgaaatcctttagtttgaccaggtgcggtggctcacgcctgtaatctcagcattttggggcggcgaggcaggtagattgcttgagctcacgagttccagactggcctgggcaacatggtgaaaccccatctctaccaaaaagacaaaaattagccgagtgtggtggcatgtgcctgtagtcccagctacttgggaggctgccgtgggaggatcccctgagcccaggaggaggaggttgtagtgagccttgattgacccactgcactccaacctggacaagaaaacaagaccctgccataaggaaaaaaaaaaagaaaaaaagatctttagtttgtggggtgtgtcacacagcatattatttactttgtttcaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcaggtatgttgtaatatctgaatgtaagccattttctgcatgctatttcaaatataaatttcaacttggaaatctttacatttgctcaatttcttggtctagccttactgagtggactagaaccctatttttggtagttgagaatgccgcacatatgtaaaagagaacaggctgttaaagcaggaacagagttggaggagctgggtgatgtagattaatatttgggcctagaatagcaaggtaaattggccatgggagtaaagccgttttcatagagctttgtcaactctctcctacttggggaactctagttcctgaagaccctttagttagagtcttaagaaaagtagctaggtcaaatgaaaaagattttttttccttaaagtatttgcattgggtgtttttggagacctgtcttcctaacagtccaagttaaaatctaattgtacttggctggggctagagattggaagtagcttttaaggtcagataccactttaaaatttatttgtataattcacttcaatgaaaaaataagctctcagcaattagtagccaacctagatatgttcttttgaatacaggctccttataaataagcacctcctgtacaaggcttaattttaaatagttgccctgagattcctttcttaaatttgagttttgagtctcttccattagggaagctactacgtcttccccagtttttattatagcaactgaaattatggaaggagttttattttgtgaaacagaggtcaaaaatgtttgctggattcttctctcatatattttttttccccagtcttcaggatgtgcttatgcaggattccaggttatatctcatctttgagtttctttccatggatctgaagaaatacttggattctatccctcctggtcagtacatggattcttcacttgttaaggtaaaagcttaactaattttattaatatttatgcactgtggatataaagggactatatatagaagtccctgcattttgtgggaatatgcttggaaaaagtgttagaataagaaaaagtatttcatttttctccctcatggttagtttatacaggttagagatacccatgttattaccagatagtgtttctagtaagtaaaaattagtgcctgagataacatagaactggtaagtattgttggaagctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaagatttttttttttacacaaggtgggcttatttgcatatgtatatatacatattttcccttttttgtgtaaaacattatcaagacgtagatctacctatgtctatttacatttttgatataattaaaccacttccatattgatgaacatttaaattattttccaacttggttattgttgctcttattaacagtactgcactgaatgtccttatagatatttatctttgtatgcaactttataggataaatttttagaatgggaatgatggattgaagatgtttatttacattttgatagatattgccggttgccccctaaaaaacttgtagcaatttactcttaaatactcatggtgtgtaatacttattgttttagtacatcattgccaaaacttggttttatcaatctgttaactatgtgaaaaaggcatattaagattgttttaattttatatttcatgacaatttaacacttcatatttagctattataaaccgcctatattttcgttaggatacgttctttaacaatcttgcatgacttttggactttctgcttttatgtcttgcttaagtcttcctcactcaaagatcgaatgtattagaataatacatgtcagtatttttctggtagttttagtaagtcctgtcttccacacatactttttttgtcttaaattctgtattaagatttattttgacttaaaaactgggatacagattctgctttatctttttccaaatggctagccagttgttctaactggttttatgtacaggcaacaatggttttacttacaatttttcagttttacaatgaagcagaaatgatgcacattcactagaaaccatacttcatttacccatacaaccattctgttttttcactttcagtacagtattcaataaataatgaggtattcaacacttgcaactatatgctaatgtaagtgttttgagcacaattaaggtgggctacgcttagctacgtttggtaggttaggtgtgttcaatgcatttcgacaaggtattttcaacttagaatgagtttaaccagatggatcatccgttttgttttgttttttgaacaccacttgtccctctaagatggagcatctgtattactttccaatttcaaactgtaagtcatttttctgtgtactttgtttttgtaatatccatgctacttcagatgtcaatgacattgtctttggcaacaaatgtcttgtaaagcacttttctctgaactaagcagcattttatgataattttatccattgaaatatataatcataatatctttgccatcacttttagaatctaattttttcaagaaggaaatgaatatgtaaaaatgaaagaaaaggccaactgtattgaagatacaaaatagagttggtagcggtatatagaagaaaaatcaagaggcttctgtgtagaaaaccaatttgtaatttaaggatcggggaccaaaaatttttaaagactaaatgtgttcacattactatagatatgtctataaggtgaagattcttttcttaggtatacaaatgtgatgttgtatataaatgggcttcccacccacaaatgcttattagcctaaaatggcctgaaagctctagtaattaaattatttctctgcgtcctaattttttgtctttgaaacagattatttagaaaatcatgtacttcgcttaagtttctaacttttacttgctttttccagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggcaagtggaatagtggtttttgatggcttttgaatgtgtgtgattgctagattattttctgtatttgtgaaagtcaagaaataactcaataaaagatatctactctgtgccagtatcaatttattgcctctcagctccaaattcattgcatgctatgtgaaaatggaactgaagcctttaagtattttttctttaccagctgctatgttgttaaggtagagggtactagagggacatggcaggaggaaggagttttcctagctacagtttttacattttcattattttttactttatttatttacatcattcccatcctttgttgtactttaattctttatattaaactctccccattcaaatcaccaccttggtttctgtctcctgactgaaccctccctgattatagtcagattgattcaaagacaggttttgttccttaaggtatattatttctgatacatttaggaattgctaactataatttatgtttgatctgtgttatattgctgacttggcatttagtgtttctgaaggaaagggaacattgtataataaaggattattgaaaggctgtcttctgtggagttgtctacccttgacccaaagactgtctccagatcaaaactagtaacagtgctcatctgattagatgtcttggctgcttgttagtctttatcatttttttacatggctatataaataaactaagattattttgttttctttgtcttaaacaaatgctattgacctcattagctttgttctaacaggcaatatttttaccatatgataaatatactaaaatggttggttagttctagatcactaatctgttatttgacttattcacgttttttaaataatttaaaaatcattttttatcgacgcattattatgcatatttatggggtacagtgtggtatttggatacatgtatgcaatgtgtattgattaaattggggtagttagcatatccattgccccaagcatttattatttctttttgttgggaacattcaaaattctttgtttgggctatttgaaaatttacagtaaattattggtaactgtagtcagcttacaatgctgtagaacactagagcttatttttccttttgagctgtaattgtatccataaaccaacttatctctgtcttcctctactaagccctgaataaccactattccactctatggccattagatcaactttttacgttttcaaatatgagtgaaaacatgtggtatttatccttctgtgcctggcttatttcatggctcatccttgttgtcataaatgacagaatttcattctttttttatggctgagtagtattctagtattccattgcctgcacgtatgtgtgtgtacactacattttctgtatgtgtgtatgtatacaccacattatctgttgatggaaacaggttgattctgtatcttgactattgtgaatagtgcttcaataaacatgggagtgcagatatctctttgacataattgattttatttattttggacatatacccccagcagtgggattgcaaaattatatggtagttctagtttgtagttttttgagcatcctctaaacagtttttcataatggctctactaatttaagagcccaccaacagtgcgtaaaaagttgccctttctctgcatccttatcagcacttattttttgtcttttgatgataattactctaactgggtgtgatagctcattgtggttttgatttgcatttccctgatgaatagtgatgttgagcactttttcatatacttgctggtctttgtatgtcttttgagaaagttttattcagattgtttgaccatttttaaaattggattcttactattttttttattctggatgttaattctttgttgtatgaatgatttgcaaataatttctcccattctgcagattgttgcattattctgttattctgttcattctgtttcttttgctgtgcagaagctttttagttcgatataatcctgtttgtctatttgttattgctgagacagggtctttctctgtcacccatgctggaatgcagtggcgtgaacagggctcactgcaacctcaacctcctgggctccagtgatccttccacgtcagcctcctgagtaattgggcccatacacaggcatgcaccaccatgctaggctgatttttaaattttttagagacggggctgtcagcatatttcccagactgttctcgaactcctgggctcatgcaatcctcccgctttggcctcccaaagtgttgggattataggcatgagctgctgcacctggcctcatttgtctatttttgattttgttgcttgagcttttgaggtcttatccatatgatttttgtccagatcaatatcaataacagtgtttcctctgttttcttccaatagtttcatagtttaaggtcttatttaatccattttgagttgatttttgtgtatggttagatataggggtttagtttcattgttctgcatgtggattatccagtttttccagcaccatttattgaagagattggcttttccctagtgaatgttcttgtcatctttctcaaaaatgagtcgactgtaaatacatggatttatttctggattctctattttgttctgttggtctctgcgtccttttttatactaatatcatgatgtttcggttactatagctttgtaatacatttttgaagtcaggtgatatgatgccttcagctttgttgtttttgctcaagattggtttagctattgtgggtcttttttggttctatatgaattttaggatttctttttatttctgtgaagaatgtccttggtattttgatggagattgcactgaatttgtagattgcattgggtggtaatatggtcatttttatattaattcttccagttcatgaatgtgggatgtcttttttgtatcttcctaaatttttttcttcaatgttttatagtttttagtgtagagattatacatctcatttgttaaatttattcctaggttttttgtacctattgtacattagattgctttcttgatgttatttttcagctagttattggtgtatagaaactattaatttttgtatgctgattttgattttgtatactgcaactttgttaatcagttctaagagtttttggtggagtcttttaagtttttctatatataagatcatctctgcacacagggacaatttgacttcttccttggcaatttggatgccctttatttctttctcatgtttcttattcatgttataatggtactgttagtaccatcttagcaagtaagcagtacctgcactttgttcagtgtcaccccaaatctattatcaatgggtttggtttttcagtggggggaagataaggctgtataactgtcttgatctttagtgatttgaaaagcaaaaaaatatttattatgcttttatctgttttgtcttctaatgaatagaacttagaaatgaaatatttatcttcaattttgtgtacctttaattgacttaaacaatattattggtggcagtcatacaacctttaaaggacagccctaataaaaatataaatgtttaagtgtaggtaattttatgcaccacatttattcattgtaaaaatttgctttttaataggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcaggtagctattaaaaactgagataataaaggtaacatatatgtaacaatgagattacatttatgctttaagaaatttttgttttcctgttttttagagctttgggcactcccaataatgaagtgtggccagaagtggaatctttacaggactataagaatacatttcccaaatggaaaccaggaagcctagcatcccatgtcaaaaacttggatgaaaatggcttggatttgctctcggtaaggagtgcccttgatactgactttcaaattattgatgattctgaatatattcagttctttgttttgcctagaaaataggaagaacactaacatttttgagctaggtgtctgttatgtacattgtattatactagcttcattttagatatcaggaggcactagtggctttgagaggaggatttagcattagtttttgttttttatctgacaggtagctatggatattctgagggagaagccaggattaatacacattttttttttaagttgctgaattgtagtggctctcctttctagcatttttgtcactattgagccctcttagtttatgctagacgtgtttttcttattggttgatattttaaattattaaagccatcttctgaataagctttattcgcactttgtacctagtttctccatcagaaggatctattgctataccattgtatacattttctcattggtcttcgggttactttcagagtgtaaagactccttatgccacaaaattaagcttagatttcccccaaatcaaatactataaatcagattccttagtctagccacaattgacatatcttggagtggataaatctttgttgctggcattgttctgtgcatcataacttgtttagtggcatgtcatcactgtcttctactctctagatgccattagtatactcttcacagttaggacaaccaaaagtgtctccagatattgccaaatgtctcctgatgggcaaagtctatcccagttgcgaaccattattgtaaattaaacttggtttcaaatttgagctttattccttagctctgggaacttgggcaagttacttcccttcgagcctcaatgtcctcatttgtaaaatgacattaatacctacttttagctgtgggaattgagtaccatgatttatacaaagcagtttgtatggtgctggttacatgagagttcagatggtaactagttagtaaaaaatctctagtgtgcttgttgattttattttattttagtatttcttaaagatcaaatttaacatcaatcctaaactttatttagctttttctggcgtgtaaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaattaaactgtttaacaaataatgctgctcattgtgattcttacctataagcagcctaatttgaattatttgctgcaatcaagagaagtgtacaatagttttattacttttttagtgtacttctatcctttttccaactatatctcctctatttttcctcctcgttaacaggctagaatgtgcattcctgggttaccgatttttacactcaattggatgtgtaatgagggatctatctaatccatcttgtcttggaaattttgcactctagaagaaagtgtgtcactttcttcagcagcgagaccttttaagattggtggtttggttgtcctgttctgtggtctttggtggaagccagtttgttgtaagagaatgtagagcttattaatgtaagtcatttggggttatattgtggagggttgtttaggattgcatggcaggaattgggtaaatgaaaggtaacactaaagattggagatggtataatggcatatctacaggtctgtgtttccttatctgcgaagtgagacattgaaatagatctgttttgcaaattgtggattgcaaccctttagtgatttacgaccagcattaatcactaacccctttcctaccccagtgtaaaacagaaactatcagtgtatcctatataattatttacttatttattttttcagtaatatatagatacatgggtgatacaaatgtttggggccttgtagataatgtagaaacagcatgcaacctcaccgctcttgctccacggagtccaagtgtctgaaaagttgataatacatcaaattagaactgacttggtagaccagggaaatgagatagctggtaggacactgtcatcacttgctataatgagtgacctacttttgatcctatgtcaacttcagtgactaggtgaaaagctactgaattgtgtcctcatctcaaatgtatttttaaattagtttgtgctgtggtacttctgattaattttaaaatggagcttgtctctaggccagtgacccttaagtctgttatgtgctagaaacacccagaagctaattctggcactactgtgaattcagattttgaaaattgggaaatgtatcccaataatgcattttttcagaagcttgccaagctgatttagatgaattccattgtcatcagtagtggtgagtt

SEQ ID NO: 16545 - DNA, 10015 bp, Human
tttagctaatttacaaaaaaacaaaaacaaaaacaaaaaacaaaaaactactttttttgcagcacaacagcctggtttacattgcaaaatgatttctcattaaaggtctatcatctatttccatatatccattattatttgtaatatcctttaaaaaaagcagtcaaccccaggctaatccattgcacaactcttttgaaagtcttccttctaccttgaaagaagaaagttggcaggttggacattgttcttgcggaggttgtaccatgggtcacatatcacggtgtgacttcaaaggccactggagccaccgtctcatactgaagaacacacatgggtcaggagccaggtccaggtccggcatggtggatctggagaggggagagtccctgcctgtgatcctgtggggagccctcaggctcctctctggccaccatcctctgacctccctcctcagcaggacagggttctggcttctctgagggacaggttctgtggcaggccaggtgtcactaacacaggcctccataacaactgtttcagtactgactgagtgatgaaattaaatattaaaagctgaaaaaagccagtacctttatacagaggctggatgtaacaaaagcccaccaagagttttgcttaggcctttcctgggccttaaagcatgacaaaacaatgaaggaattcttaacaggacctatttagaattaaacaagttttattgtgagtctgaagaaactccccaggcctccacaaacaagtttactgggcatctgaaggaactccccaaacctccgtgatttagcaggagacaagataagggcaatcatcccccgcacctggacccatttagattaagtaaatagactgaggctccagaataaggtcctcaggacccagacctcagttacagattaaagaagttaatcacttatgtctttagatgaatgcacacttacttgtagacatataccttagaaggtatatatgctctggaaaactttgtaattttgagttggtctggtagtaatttctaggccttctccctgtaactggttgcagaaataaaacctctcttcctccccatttgatctgcatctcgttattgggcctagagaaatagcagccggaccctcagtttggtccgggaagttcttccatcctccctcgcctgctctctgtggccactgcactcactgttgctgttgctgttccggtctctgtgaggttcacctagtggactggctggacatttctagggggcacctcagatacctcaccaacttgctggatctgatccttggatttcgattcataaattgtgccaaaatacgaagtggctaatttacatagtacttagccagatgaccgaaggactcagtatccaaaggcccctaacagaaaacacagaccacatttcctttactctggcccttttcctgggggtccttcctataccactgacactgttcctgtgtaggcggggctagaggggagactaagccctcggagtagctttcggatcagaggaagttctgctcttacagtgacaggggctgaattaaattcccaggttggggccaccactttttagtctgacccctgcagccggagtctcccagagcccttgggaactcggcagcggagagaaggctgagggattccgcgggcagggaggagaagggagaagagctttgctccattaggatctggctggtgtctcaagcgcacagccaagtcgctgtggacctagcaagggctggatggactcatggagcctcagggcgggttggggaagctgtcgaggccgagccccgctttgggcttctgggcgccctgacctcgctcccggaaccctggggactgggaggcgggagggggcttattgattccagccccgggcgctcgctcgggggcctacagaatggcgtgtttcggggttgtggcgggccgaggggcggggtcgcagcaaggccccgcctgtcccctcctgggcctctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggtgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctttggggaggtttgttttcacttcatcttccccaccacagctcctgattatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctttgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtgagtgtgggtggctgcaatgtgcggggggaaggtgacctcctccttggctgggctgtgatgctgagattgagtctgtgttttgtgggtggcaggtggggagacagaagaggagaagattcgtgtggacattttggagaaccaggttatggataaccacatggagctggtcagactgtgctatgacccagattttgtgagtcccacaccccactcccagtcacccatttccctgccttttggcccagaccagggagggacttccaaagtcaggtctgtagcagactccggccagctgactggagacgtctataacctggttctccaaaatgtccacacgaatcttctcctcttctgaagattcttgtggacattttggagaaccagaccacggacaactggatgcaactggtcatgatctgctaccacccagagtttgtgagtctccccagtgagctgcacctggcagagtttggatttggggccaggactcttgcattcctgcacgcactggtcttttcttaagtccttggtaccactcatcctccaagtgctttcccatactatcagcagttattctcacgactccaatgtcatgtcaacaaaagcagaggcaattcccaccaatcttaggacacgatccaggcatcccacggtggaaattcaattcctagatggtaaaatttgtgttcagaatctccttcatctcctctggcctctggcctctgtcatgggtcatttctgtcagttgatttatatcacctacctgctcctagaatatacagactcaagtacaagaccaaggaatgtaatggcaccctcaaattgcatcttctcctcaaagttttccaagtgctgtcattgacatgcaccgggatctgcgcattttcataacagacagctcagaggcagccagagggcctttattcctctccctccttcctttcaacttgaacttctcatctccctggaaactagtcaatgttcattgttttcttctgtcaccccattagaaggaactttctacttctttccctgagctcctttagttctttgcatccttgattctgcccctgtctggatccagaggctgccaggtgctcgggcgctcatgcggctgacccagaggctattgggaggccagtgaggacagattcaggaagagcatctcattctgatcacttcagatagggtctggcacccagtcagagtctaataaatgctgatgtatccaattgaagcctgggcactgccccggttttagttgtggggaagatggctgcttgcctgtggccagcctgggccatctacagccctggggaggccacgtctgtgcagggagcttttgtctgagggtggtgacagctgttttctgcctcaggagaaactgaagccaaaatacttggaggaactccctgaaaagctaaagctctactcagagtttctggggaagcggccatggtttgcaggagacaaggtaaaggaggagtgatatggggaatgagatctgttttacttcatgtgtttcggggttttcagcccacacattcttggccttcttcagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgtaatcatggtacttgtttttcacccaaactcaatcataaatttattgaagagaaaagccatgtcttactgaactttttacctcgagtatcattcacagttcctgaaatacagtaaatgtttaacacatgtgaaaatttgaaagaattccctcaagggaagattctgccaacctgtacagtcattattgggatttagagctctggatatagttgtattaaccagagaagatataggataacgttcagaagattttacatgtacgtgtcttagagaatgagccagcagctctctgtaacttcagctttaatagctgctagctgtcctttgaatagcttaacctgagatggggcagcctggtttgttgggtcacacagtagcaatctgtgtggtcagcaggtgtcagtattttatatgaagtcatctgcaaaggagcaggactcattggataaccatctgatgagcaggttcctccaacagtggctggatagtggagttgggccttggtaaggcccagccttgagatgtagcccagaacagggagattttgaggagagtcttgtggggccattgtccagatgatcactgcctgcagctgcacttgaaaagggagcaataggtgtaatgttaaggacattaagaagtaaatgactaatttgctgggcacaatggctcactcctgtaatcaatcccagcactttgggaggcccatgctggtggatcgctttagtctaggagttcaagaccagcccaggccacatggcgaaaccctatctctacaaaaaatacaaaaattagctgggcatggtggtgctcacccagttaggaggctgaggtaggaggatcgcttgaccccgggaagtcaaggctgcagtgagccaagatcgcaccactgcactccagcctgggcgacagtgagcccttgtctcaaaaaaaaaaaaaaaaaaaaaatttgagcaaagttagaatcttatgaaactggtaagaaaaattagttgagccaaatatttatgaatgcttaacttcaatacagaagggataaaaataaaaaggaaaaagtaatagaagttaggagttaatactatgataaaagataagtagacagtatgaaaatattagacgagtaaaatagacatagatctagaacagatgtcagcaaacactttttgcaaagggctggtagtgaacattttaggctttgcaggccaatgggctctgtcataatgactcagcgttattatcatagtgtaaaagcagtcatagacaatacataaatgaatggtgggacactgcattccaatggaactttatttacaaacacagatgactgcaacaaaacaaaaaccgaacaacctgattcaaaagtgggcaaaggatttgaatagacatttctccagagaagatataaaaatgtccactaagcacatgaaaaaatgctcactatgactcatcattagagaaatgcaaatccaaactataacgagatgccacctcacaccggttaggatggtattgaaaagcagaaaatcacaagtgctggtgagagtatggagatactggtgcactgttgtgcactgtcggtaagaatgcaaaatggtacagccacagtggaaaacagtatggcagttcctcaaaaaattaaacataaaattactatatgatgcagcaattcaatttctgagtatacacccaaaagaactgaaagcaagctcttagagagatacttgtacacccatgttcacaatagtattacacagctaaaatgtggaagcaatccaagtgtgcatcaacagatgaatgaataaatgaaatatcatgtatacatacaaaggagcattattcagccttcacaaagaaaggaaattctgacatatgctacaacacgggtgagccttgaggacataatgcaaggtgaaagaatccagtcacaaaaggacaaaaactttatgatctcacttatgttacatagtcaaaaaacatctaaagagaaagtaggaagctga

SEQ ID NO: 16546 - DNA, 9519 bp, Human
ggctgtgggtgtgatgaagagcgctgttcccctcctttttctcccctcttactctttggccagccaggccctgcccactcactgtcccctagggcagtggattttaaggaggcttggctcctccctgtcggcctgccctgcccaagtcagcctaccctgctactcccccttaggagcctcacatctggctgggtcttccctggcactgtagaggtggaggccctcttcagttctggagttcgtcttatctcccaactctgatgctccttcccttggtttctgggctcccttgaactcccctagctccgtgctcacggccatctcagggtctcccctgcttgcagctgcacttggtacagcctgtgccagcccctgagggaccggctgcagcttcactggcaaacaggcgggcaaggggcacagggctgctggccggagctgcctgcactctgcaggtagggttcaggcaggggccggggtgcgcaggggacggggtcctggatctggggcaggcccctccctcttccctttgtccagctttgggaccagtcctggagtattgggaaatgggcgcagagactttaaggccggctacctaggcagatcctgtaatccttccctaagccagggtggagggtgctggaggggagcactccttacagccggctgagagaggcagtttgggtgtggaaagcttctcactgaggagctggggctgctgagcccagggagggtccttcggggtaggctggaagccttggcagcccccatagaccagcagcttcacggccctctggtgccagcctcctcgtggtacagatggaaagtctagtcttgatgaagaaagacccctggcttctgacactcccttccccagggccctctgtggtgcccccggtccagatcctggggcctgagtggcatagactgtttgtggcagctccttttggaggggcaggctaaggccaggccacattttggcagccctggggccctgggggacagggcgggcctccagggaggaggtagggttcccttgccaaccaggccctccacttcctctcctcttcccttgagggctcgtccctaggtcagagctgagcagcagctgcggcttctcttgtgctgcacaggtctaggatgtcaggcacagggccctgcccctttgagtggagaatctgctagtccaggggcgggtctgatcctgggttgcctgccctgggagctgcaggctgggggtccctggtgtggccgcctggtccttaccaagcacctggtgtgtgtctctgagggtgtctgtgtgcgtacgtgcatgtgtgtgcacacgtacacacgtgcacctgcctctgggaggtagtcacgtggagattctcatggcctgagggatcaggctctagtctcatttgtggaggtaatgaatctacttgttctaggggcagactcagaatccccaccccaagcctggaatgggtgaggggtccctgcgttagaggtgagggtgagccctttgggagccacacacacaggcctactcctcagctactgaggagggactgccctctttcccgaccctgggctctctcgggagctggcctaggcagggcaggggcccagggctttcaggggctgcccctccaccctttgaccctggcatcactgtctctgcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagtgagcccggcaggcagctgcttagtctccctccatacccttccagaccctttcagagccccttttctgcctctttccctcgcaccctgccttggggggtctgcacagggagcatagagtgggctttggagtcgggctgctgggttctgttctgtcttctagccgccggtgtggctgggtcatgttgcttaacttatgggtctgctttctcatctctaaagtgagtgagaacagcacagggttctgcagctctgcctttgaggatcacatgtgacaacatgtgcacagcacctagtgcggtgctgggacctgggagcaagggccgtccctcgggatctgcctgacttctcacccctcttgcctctaggctggagccagacatcctgcttcgggccaagcaagatttcctgaagacggacagtgactcggacctacagtgaggagggcagaggggcacaggggatgcggagctggagcctgcccttctgccggctctaaacccctcccttgaatgcaccccctgcaggctctacaaggaacagggtgaggggcagggtgaccggagcctgcgggagcgtgatgtgctggaacgggagtttcagcgggtcaccatctctggggaggagaagtgtggggtaagtatggggtgtatgttgggtgagtcgccatcacctatgtcttagtgggttcccccagcctggagagctgggggtgggggctggaaagggcgtttctctttccagcagctggaggggcggaggggcagaggggctgcctaggagccacttgatgtgctggaccagggtgatctgagtgttcctgggggtcagggcctgtgggaggtggggatagtttgggttctaagataaggccttagggaggaggtctctgagtccaagactgaggagagtgatcgcatatcctcatctccaggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctggtgggactccccatctctgccccatgccatgtgccctagcctcctgggcttctcagcctggtgcctgggcacctctgccctgcctgcctctccctacaacccaggctcattccaacctcttggggtacaggggtggaggttgggcaggagctgtctgacctactgggtcttcaacatctcttgccctctgtggggcctttgggttgggcagtgggtggcttggaagagccctgctctgactttaccctcctcacccctgcagatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcagtaagaggggtgtggtgcgtgttggggggatgcagcgtgggaggttgcgttggcttgggagaggccacagggctcggcttgctctcctcacccaagctcccctccatgccagttgctcagaggtggagctgccataccctgacctgcaggaatttgtggctgacgtcaatgtgctgatggccctgattatcaatggccccatgtgagtcccctgccatcccagacacttagctcccctcccagcccagattctccagccccagttctgccccagactcccatcacctggtgtcttgcccttcctagttgctgagccctcgacttccccgcagtctacttccctcttggcagcctccatccttaccctcccacctgctccctctgatctgctacccaagccctccccaggtgcctcccttcagggcctaagtccctgccttgttctcctcatgcccagaaagtcattctgctaccgccggctgcagtacctgagctccaagttccagatgcatgtgctactcaatgagatgaaggagctggccgcccagaagaaagtgccacaccgagatttctacaacatccgcaaggtgggccctcaccccgtggccgtctccatgtcctcatcccacacctctgcccagcctccccttcaagggccaggccccccacacagcatccagtacagagggtcctttcccattgcactgccccaggccccagaccttcctggcctctggtggatcagcagtgccctgttccattccaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggtctgtgccagtggcgtgggctgtgggactgagtcagtcaggggaccaggagtcacgggtgacctgagccttcccatgtcccccaggacaggaacactttccatcgctttgacaagtttaatgccaaatacaaccctattggggagtccgtcctccgagagatcttcatcaagacggacaacagggtatctgggaagtactttgctcacatcatcaaggtaaggaggcagccttccctgccaagcctcgagcctgaggatctgggggcttttagggggtgagactcaaggagggtaggcagatgaccccctgaagagctctgactcagctcacctcatgtctgactcagctcacctcatgtctaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctcttgtgagtgtccctggagtgggaggggaacctgcggggtcatattcaaggggtcagggcctgcctcctgccctcctaggatggctgagcctcccttgtccctgccaacccctctgagtgcaaggaagggcttcctggtcccatccatggtctgtccagcctggcccacctgggtatccttgctttcccaatatggttcagatgcgcccctgcgctcttgggccaagctctgacccttgctggaccgctgggtttcctcccactggccctgacttgcacctacctgcatgttgtctcacctgcagtgatgtgtaccgtaccaagggccagctggccaacttccaggagatgctggagaacatcttcctgccactgttcgaggccactgtgcaccctgccagccacccggaactgcatctcttcttagagcacgtgagcaggcagcgcagagctgggtatggggagggcagccggcttcgcatccagctgcagctctggttctgaccccagggttctgtattaggtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggtgcctgcaccaccctgtgtctgcttgctatgccatctctcgcccaacaaacctcactcttggcaccttgggccagggccactagacctctgacccacctgttgcctggactggatgggttctttctctgcccttggagctacatctgtcacccctcacagccagtaatctacccctgtcccccttatcccaggcctgcatagttattggctggaggacatatgcgtgctgggtggggggtcaggggctccggtgagcccaggtgatcccaggctcaggagctgacactgtcttcatgtcccccaggcagaggggcttccacacgtttgtgctgaggccacactgtggggaggctgggcccatccaccacctggtgtcagccttcatgctggctgagaacatttcccacgggctccttctgcgcaaggtcaggatctgcacccctagccttccctcccaattgttcaccttcctctgaaccattcgggccccttcagcaaccgatcctcctcccacccagccctcagattggattctgccttcccaatgtaactacccttccccaccccagccttcagcctggggccccaacttggattttgactaattcaccctttgcacatcaggccaagcctggattcccctccccctgccctctgctgtggcctggacccccagaaccactgtgccctgcccagcctcggggccacctgacaggccctccctccctgttgcctgcccaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtcagagcccagcaggcagccaggcgggcgggcgtcccaggacgctggggtctcccgggttgggtggggggcggtggggggggcggtctctcgggttggtgctgccccctgctggtagagcatagctggccaattgacaagtcttatggagttgaggggttggggggttggggggatgggggggcgggggtggggagagtgagtgaggaggctggggaagggaggcaggggcagctggccagggcgcactcgtctgagggaacctggcccgtgcaggagccgctgatggaggagtacagcatcgccacccaggtgtggaagctcagctcctgcgatatgtgtgagctggcccgcaacagcgtgctcatgagcggcttctcgcacaaggtactacagcgcctgcctggaccttggcatggcatcactcctcccctcctctgcatttggggtcctgacctgtccctgggatggcttggggtggggcatgacccctcagcactggctgcagccctgcccattacccccgctccttgcaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaatgaggcaggtggggtttctgttgggagagggaacgccgtggtgggaggtggctgtggatggaggcaccgtgcattctgaggggagggactaggcttgggtgatgtgtatgttgtgcatgtggaaactgacaaaagaagctgtgggagagaggagatgcccatccaaccctcatccagcctgttccctgtgaggggaacacctagccccgggtctgtggcacatccctgtcacaccagcttgggggctggtgtctgtttcccaccttgtacttcctcccctcttccagcctctgaggggatggcctggtagatgggaaatatgcacctacagacaaacctgagaccagggtcttctggggggggtcttgtttagatggccctctccaggccatactctcagagattctgattcaataggcagaaggtgtggcacagacatctgcaaactctcgggcagattctattgcaagaggttggaacaagcctgtgcattccgattccagccccccgcccccgccccaatcccatctcagcctctgtcccatgtttaatacacaatttctggagcacctccctggcacagaggttgctgaagtctgttccccaggtaaagaaggaaagtggaatgtgccctgggctgtgcagggtcctgggtgggcagagagaagcctgtcgctgcccctgctgctggctggggaggcctgtcctcccctggctggctgcctcagaagcaattagccctggaacagcatgagcctgtttaattgagggcctgcccagagccagagcagctggagcaggagggggaggctgggaggccgctggcttcctcctcctttcttgtcagctgctctcccccaccccagcctctttcagcaagcaggtctgcacctggccctgggtctcccagtgggtgccccgggaagaagctctcctcatccctctccacttcccattggccaagccctctcctggtcaagacccaaggcccttcagttcagaagacaccccttgccaattcatcctggccacttacatgtcacagaattgaacgttggagcccgatgagggtgggaggtggtgagtccagggctccttcac

SEQ ID NO: 16547 - DNA, 14621 bp, Human
tccatgtgtggcccacctttctgatgaggaaactgaggctcagcaaggttgtcatgggaggcagaagactcagcctttgatccaggctgccttgtttaaattgttggtgacattttcctgggtgatattttcatcctccatagtaaacttcttgataactgttgaatagaataggtatcctaaattgatgtcctcctagaaagtcaacaatatccaatttcgcaggtatggggaagagagaaaagaaaacaatatccaatcaacaactattgaaaaaccttattaatgggcaaaggtgatcggttcaaattggttgcccagagctggatccactagatcctggagaaaggatccctctggtgaggccagaagggaagcttaatttcaagccgagcctccctcttgactagaaataccagccccaggtgctcccatctctctggccagtctgcattccgtgattaggggccctaatggccataatgcctccaaggtggtgttgaaaccaataagtcttcagagaagttatggtatgtttaataacggcttaatgactccttgtgagatgcaaggcttctggttcctgtttggtcttgatttacagcccaactctggctgaggagccaagaaaccccttctaagcccccagcggaagagggaggtgttcacaccaggcctcttggattcctttaaaaattgagaattcaaatgaaatacaaatgatgtttgactccccacctctcttgctagtctccgggggcattgataataaaaacagtttaacgcagccccacgggctcctcaatccatgggaagtgagcagggtcctcgggtccttgggtatttctccccagatcttaggtagggtggtggttatttctcttttctgaaattctaagctactgctctaatcctgtctccttttggttggggagactcagctcttagaagatgcagttctaccctcatcccttctgaatcgtcaggcctgggggagcacagccctgaggtccgagctgcagacagtctctccagtgggtccccagacacttgggtcatctgcccactgaaacgcattcactccaagctgctgccagaggaaacaccagcccttctgctcatcctccacctgttccaaaggctgcccctgcaggacactgttcagtcctgagctgcccatgggagtctccctgtctgctctggccctgtctctacttctgaaacacacctcaaatacatagaaagacccagggttggcttggcccgacctccacagtcagatgaggacactaatgattggcgcaaggaaccatagctaattaatgatagtgtccaggtccaagctccccagcaccccattcccagcttagatctgcttccacacaacactcccaatagctcctttcactgtgagaaacaagagatctctaagggaggtgttttttgctgaggcaacattttgtccagctcctagcggagacctaagtaaaactgcagcctaaggcctgcctgtctgcccgcccaggccctcatcccaggctgatgtccagagtccaggcccaaaagtgtttgggggggatgcccacacggcctcacccctctaggggcaagtgcctctaggctggatatcaggaccacgggtgctgctctgagcaagagactcacctggatgggtagacaaagggatcctgccctagagaggaagctgcttcatcctctcctgagctgcctgggactgggctctgggtgaatggggggagggggttcccgggctccgaggggttaacccgcacggggccacacgtgacgtggatggttccagcattaagtcagaggcgcggccccctcccctgccccccgccccccgccccccgcggcgcgcgccgctcccgggggctccgcgcccccgcgcccaggtccctcccccttggcgggcgctcacaggcggcgcgggcagcgcgagccccggagccccggaggcctgtgcgccctgagccggcatggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaaggtaacgcgcggcgcggggcgtagcgcgcagcccgaccctctcttcttcttccttacccgggcccacccgggccttcctgcttatctctcccgctcgcctatttctcaactttttgcccctctcgcctttcgccacggcttccacggaagccgggttggcgctggcccgggccaggcaaaggccagtgtggggcgggagggtgaaccaccgttcctcggcggcgggaatgggaggcgggaggtcgagggaaggtgcagtggcgacggcccggagtccagtcggggcccgaaagcagttggacctgggaaggagagagcatgctctgccgaagttggactggaactgccacctaccctgaagcccagacccggccgagggctgtggagccacactgagacctgacgaagaagcgcggcttttgtgtctggcgccctttgagggccctgaggctgggcctcaacctagagtggtcaaatcggggtcggctggggactgcggcctggtcttggcccgtctctcctccccgggcctagccttcacaggaagggtgctgcctgtgcggcagactggcacagtctggccgcgactggtcgtgcaatgccagggctgtcctcaagacggaataactgtattcttatttctcatactaagctggcctccctgccgttatgcactatgatagccgcccttctggcagtcttggcttccccgcgctggatcatcaccgctgggcagtcaggagcagccctgggcagcctaaccccctggcgccgcgggctcacgggccggtgccctgtgctaaggccggctggaccgcgccggcatccgagaatgcgcctgaaggcaggggcctggcaggctgatcggcagctctgcggccgtccgccgcaccctatgacctgtaaggcgtctcggcttccgcactgcacccaccttatctgcgctgccatatcccgcagcctaggcccagaactggatcctccaagatccgcctcaaccccctgccgccgcccggctggcgcctcgcgggcctccacggagtggccgggcatctccggctttcgcccagccggggcggtgggaatgtgtaggggagggcggggaggtgtgtgtgggtcaacggaggaaatgaacgagtccgcggagcttcgtgtctgtgccctttgaaagaggctttcctgataaaaaccacagttgggacttaatgagaagcagttggcctggctcctctgatcccagccagacggcagaggccgcgcagtgcggtgagcaccgccagagacaggtacccggcctggctcagcgctccgcgtcgggcaggagccacccccccaggcccgcgtccctgctaggcgcgccgcatccggcaccgacagctcgggcccccggaccacaccggtgccgcgcgaactgcagagagcgctggtgcggaacgagcggccgggagaaacccagcaccccgggatccgacggcaagggtggccttgacaacgaaataccgagaaagaaaaccaaagaaagcgagcgacaaccaagaaaaggggaagggaaattgaacaaaacaacggagagcgcggcgagaacgagagggtaaatggcagtcggcgagctgggatgaactaaaatgaataaatgaggaacgaacgaataaaaaaagcaggagcaagatcgaacgaaacggataactagagaagggggaaaggacaaagagggagggagcagactaaacaaaagaaaacggagcatgtttaaagcgtagaatatatcaaaatgagaacaagggggtaagaaaattaacgatttcagttgaacggaggacaggccaaacgaaagggaggcaggcgggtgcgagcagagcctggtagagatcctggcggccgctagcctctggcgctcttgccggtgttcaacgggctgccagcgtccctgcggcagagcggacctcggcgcagcgcggcgcgcggtggagcctggctgcttgaggacagtcagcccccagggccgcacagcctacttggtgggaagtggcgggcgaagagggaacccgccttatttcccggtttttaaaataaccggctcggagcgtttccagtccacacgagtgagcgcgcagctgcgccccatctgcggcgcgatctttcacgaggctgggcagttgcgcgccccagagcctggcgcacctcgctcttctcccgcctgcagtccgccgcccgcgcagccccaggccgccctttgctgagagcgcccagccttgctctgaacccaggctgcgtgctggcgctgccagccactctcgcgccgtccgcgcttggctagtctgtcccgagtttggctctgacgtcgaaacacgccctcggcaagagactcctactagagttttgcccgctgccgctgaggccctgagccggatgacccggccgatcgccaaagtcgaggagagtcccaagttcttagacccgggctgaggcttctgggccaacgctgagaacccccaagaagggcaccgaggcctcaccggggtcctgcccacggcgtttatgtccactctggctttgagtcttcggcgggagctgcaggagcctgggcctcagcgagttctgcaggtcgcttagtgaccccacagtggccggaggaaacagtgcggcgcgggacaaggctgcagcgaaatgtgaaagccaaggctggtcccgcggtctcaatggatgccttctgtggggacagtggagcactcgggcctgctgcggcgctgcttcctggctgcacagtggcttagaagcagccgctggtaggggctctggcactcctccgggtgaggggtgctcagggtacggcaggcctgagagctgggtcagggacagagagctcctttactacgttaaaaggctcctggctttcacgcccaacagctgctgctgtggccctgcggttatgcaggcagaagacaccccagcgttgtctcaggctgtctccaacatgagtaccccgccttaaccacctagtgtccggatcaggtgcagtgactcctctgcacaatccatacacacctcagatgtgccccgtgctcagcagagcagccctcactcctttacaagcttaggttcaagctgctggctgctattcctggcctgtctttcctggcttctgccttccatttgtcccagttctatccctttcctcttctgggccttgctcctcaggaggctgctctgtgttctctgaggagtgcccctctcccaaagtggagggatgccaccctccctctggtgttctccaggtagatcaaggaggtttcagggcaatgacaatgaggagagcagttccgtggtcccttgagagggctgtagactgggcaggcatgggagttgggcataggtcagcaggcttagcctcttctttggggaagctgctctgagaagtcctactgcactttcatcccttgtccctggcagcttggtggctcaaggtcgggaacgcaagtctcagggccccagatctggtcccttcttctgggcaggtcctattgagacccaagaggcagatgagcaagccccagggctttggagggcctctgccaggatgtcagtactcttgaaccccagccctgaccctcagccctgagctaccctcaccccttttctgcctggagtccagcacagcctccctacaaacacaagacaccaagactctttcttctcaggctgaacatttccatggcctgctgtgtgtatgcatgtggtgggggtggcgggggcgggggggggggatgtcccattccagtgtccctagtcttcctatcattttcaattatttggttcaacttctgtgagtcttccttcctaagcttctatcaaatggaactgcctctaaacctgaaatgtgctggcccaagaatggaagtcagagactggaacactttctcccctgtgctccacctgagttgtgaaggagccctggtccctgggctgtagctgtgggctacctgtgtacaggcctgtgtacaggctgggcatggtccaaggctaggtagccctgctcgactctcccagtcctccaggacacacaccaggagcttatctcatggcctgggtagtcctggaaagtaactgaccaccttccagctgaggaggaccctgccccatttgtccttcacagtgcagacagggactcaccagacccagatcctgagaggcccatttctccagtcccatcctcccccaaccacagctgtgatcctgacaccaagtcctgggaagacactgcctcttgtgccagctagctgggcctcctcagggccaggcctccactggagatgggcccagagccaggcaagaggctgtgtgagtcagtggggcgtctttgtggcgtctcagctgccatcccagtggactgttgaggagggatttcatggggacaccgctgggggtccttgccagagggagagggtgtgggcaatcagagtgacctatttttcaccatgctctgtcggtcgatccaccatggtgaggctccgccaagcttctggagtaggggttagcatgtcagagtggggctgctggaaactgttccagtctgtaatcaagtccttccctgcctgttaaacacaggcaatgggggagcagttagaaactcctgaggaaggagggggtggtcaatgatgggaatgatggggacaggggctgtgccctgttgtgacactggtccccaactctccttctttgagcacagcctatctcagctctgcttctctattgctggagcttaagtccttgcccagataccacaattttaggaggaatggagagaagcaatccctctggaagcttctttgtcccatcttgcccttcttacaccagagctggggaatttgatattgacctgagacctggggttcagagaataaagctcagccagaccagccaaaggtggtctgagcacccacgtccacagcctgcctggccctgggaacagaggcgtgggcataagggcctgggaaccaaggcctgcagagttaggaacaaggaagcactttctggcaggagcaggagatgtcaaccaccccatcctcaccccgccctctgcccccattcttggccttgccagggtggtggtcctgctgtggcgccagtcctctcacgtccctgtggaacgcaccaccacagagcacttccccgaaatgaaccccactctggccccagcagatccgcccagaccacagagcacatagttccccagggccccctccccagctggaggctcagcaggcaggcctctaaatgccaggctcccatggagggtggctgccaggaggaagggaagggaaaggaagggggaggcggagactgaggcgtcaatgttcttccccctccctccattccaacccacaaaagcccctggttcagttgccatcctcccttttgtgttctccattgcagctgaggagaagacctccaaagctgccagcttcccccagctgcccttggactgccgagggggccccagagacgggccctctaacttgcaaggctccccaggcccctgcctggccagcctgcatcttcctctttccccgggactccctgactccatggagttggccaagaacaagagcaagaagcgtcgtaaccgcacgaccttcagcacattccagctggaggagctggagaaggtcttccagaaaacccactatcctgatgtgtatgcccgggagcagctggccctgcgcacagacctgactgaggcccgggtacaggtgagggcactgcaaggatggggctctctggctgcccctatcacacagtgaccagaaagtgatctggaagggctgggagaggtgggcactggtgcctcccagagctacctttcccaggggcctgcaccagccttcccctcctgggctcaccctcatgcccagctctgctgcagccacaggctcttctggtccaaattgaagcttatgcctgggtataagggcgatggcctctggaagccatcacctgtgtgggagtcctaaagtctaccacttactggaggtgatttggggtatgttaatagatctctcagtctcagtttcccagttcaggaaaagggaatgatgggactggctgcgtagggactatcctgaggatcacagggatggccgcattttggaagcggtgaagtgctgaacacacatcagggctgctcctgaggtggctgcctagaatgggagggtccctgtcaggaggtctcagggttagtgattctcaaagtcatcaggagccaccgaccttgggtccctgccagcgctcagaccctggctgggaaaggctggctgggaaaggctggctgggagcccttccccatcctaacaaaatcccccatggagatcaggtgccagggcttcccagaggggccatggccagttttacatggggggagcccagcctgtgggtaggtaaatgctgagaagggaggaaggcaagggaagcccacgtccaagcatgctggaagtgtcaagcacatgaaggtggcaagcaggctggggatggggaaggagtttcagtaagagtctggcccaagaggaagatggccattcactggcttgcactgaaccggctcgatcaaagcaggcttcccgataccaagcaggagacactgggaggggtgggttggagttctggggaaaggtgaggaggtgacctcttaggcagaggagtctctctcccaccatggaggagacttagcaggaacaaagctcatgctatcccaccctgcatggggcccttccagagaccctttgtgaaggcactagggcaggagatagtcctggcaggatatggggactgacaggccagtctataaagaggccagctgtcatctaacagagaaggccctacggctgcatccaacaggatgagagaggcttgggctgtttccccttctctgctgcgttctcctgcctccctgctcctccgaggagccaaaacagacttccaagactgtcccccaaggcctccaggggctgaggtcatcagggcaagaggcccggcattcaaggcaaccccagatgatataagccatgggaatcaggaccatggagtcacctcagcaggcctccggggtgtggtctaaccagctcttcccaaagcaagtgtttgtgggaggtggagagcacttcctctgctcctctcctaggccttttcaacctgagagggtgcaggagtagccatgaggccctcacccctagtctagaagcttcctgaaggatggagaccctggagtaggaatgttttctctggcaggggtgtgaaacccacccatacaccctgccctatggagaggaagaatgagactacacaccagataatgcagagggcaggtccagagcccaggggaggcctacagcgggatccccaagggagaatgggtggtgacagaaaagtgagttccaatagccagattcactggctgtaagctccctcatcctctgtcaggggagggagagcagagaaaggaaatccaggcagctgggcaggtgggggtggccttttgctgaccttgctgcaggcctgctttcttatcttggcaatctgggagctagggggatggggtatgcacagccccttcactgttggtgccttacctgcctgcatgtgtaggaatgaccatgggggcaggaagcctgatcccagctggggtagacggattactcacacacacacacacacacacacacacacacacacacacacacagctttcttctgttgtgactcccagctagatatccctggaaagcaggggttgttttgtttggttggttttattttgacattgttaaatttagcttagaggctgacacataaatgttgattaaatgatagaaatacaaaacatatataccaatacagttaaatgtaacagtcacagcacatataccaaacaacgaattcatcacagatatgtacacagatgtgcacaacacacagatgtgccacccctatctgccaagggctcacaaataaatgggagaaacagattccaaaacagatcatggtaatggaatggggtgagtacaaagagaggtccagggtattttggaagtcctgtggaggatgcccagtgtggatgtatgtgttgaggggatgagtagcccaggaagagaaaacctaagcaaaagatggaaggagcaagatagcagtgtttcagaagagctgggcgggagcttgggaggcaaccagaagaataaatgtgtttgcctggcaggatatgaggctgtgcagagaggcaggggccttgttaagaagctatgctctggaccaaggtctccagggagtcactgagggtttaaacaggaccatgacctgaacagaaatgtctaagattcctcggatgctatgaggtgggtagcctggaaaaggagatgaggcagggagactagaaacccaacacatgtacacagtatacccaggaagtacctagggcccctgaggcccacagatgcccccacaacacccttactagacacagccaggctggaggaccacagtgattcaacctggggagtgacagctggaggcccatggggccaattacccactgtgggcttgggcctctcccaggcttcctcccaggcttccctggcctggagaacagtgtggattaacagttgagatcctccatcctggagcctgctccccatcccacaagaggacacaaccatcagctctccctagcaggctcctttcctcagggctgccctatcaccccctcaaacccccacaacctgcccccaggtctggttccagaaccgcagagccaagtggcggaagcgcgagcgttatgggaagatccaggaggggcggaaccccttcacggctgcctatgacatctctgtgctgccccgtactgacagccaccctcaggtaagaccccagccctacctgaaccaggacctggcagggtcaccaaaaagaatatgaggtctggcctgaagaaacctggagagcgtcagcgttctgtatgacagtgggtacaccacttcacttctttctctgcaaaccggggctcttgcctgtctcatgaatgacgcatgcggaacacaaaggaatcacagaagaaaatttcgttttgagaacagtggcaggggcctcctgagatgccactgccagtgttgggggtgagagggggtagatctgagccaagtggaggtttcctggaaagtttctggggccccaaggacaaagagaaagcccctgggtagggaagtcagctcctgaggctacaggctcatgggccttctttccctctcttttcagctgcagaactccctgtgggccagtccaggatctgggagccctggaggcccctgccttgtgtctccagagggcatcccctccccatgcatgtctccatattcccacccccatgggagtgtggctggcttcatgggggtgccagccccttctgcggctcaccctggcatctactccatccatggctttccccccaccctggggggccacagctttgagccttcctcagatggtgactataagtctccaagcctcgtctcgctcagggtaaagcccaaggagccacccggccttctgaactggaccacgtgatcggttgcatggacctgcagaatgagctgcccacctctttttccattcccagtcgctcccagcccacctctgcctccaagccccagatggttctggaggctgcgagagcagctggcactgtcagcccccagcagggaacacgttacagggtcttttctcttagaacaaggtggggctgcctaggagaaggggcttcgaagcagccaggactcttcctaccacaaactgagtcccctcacctgaactctgggctggaggcagggagacactgccctgcttcctccagactttgtccaagtccattgtcatctctccagctaagacagcttacttggctcatcgttcagggaacccaggaaaatgggaggagaacgccgcgtggactgaagctcttcatgatgagatggaaaccaaaagggagtctcccatgatggggtggagtcagccctgcttcccctccccaccagcagggggcgcactggtgtctgacactaaggagggtgtaaaggccaaggtcagcatagactgaggcacactggctcctcagctccagccaccctcactcctgccatgtgcctgcactcccagcatgccatgcagtcatcttcccctccaagggggcagaaattccaccagaaatcaccacatatttggaatctcttccacgggaccagcccagagctatgccatggaaatgatattggatgttggtaagaataaaacagatttctacagactgagatcctgatccccatttttgtacagacacttttgtgttttttttgtttaaaaaaaaaaaaaaggagagagagagaaaaaaaaggctgcccagcattctaataaaggtggtggtgttttttataccaggtgactgtctatccccagggcttggcactggttgctttggggctggtctgtgtccaggatgcaggctggccacgacccctgagaggccagcaaggaaggggaaggtggtcctgcagcagagccctcaaggccgatgcatgccaggctgggctctgtcacctgcctagggtctctgtggctttggctgtgctgggaggcagggagaaaagctcagctctagggctgggctcatgtggcagggaaaactgagggtgggactggcagtaaaaaagctaaaataattttgtggctaaactgacaatggaaaggaggtagaatggaagaaaggggtgcccactgaggttctgtgctccccatgggctgggaccccagggtggtgggagtgggtcagcttccttccagatgccccaggaaatgtctgagctgtggggcagagacaaaagccagaactctttcttgtggtttcagagtattacccattctatccttcatcctcactttctgccttatctccgaagcctggaaggcaggaaaaaggtctggccctcccaccctcccagtaaacacaaccacattgctcagaagaattcagcctcaaccagcagcccggccacccccaccccacgcctcatctttcaggcacagagaaacccaagcccacaaagacacatcagggctgagctgattcgagaggagggggtgagtcccccaccagatcagatttcccagccaagacagtcgcatgtatccccagaggagtctgtcttccctcccttccttccccttccctctatacaagggtctggcttttggtgatttctttcctcttggtcttgacgctggctctgaggtccacaggtgtgagccctgtatccgggaggggacccagcagaaagaggagagtcagggtaggaaggagagacatccctggctgccactgatgaacagaatctccttcacctggccaggcagtaatgaaattggggctcaagccaaccattctgactccagggctcacaccactgtatgagaagtttcttcatccaaggagtcatcagcaaagttttggaccttcttccccaccaagtcagaaagatgtatagagagagtagtttgttctacaaacatttttgagtgccaactcagcctggcaatgtgctgggtgccagagatagagcgatggttgaggaaaaatatgattcttctctcttgagagggcttagaaatatgaaaggagggaagaggaaaggatctgtgataaacccaaacaaagaaaccagaagtgggaagagacaggagaaaaaataaaggtgagccagaggtcaatgaagcaagagtgggagaggctggcagaggccaggaggggacccatggcggggtcgggggctcctaggggagggcacagagaggccagagactggctactggctctcatccaggggcatctgcccacagctcatatttttctgtccagtgacagctaaatgaagagaaagctaactttacaaccgcccacttcacatataatgaatatgaatgggtatcccggagcctgttttgtgggattgtctgtgaggtgacaggtcctcctacttactgggccatcccagccagcctgtcccctgcctggggcatgagcagcccttccacctgcttctcattagctgtgtccctcctcctcccacacacccctaagacacggccccgtctccagataaccctgccctcagcctcactccagagctaacctcagacctccgcccaggccagtggttcctcaaggccaggcctgtgctctggccactccttctgggaagggaaaggggaagtggcccctcctgaaatcccagctcattttgctgaggctcctgtc

SEQ ID NO: 16548 - DNA, 32137 bp, Human
  misc_feature (1)...(32137): n = A,T,C or G
ttgctgttctgccgcatttcaaatctgaccccaggcattagcatcagagttctctatcaatataaagcctattataagacaaagatgaataggaatatatacacacatatataatgtattgtttacataggttaggcacaatgattcactattatcatttaaggaatggtaggaaccctcctgaaatctaacttcccagttgtatatgttcctatatgtatatgtgtgtatatatatattcctctgtgtgtgtgtgtgtaagaaaaatatatatatagcctagcatcatttcatcctgtgattagaattatggatagctggctccttacagtggtttatgcctgtaatcctaatactttgggaggtcaggatgggaggatcgcttgagcccaggacattgcaaacagcctgggcaacagagtgaaacccccatctcttaaaaaaaaaaaaaattaattagctgagcatggtggtgcatgcctgtagtcccagctactcaggaggctgaggtaggaggattgcttgagctggggaggtcaaggctgcagtaaaccatgattatgccactgactccagcctgggcaatagagcaggccctgtctcaagaaaaaaagaaatcatagatagccctgctttaaaagagcaacaagcgtgccaccaaaaaaataaataaatcagtcttgtttactaaaaaatgttttcaggctggccacggtggcttacgtctgtaatcccagcactttggcaggctaaggcaggcggattgcctgagctcaggagtttgagaccagcccgggcaacacggtgaaaccccgtttctactaaaatacaaaaaattagctgggcgtggtggtatgcgcctgtagtaccaggtacttgggagactgaggcaggagaatcacttgaacacgggaggcagaggttgcagtgaaccgaaattgcaccactgcactccagcctgggcgacagagtgagactctgtctcaaaaaaaaaaaagttgtctagagtgtattcataattacaaacagctctctgaaaagcatttatttgccttctctctttgggttttctccttctgttgaatgtttatttgatccttgccaccagcatcatgtaactgcataatccttccatgcttacacttacagggcaccctcccaaaccactaagctgtccttctgcaagcactttaatcaaaaagtattatagagtttgattttaagaatctgagaagcctcttgcttcttaaaaaggaacatgcataaatatgtgcagattttccagataaaactaaaaacacatcctttcgtctaaaatatactctggtttaaaatctggaatattggtgtgggagacgaaagacaatttcccatttgacttgtttgttttgttttgttttatgtggagggtagagggaggaaatgggaagagaaagttgaattatcccagtaattttctaggggtctcagccttaaccatttccaaaatataataaaaaaaatctcattaaaattactacgagcatacgtcttttgcaggaggtggttgaggtaatcagatctcaaaaatgcaattaaaatggggtctgaaaccccaaattagtaaccagaatctttagtcaatatacaaaaggccacacgaatgggttgagcttactgaagatttctgtttgtggcccaggaaatgcctctctcaccacccatccaggagttttatattctcctgtaaaataagcatgttgtgagaagttccctgaggaaatttgaagacaagtgtatgagagctctggagccccatccccctgccctgagcatagtcgccaaaaggactttccacttagtttacttcatgcttgcttttgagcctgcggcaaaaaattctaccttctgagtgactgtgggtggagggagggcctgagatgacatcaaatcacagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaaggtaagatgggaatgggactgtgtgctgggttggttttctaacaacgactggcatctctccccacccagcctgctcaccagatggccattccgcataccctgccagctgactttcctttccagttagaaacagtcagccttcgacccgacaggggaaataatgagtactgttcccccttcctcagaacatttacattttctttttgctatcattctttatatacacttgtttattttacggaaccgattgggagaaggtagcatagtgtcatgttactcctgaatactttagcatgtatctcctaagaatattctcttgtggaagaggttccaagaggttaaccttggtacagtattctgtattatacagtccatattcaaatttccccaactgtccccacaaactgtcttttacaacttttttttctgatctaggatatattcaataagcgggtatcgcatttcgttgtcatgtctgtttagctccaaaaatatttacatttagcaagtgttttctaaggagaattcctaaactcaaggctcgccttccctttctatttctcttaagagttcacccggaggaccagcagggtgacgcacagcttctccaagaaactggcttgcagacctggggggagggacactgagtacagttctaggagtggccaccccacagtcactgagatcaggctttccaggtaactaagtccttagttgcatcaggcagacttcatctgtaactgaggggttaaaaaaaaattacaagtggttttatatcatagggaaagaggttttttttctgttttgtattacatttcaacttttattttagattcagggggtacatgtgtaggtttgttacaaaggcatattgtctgatgctgagatttggagtataattgaacccctcacccagatagtgagcacagcatccaatagggagtttttcaaccctcctccctccctatcttgtagtccccagtgtctgtggttcccctctttatgtccatatgtacccaatttttagctcccacttataagtgagaacatgcagtatttggttgtttctgcatcaatttgctcaagataatggtccagctgcatccatattgctggaaaggatatgattttgttcttttttatggtggctgtgtagtattccatggtgtctatgtatcacattttctttatccaacccactgttgatgagcacgtaggttgattccatgtctttgctattgtgaataatgctgcagtgaacataaaagtgcatgtggctttttggtagaacaatttatcttcctttgggtatatacccaggaatgggattactgggtcaaatggtagttcaatttttggttctttcagaaatctccaaactgcgttgcacagtggctgaactaatttgcattcccaccaacaatgtatgaacgttccctttcagataaaaagtttaaaagtttagattagtttctggtccactgaatcaactgtcttggatttatcacagggatcttctgcatttaaaatagaagaggcatcatgctgaagagggaggggaaggtccaaccttacactaaaaccctggatggaggatggggatggatgattgtgattcattttttcctggtaagaattcacttttttccccctttcctattgcctaaaagcaggctttctggagaaaggctcagagctgcctacgaataggatcacttaggaaatctttggcatctgagtggaggggtgggcaggaacaaggccaggagctgccaaaaactgctaaagtcagaggcccatgccgaacccaggagaaagttgaaaatgcccctagagcaaaagcagaaatgttcctgggctgggtgtgggggctcacacctataatcccagcactttgggaggcctaggtgtgtggatcacttgaagtcaggagttcgagaccagcctagctaacatggtgaaacccgatcactacaaaaatacaaaaattagctgagtgcagtggcatgcacctgtagtcccagctacttgggaggctgaggcaggagaattgcttgaaatcaggaggtggagactgaagtgagccaagatcgtgccactgcactgcagcctaggcaaccatgagagactctctcaaaacaaacaaacagaagtgttcctgaatccagtcatctactcttcctatcatctcttaaacctgagaatgctcagtcacaatcagcagttctgtactggctgcatggcaattagggtttggggacaatcatacttttaaccatcccaaaagtagcactgggaggtgctaaaaagtgctctgggggtgatctccccagttcagcccagcatagatagaacactgtgggcacagccccttctaccgataaggggtggggacatttcctctgtttggcctgctgtctacttcccaatccatccccactaactatagtttatgctatctatatttccgatgtgtttggaaagggaggacaaggattttgaagggggagcctgattcttctcctttacccataagcaactagacgaggcattccattttttaaattaacttctttccctcaccctcccaggggttgaggtgtgacagtggtgatctgcatcatcagcatgcccattccagaatgttggtgaaccccagctatgccccacacagctctccagagagtggcaccagctgcacaattcttaagtgtttccagagttctattaactttgagatgcactcaaaaaaaaacacccttttcttgccgacacttcccccctactcagccctacagtaagcagctcacggggaaaggtagcacaggtcttggtgccttctaataatcctatagttcacatgcagatatctaagaattctacaaataggatggtgggaaaacatcaggcctcctccctcgtgctagacaagataggggcagaggtccccagccaggatttatgtaatacaaaactcttaacacataatagtagtacttgctaaacattagcttcagtactaaacaatctcattttccccctagaatatgttattttaggggaatctcattttccccctagaaatgttactaatagggaaactaaaggatgccctaagtctgagagcccttcctggggctgggccacccccctaaatcataggctttgcagaataggcactgttggtgaggatctctaattctcctgcctttctccccagtaaccaccctgactttttctacattatcctctgaggatagaatggtttttgatcaatttagttgctgataggaaaaaccatctaataaccagattaataaacactgtcccacttttagggtgtgatactgcttactaagcacaaaaaatgcactggatcctcaaaatgttaacaataaattcaggggctaatcccccacagttgtaatgtggatacttgaatgactgtgcttttgtttctgtatgacttacaactgttcttttctataacagatgagctcctagtaagtgaaaaataacaatgttctttgggagcttcctacttaaaaaaagagagagagattcattctaaccaacttaccacactttatatatttgtatgactgttttctgtattcagtctgtcttactagactgaatgttccatgggggcagggtctatgtctgcattgctcatgagtatatgctcattaccgtaagcccagtgccagtatacagcctggaacatagtaggcactcagtaaaatactgttggtggatggatagatggatggatgaattgatagctgcacacatttatgaataaacaaataaggatgaaggggatagttgatgaaactgaagagatgagaatggctcttgaggctatgagaagctaatgagaaaaattaagcagggatgtgatagatttgcatttcagagaaatgtgacgagcagatgctactgagaggtcaaataggagagaaataacaagactctattggtttagcaacaaagaaatctaataaccttgataagagctagtacagtggagcagtgggggccaaagttagtgaactttagttttcagtggagtagcagaatgacagaaagtggagatacctaatagaccattttttacagaagtttgcctgtgaaggtcaggaggagctagggtgatactagaaaaggacgcaggataagaagttgttattagataaaactaactctgacaaagcctggtgcctgtattgaaaataagtcactgaggctgatccaactcctttcccagacaataattaaaatgatctagtgaggaagctcttattggaggtggggtgtgggggaagtcctgcttaaggtgttcctgccaggttcaacccaattaactgctcttaaaaacaaaaagaaaatgaggggactggagaagttctagggtttttgctttattttggagtgagccatttacaatgtatgacgtggactctggtaacagaactaaaacccaccaagcttggtctaagacatgggattatgtagaataatgcagatttatgtagtctgctaaattaactaaggaaaaacctagaccttgggagagatttttaatatctttgagtcaaaactgaaacaaagttggaagacttcaagttaagggacgggaagcatggtaggtgcaaaggctctgcccttggtcttcttgatacatagtggacacggactcagttattagagacaagtcctaaccattcactgctgctacacgcagacaccaaggacagaccagagatgaaaagctctgaactgggggaccagtagctagctaaatttaggtagctaagaatatagaggtcaacatcctctagacaccagcacagaacccacgtccatagaacaaaaggaagtttactttacagaatgatgcactgtattattccttgctcatgagaggacacaatcatcacattattatgaactgagagaagaaagtctaagtcatttgagatctgtgtatattttctaacctaatttctagcctgacagaagtgccttagaggaaaattatggttataaattgcctcaatgggggcctgataaaatgtctttttaacttttgaatatatagtcctggcgtttatagcactcttcattctaaataagttttgttccttttatcaaatcagaatgggaaaaagtatattaagagacttcttcctcaccactaccacttttgcaatttctgagcatcgccagtagtgatggggtgaaaagaagggggcaggtcttgaccattatttaaaagcaggggctgagggagggaggtgtctaagagaaagcacatctgtcactcaaatgaatgggtggatggtaccaatagaaaaaactgaaaagagtaggcataggataagggaaatgtgagtttatgtttggacaagttgaccagaagttataaagatatggtagacaattaggagtctgaagctcttgggaaagcagaatggaaaccacagttaattgtttgagtgttaagtgccaaatattaagtactttatcagaattttctcaattaatcttcacagtcttatgagctaggtaatattttcatccccaatgccgcctcccccatcataaaagcggaagcttaacccatgtgacgtgcgaagttgtttgcccaaggtcacgccccagtaggaagaacagcctggatgcaagttaaggcagactgattgcagaaccctgttcagctacaccaccataagtatgcaggtggtaattaaaaccttgagagtaaatgattgtccagggagcagatatcaagcgagatgagtacagaactgtaacaggcgggccgagaaagtggaattaatgaaggggaacctaaggctttgtggttcttttattattattaattttgagacaaggtctcactgtcgcccaggctggagtgcagtagtgtgatcacaactcaccgtaccctcgacctcccaggttcaggtgttcctcccacctcaccctcccaggtagctgggactacaggtgttataccactacgcccagctaattttttgtactttttgtagagacggggtttcgccatgttgcccaggctggtcttgaactcctgggctcaagcgatccacccacctcggcctcccaaagtactaggattataggcaggagcctccatgcccagctggttttgtggttcataagcaatgcatggccaggttgaaagcagaagtggccttgaaaagccaacgctacgaaacccctggagacagagagtacacctgggctttacgagtgaatgcaaaccctggctaggttcccctctagacccctgtgggataaagcatgactgttacttaaaaacggaaagaaggaatagcacttaacagccccccggctaactagaattctgagaaataaaagttaatactccacagaaagaaaacctcatctccaaagcagcaattctagtggagtacaggtaaggaagattaggtggggcagaaagaaaaggatggggcccctggcccaaccttaagatggccacaaatcccagttaatccaaaattaagcaccccttttcactcttgagtgtctcaatttggatgatacattttatggtcaacctatttatatatctagtgaaggaaggtactcagctcagcagcagagttaaatcaaaactaatctaagaactgacaggaataattattcctctttggacaaacacttttctcccacaaaggtaactggaattagctgtctttaacagatgctactgagggcagtaaaagagtgccaggtctagagtcagtctaatctgggttcaaatctcagttccagtacccctattttaagcaactttttacctctctaaacttcaatttcctgatcttggaactgctgttgcagttataactgagaaaattattacagtgacagagatctgacctaaccaactccatccatcctgcttctaacttccaagctgtccttgttcattcccatgcgtaggctgaactaactttgggggaaacttagttgatagcttaactttgaaagagaaactaacagccgtttccaaaaaaaaaaaaaaaaaaaaaaaaaacctccttttaacagccctttccaaaaaaaaaaaaaaacacttccttcctgcctggggactagattgcctttgtaggactaacacattagccataagattagaaattatggtttaggagtcatacagctggaggccacaagactgaccctccccaaattgctcgggggataacatcactattgtgaaacctaagatcagtgcttgagataatttgcaggccctgcatttgatggatcagctggcaccacccagattaataaactggctcatctggttgtgggtccccctccacccttccacccagaagtgactcagcgcaaaagggcagctttgatagaatttcatctctgacccaaccaatcagcactcccaactcactggcctcccacccaccaaattatccttaaaaactctgatccccaaaagctcggggaaactgattggtctaataaactccagtctcttgcacaatgggctctgtgggaataactctttctctattgcaattcctgtcttgataaatcaactgtatctaggcagcaggcaagatgaacccactgggtggtttatttggtataaattatttggtacacaacattggcatgcctattccaaagccatgaaatgaggattaaatgagatgtttccatttaaaatgcttagctactttaaaaggaatgacttcccccataaaatataagatgtataatgaggctcaaccaataaggcaaactggtaaatagtagtaagctgagggaatcataacttctagtagccgtaattgcctctgtaatggctcacttaccacctgagttggactctggtctgctttgatttaggtgaatgtgtttgtgatggggatgaccaagacttttgcaattttctttgtggtctttcaagaagagtttgaaggcacctcagagcaaattggttggattggatccatcatgtcatctcttcgtttttgtgcaggtataaagctggcaataagcttgctgtctaaggagaagaaccacaaagggcaattccaagattcctattcaagactgaataggaattcagtttctaaaattaaggttcatttactgatatgtaacgctgagaaagtaaggaattgcaatatttagcttccacttgacttagtaacaaagttgggagaatcagcattcaaacaaagaaagctgaggaattattaaatgccatgattcagtatttcatgcattgcctttccagtctgttaatgccttaatataggttcaatgagtaaggccctcaacctggaagttaggccatgaagttctagttatctaagtatattcaaaacaattttatttattttttttttttgagacacagtctcactctgttgcccaggttggagtgcagtggtgctatctcggctcactgcaacctctgcctcccaggttcaagcaactctcctgcttcagcctcccaactagctgggattacaggcgcccgccaccatgcctggctaatttttgtatttttagtagagatggggtttcaccatgttggccaggctggtctcaaactccagacctcaggtgatctgcccaccttggcctcccaaagtatgggattaaagagccacggcgtccagcctcaaaacaaattatagaaccaatttcttctccttttatttggagctgtaacagggtggaagagcagataagtgattcaaccttattctagtcattgaccactagatgcaatctttttgtggaggttctataatgcatttcaaatcacctcccctccaaaccttacttacaatcaacatttccttttaaactccccttccaaaaactaaaatagtgtggcactagtgatattaagaaacccgatatgaaaatcttttttgaagaatacgtaatacttcaaagtaaacagtcctcttgctttccttgtcattcatttaaatcgccatcagaggataagggatgccagatcattatttacctaagaattgcctttctttcttctcttaaggtcccctggttgctattatttgtgacatacttggagagaaaactacctccattcttggggctttcgttgttactggtggatatctgatcagcagctgggccacaagtattccttttctttgtgtgactatgggacttctacccggtgagtccattgtaattatgtgaccatagaaggccaggagtggtggctcacacttgtaatcctagcactttgggaggccaaagtgggtggatcgcttgagtccagttcgagaccagcctgggcaacatggtgaaaccctgtctctactaaaaatacaaaaattagccaggccagtggtggcacatgcctgtagtcccagctatttgggaagctgaggtgggaggattgcttgagcccaggaagctgaggctgttgtgagccgagattgtgccactgcactccagtctgggtgacaaagtgagaccctgtctcaaaatatgtgtgtgtgtgtgtgtatgtatatatgcatccatccatagaagatagaagatggaacaggactcttcccttctactgttcctgggtccaaaaggcctagctgtattatctcggatccaggagattatcttttctgttaccaagccacttaatgtaagagtgattctaaactattacgtttttcttttaggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtacgtcattctaagtttatttactatcaactgtgcaagatttagcgttcagctttctccctttgagaaatggaagttaagactttcagagcaatcgatttcacaaggtattgcaagagaggaaatgagcataatttctaaagtaaacatgcttctcttccctggagaatacatacgcaaaagagatcttgaaatacttgcaggctttgccagctcacacaagcaactcagaattcaccatagggctcaatgtctgaggagatggagggcattccgtgcagctggaaacagcttgcagtaaaagcgatacttctggggaaataaggcttcccccttccccccccgcccccgccccatcaaaaaccctcacttttcccattttccctttaagacaaaaatctgcatttaaaaaaactcctcccccatcggactcactgaaatagataaaaaagaaacaaatactttggtaaaaagagtatgttccttaagagtttatgtaatgtcaactataaattttcacaaatgaataaaaaatgattcaactcacaattttctttgtaactaagacatttggattaaaataatcctaaactactggaaaaaatacatgtatatgtgtgtattcatatgcctattgctatctacatggcagttttgttgaatctttcctaactattcagtagtctcatggtgaatgggaccagctgacaaatccatgataggatagcagaacctatagcccattctatctttagaagcaccatacaaatcatagctttgatcaggacacgctgaatgcaagcaactattcagctccaaaggcaagattagcatctgtcatcttttaaggaagatctaaaaaatgtcatgggatgaaaggctatccatgccttcctccctcccgctgctttttttttttttttgagacaggctctctcgctttgtcattcaggctggagtgctgtggcatgataccggctcactgcaacctccacctcccaggctaagcgatcctcccacctcagcctcccaagtaactgggactacaggtgcacaccaccacatcaattaatttttttgtattttttgtagagacaggttttcaccatgttgcccaggctggtcctgaactcctgggctcaagtgatctgcctgcctcagcctcccaaaatgctaggactacaggtatgagccatagcacctggccagctgtcccctcttctaaggctgtttccaaatgatttctttcatcttattctattttttctgtacctaaatctgtactctcacttcaggatatttaaattttctatttaattttttagcatttgaaacactctcctctccctccaaaaacttgccccccctaccccccttaacacaaataaccaccatctctccttttatcccatctattggtgcagctttctggttttctatctccaaagcactacattattacacggatacagcagtgtatatgactaataagtcaaatcggagacaaagtaatgttttcaagaattaatgggctatgccagtggggcctcttctgagcctatgaacacaaagcagtattgtgaactgaaaggctatttttaattgctcaatctctccctatttaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtaagaaagcctacatcagcctcctacccaaaaggaaagatcaacttaattttacaagcttattacattttaataaaaagctaaagaaaaacaaaagaggaattgtagaagggccagagaaagtaaaatttttgaggctagatggagcacctgggcatttcccaggaagagatctctgtcactgcacacaggctcccctactagacagtggaccctaaatcaagtcttattcatcttcatataacagtgtttgacacagtagacattatttattggataaatgcggaaatttcaaaaagctgatgctcaatagcaatagccactataaggaacagaaaaccccaggtagacagcacagtgcagtggctcaaggattggttctggagcaagacttccctggctcaacctcctgctctgtatttcttaactgtgggaacttcagcaagttactttgcttcatggtgccttcatttcctcatctgtaatatagggataatagtatctaccctcataagattgtcaggatcaaaaaagcaatgcatgtagagtttagaatagtgcctggcctgtagtaagcattcaataatgttttattatttgtagctaaggaattttccccttgaactcatagtaaaacagataaatatgacttttaaggctagtcacttatggactgtctgatatttaaaataagttaaaatgtaaattaaaagtaaaaacaactggccgggcgtggtggctcacgcctgtaatcccagcactttgggaggccgaggcaggtggatcatgaggccaggagatcaagaccatcctagctaacgtggtgaaaccccatctctactaaaaatacaaaaaattagccaggcgtggttgcgggcgcctgtagtagcagctattcaggaggctgaggcaggagaatggcatgaacccgggaggcggagcttgcagtgagccgagaatgcaccactgcactccagcctgggtgacggagcgtgactccgtttcaaaaaataataataaaataaaaataaataaataaataaaaacaactattttagttgactactcataaaactgtttaaagacagaatgcttgatctagaagagggatttggccaggtgcagtggtccaaaatacaatctcccatttccaaacttcctacatattttcaaattaagcataaactttggaggacttacttcctaaaacttcgtatgcaattatgagtcccaacatctccttttttaacagaagacttatttatactccaatcttctacaatatgacttccccaagacactgacctgaaggtctatttgtcttttagaaacttcattttctcacttgcaggacctcttagacgaagagactgcatggccttctgtgcccagggtcctctgtaaccagggattaccactgtagtgacgtaagctttccaaacacaatcagaaaaaaacactaactacatgggtcttctacactactctagcggagacttttttgctattttattaaatgtatttggaataggtaagtatataatagagcttactggtacacaaatcaaatcgtttttttcctcacatatcctggcctcaggatgagatcatattacttgggaaatgatgctgtatgcattcacatttttcaaagggaccaggaaaataaaaagatttcaatattgttccaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggtgagtagacacactcattaacattgttaaaccatttagtaaaagcaagtatcagtaacaatctccccaaaatacgtattttgtattaattttgtaacttaaaaaatcatttcaaagaccttagaaactctgcagctatatcctgtccagttactcatcttgtgtgtgagtggggagggatggtgagaggactatccacatgggacaggaataaaattaaagcaaaaaagggatcagcaggattcctttttacttatcagtctcctagattaggattgtgttcacgtctctccttcagctccagaaacttgtttggctccttttaagacacaatcttaaagaaaagatccctgagaacacttcaagagaaaaaaggatttcccgaccagtgtggtttctctcttgaagttattgccttggtcctgtgtactttcacagggccattgttttatacttcctctccatttttaccctaaactgacgcaaagtcctcgacccagatggaaccaaaatacttatacaaacacttcagtgttctgggaacccctgggagtctcatgggttctccttagaaccaggacctaaacatgctggaacagatttcctagaaaacttctgttctatcaatattagcgtaagtgctacaggatattatatgaagtgcaggcaaaaatcaagcttcctaaagctgaaattaactccttgtgatatctgattacttacaaaccaatggttgatacttagccttagaggattcaagaatatcaccgtctggccgggcgtggtggctcacacctgtaatcccagcactttgggaggcagaggcaggtggatcgcttgagctcaggagttggagaccagcctgggcaacatggtgaaactccgtctctacaaaaaataaaaaaattagccaggtgtggtggcacgcacctgtggtcccagctacttggaagtaactgggaggatcgcttgagcctgggaggtggaggttgcagtgagccaagatcacaccactgcactccactctgggtgacagagtgaaaccctgtctcaaaaagaatatcactattaattcatattgtaaatatcatttcctaataagagaaaagcagcaaggtttggggaagaaaaagtacccatgaaccacctaaaaaattaaaatgaaaataaaaacttgtgttcttactaataaactgaaaacactgcctgcctagcatttactgttcgctattagtcctcagctctttcacaatattgggggcaaaaagccaaccaactcaccccagaagtcactgttcatagcttgagatgatataaatagtatttgtcccttttaggcataggtctctatagaatttcacccttaatatggctaacactgaattctaattcctacaggttgatctgtgtaggaattctacagtaaacaggtttttgggacttgccagtttctttgctgggatggctgtcctttctggaccacctatagcaggtaacaccttcaccacattctgaacaaatttcaatagcaataaaagagaaaaactgatccaggattaatggtaacatgtaatgatggtatcaggttaaaagaaacagattatttctgcttttcctatatctactcactccaccaccaatgcaggaaaatctgaaggctcagattcttgtattatcttaagatgtgccttaagcagattcttatattcttgggagttgtagggcagacactggatctatgtctacttgtctggggagacaatccagagttttttcagagcctcaaagacccatgatgctttaaaaaaaaaaaaaaaaggctgggagcaattgctcacgcctgtaattctagcactctgggaggccaaggcgggggtatcacttgagctgaggggttcaagaccagcctgggcaacagacagaccttgtctctataaaataaaaaacaaaacaaaacaaaacaaaaaaaacaatgaacgactagcatcttgtatctaaacatgagtcacttttatagagcttgaaaggtataggcctgacacttttgttcttctgatgtgccatatggatgtccaagattgcctgttatctgttaagtatctctctttgaaaagaggcccttcaaattgtcagtaccaaggatgggaggatacttggcctaaaggccccatctctatggagaggatattgggggctgttggaaattattatatacaagtacagtaaacatttggggagttctgatatgtaagttaactttaagattcaaattgtagttttacattcactttttacctaattagacattctgtacttgctgaatatttaatctaatactattacaaacttgaatactcacacagaagtatttctagggaacagacctaaactttagtttctcacacaccacaggttctcaatgtatttcagtgtacaaattactatgacatttctaatcatccacataaaggaacttagcctaaaacttacttttgcttcttttagtcctgaagtaagacagaagggagttaatcttgtcctactatcattttttaaaaaattaagtttcataatgatgttaagtttatacctcttaagactgagaaaggggccaggcgcagtggctcatgcctgtaatcccagcactttgggaggtccaagtgggtggatcacctgaggtcaggagttcgagaccagcctggccaccatggtgaaacccggtctctactaaaaatacaaaaattagccgagtgtaatggcagatgcctataatcccagctaacttgggaggctgaggcaggagaattgcttgaacccgggggacagaggttgcagtgagccgacttcactttgcaccacttcactccagcctgggcaacagagcgagacttcatctcaaaaaaagactcagaaaaagtaaatattaaaagaaggagactataaactaaggataacaagaattgttactgagagggcctggcatagtagctcacgcctataatcccagcacttagggaggccaaggtgggaggattgtgtgagtccaggagttccagaccagcctggacaagatagtgaggcaccatctctacaaaaaaattttaaaaatcagccaggtgtgatggtgcatacctgtagtcccagctacacggcaggctgaggcaggaggattgcttgagcccaggaatgagtgcagtgagccttgatcatgccactgcactctagcctgggtgacagagtgagaccccatctcaaaaaaaaaaaaaaaaaaaattattactgggaacaaaaaatatgccaatagctgaggttcaattaaggcatacttattctaaagaaaaaatttacataaatatgcaaccaactctcttatttgcatttatgaacacaccccttcccatgctatctaacacttagcctacgtttcatacctggaaagcaggctagaattataaagtaaagcccagaatttttatatagggactagtaaaaggaggccaaataccagaagtaccttgcacaactactctatggctagtacccaggacagtgaaatacagaaaacagagctcaaacacagtttgctgatgcatttttttcaatcttgatccttcttcattggctgtcccagtagtgccttggaatttttcaagcctattgggccaaaagtacaaggaagtaacaaatacaagggcatagaatatcttactcaaatgaaaaagacaagcaacaaaactataacatgtttaatgtcctatgtgtctttgtatacttcttaaaataaaatgtttaaatagttcaatactccgagaagacaagtcaaatttctgaagaccattacctgaaaagaaaaagctacaggtatatatgtgagttctgaaataaatttgttgggtcatgatctcattgtttttatggaaaaagatagactaccacagagcagattaaaaaagagtatatcactttattttcaaacttttatttcatacacacacacacacctatgtaatgtaaaatatgagatataaaatacttctgtcaatgagacaaaaaaaagttaacaagcttttgttagcccaaatccagtatagcctagcaccatacgtgaggataaaaaactcataatatattttttacccattaattcagagactattacttaggcagccatacattctgtaagctctacaaaaaagtcaaaggaagctataaggttgttgctaaagcttatgtagaaatttttagtccaggacgtgctcctagtatcttaaacaagattctaactgcaatgctgtgccattagccatctgttgaagaaagaaatcacaggaaagctttgttcctctaagtcattcctccgtgaaatgacagaggacattacaaaggccattagatttgttcctaacttctgactccagcagcaactaccaaagaaacatcagaaatgttgatgtacagatcaactcagttcttgcaggtgtaggcagaactgagtctttaattgaatcaaaagtctttaattgaatttactggtgatgaaacattaaattctcaaccaaacttagatcttcagaactgtatgagattctcattttttacttacctaaatctgttattaccaaattgcaaaagttgaaactcctataaaagagtataggcatttttaattaggaatctaacaaaagtaaaacttttcataataatcttcagtcaaaacactagttaaaaatggtaacatttcagccatgctcttgtagatcacacagacaaaaaaaggtaacacattacatgaacaatatttctctccttcctgtataaaaataaaaaagaaaacaatattagttctatgcaacatattttaataattcaaggaaagcaaaaatagcacaagaaattcatagaaccatattcttatttttttttaatatagagaatacgggcaagaaaattacacacctcaattgcttacatttctttcatgaatttaagaaagcaacaaaattctttataagatctttgctgaaactgagagattgaaaggatgaaagttaaaacttaccggtccccacacctcctctgtaagacaatgccctgctcacccactccaccccaaagtcccttcttattccaatactcagtgacaatttcaattttaattaaaaaatatggcctgcattagagtaggtgagttttaggattgttccaggttccctgaccagggtggtgagtagacctacgtgtaggccaaatgtcacacagctcatccaaacccaactgctgcttttgcggttagatggcacccagagccacacactggcacaaagatggaagccttggaaggctgtggaaaaatgagaagtattgatattttaagccttatttctcacagacccctgttaacagaagtaaacctgcaaaaagcaatataaatacaaaaatagtgccttgggcagaaaagcaagtatatctaatcacattctccaacatacagggcagatgtaagctacttacatgaaattcctactcttccattcaaggcatttgacatgaaagctcaaaatgctcaaggctcagtttcattttaaaataaaaccaaaggaccatattagttgcctataaaataaaaactgaatgcagttccccacttctccatattcccctctttcccaactgacaaatgcatacagtatgctaatatacatatataatcatttatttaatcacaaatatcttctgaaaactccctaaaacactataagtaattatttgattacttggtaatcaagtgactatcaaataaatatttgaaacttagcattcattcaataactgtcaagcaaatcactagcatagtactgttatatgctatgtgggacacacagaagataaaagttactcacagtcctcacatgactcaccaggtcgtgaaacattattcactctgccacatacactgccaggacttcatactaagaacagtctagaacctctacaactgtgaattattagaatctgtatccttcttctacttcattaactgaacacctgattaagccactgtagcccatcaccttattttcttacctttaattgaagacattctgagttgtgggataataaaatgactttaaaatatgttgaagtttaagtcaaggcaggtatttcacgagtatttttcccccaccaagccctagaaaaatcatttctaacgccaaatagttgtaagtcaattgtactccagcatatgttaaagtcagctagctcctaaagaagtatgtctctctctattatttaccgatctcatcagaaataccatggagtgagactggtaattttgcaccaagtctatttgtgttttatggaaaaaggtaagtgctaaaatatatattcattcatctaagctcatctctgtcccattatcacagaaaagtcatctcctcatgaaatgataggtcatttcctatctatcccatcctcaatttcagatacagtattaaacaaaaattccatctggtcctcgctccactattaccaatcctgacctctagagttttatcagtcaccttggcctatcaattgcgaatttctctatggcctaaaattttacttggaaaacacactctggaggttgggggtgagtggggagaaagtgagaaggcagagcaaagccctgtcctctatatgttctgtggggggaaaaaaaggctaaaaaaaagtaaatattttatgtatctagtgattattttccccataaactacaaagccttacagatttttactttgattcagttttcctaagattgatgaatacctacaaagcatcaaaaataaattccaaatagctctctattgtggtttaagaagaggagttcttcccttttataacacactttgcaaggccaaagaatccagcttccacatcctaatagacaccacaatccttttaataaaaattacagcacagagctaatacttgaagcattcctagtaaatcttattgcaaatttctatcaaggaaactttactgagttcccatcttaaaaggccctgaaatttaaatttgctaagccaagtttcccaagatttttccgatcatggcacatatagaaaatatttgcacaatacacccaaagtaaaagaacaagattgccaatagccagctggtggctccagtggccccagggatgagaggaaaattgtctttgcacaccttggaaatttgccactatgctacaacccaaccacaggagttctgattcaactctgaccagtcacctgcagaattttcaaccactttagaactagcaccaagaaactttggaattaaggaccttctaagttttttgtttgttttttgttttgagatggagtctccctctgtcacccaggctggagtgcagtggtgcaatcttggctcacttatccaggttcaagtgattctcccacctcagcctcctgagtagctgggactacaggcgtgtgccaccatgcctggctaattttttctatttttagtagagatgggattcaccattttgcccaggctggtctcgaannnnnnnnnnnnnnnnnnnntgtgagccactgcacccggccatgttaagtttcaataagatgaaccaatagtaaacttacatagtaatcctaataaaaatgattcatgactgggcacagtggctcacgcctgtaatcccagcactttgggaggctgaggcaggtagatcacgaggtcaagagttcaagaccagcttgaccaacatagtgaaaccccgtctctactaaaaatacaaaaattagctgggcgtagtggtgtgcacctgtaatcccagctacttgggaggttggggcaggagaatcgcttaaacccaggaggaggaggttgcagtgagccgagattgcaccactgcatttcagcctgggcgacagggcgagactccatctcaaaaaaaaaaaaaaaagattcataacttagcttaacaatcaagttctgagattctgagatgtctgaaggtatgaatactttttagacaggatgctaaattccttttgaaacatgtatggcctaacacataaaataatgtggaatagttttaaaatattaacacttaaaaaatgagttcagaatcctatattaaatatctaacttgaatgattattcttattcctttttaactgactgtaaaaaaaatggtttgcaccagtatttaaagaagctcagcccaatcttcctatttgttttaaattatcacaggaaacattactagacatttctgcctaaaacaagtcctatagccatagatataagaaaagagtctggactagtaacttcaaatacaataattattattgttaaataataattttactgtgcgtaagaatcaactgagtgccacccaggatggagttatgcttgacagaatccagtgaatctgcattattaacatgcatctcaggtaaatctgacgcaggtagcctgtagacaccaaggaaatgcttacagaggtcttcagcttaataattctgcatcagctgccagtttattcctcagagtgctggctacatacagtaataccaggcatagagtgaacattcagatacatgcacattatcctagattataactggtatgtaatcttgtctttctctgacgttcacaatgcttatgctatgaccacaaaggaatctagtcttttgaatgtcaacttatgtgtgtgcttccatttaaaatggtgagaatacagtggcttctgaactatcaacaatactttcttttaaaaatatttacttggctgggcgcagtggctcacgcctgtaatcccagcactttgggaggccgaggcgggcagatcacgaggtcaggagatcgagaccatcctggctaacatggtgaaaccctgtctctactaaaaatacaaaaaattagccgggcacggtggcggacgcctatggtcccagctactcgggaggctgagacaggagaatggtgtgaatccgggaggcggagctgggagtgagtggagattgcgccactgcactccagcctgggcaacagagtgagattcctctcaaaaaaaacaaaaatttacttagaagcattaaaccgtttagggtccgaagtgcatctgaacagatttttcatcctgttaccaaaaaaatacagagatctaataaaatcagacactcgttctctctccctatatatatatattttaaatttttgagacaggctctccctctgttgcccaggctggagggcagtgacacaatcacagctcactgtagcctcaacctcctgggctcaagtgatcctcccaactcagcctcctgagtagctgggactacaggcatgtgccatgacacctggcttttttttctttaactttttctttattcttttccaatatttttctaaatttaattttaatttttgatagaatagggacaaagtctgactgtgttgcccaggctggtcttgaactcctaagctcaagtcatccttctaccttggcctcccaaagtgctaagattataggcatgagccgtcacgcctggccaacacccagctaatttattacttcttttttgtagagatagggtctcaccacattgcccagtctggccttgaactcttgggctcaagtgatctgcctgccttggccttccaaagtgctaggattacaggcatgagccactgtgcctggccaatccttttactttcagcagtagagaatggctagttattccaatcaaataaagtagatgtttcaatagcaacgaagctcaaaacttaactaacctagtagccacttaaatataagcttgattttaacaactaatactttcataaaataatcagtcatatgtatatttctgcatcctacattttacctcatatttgctagtataaacagcatcctaaaactaaatactcagctgtatactattatcctattgaatggcaattggatcttaatttagaatctaaaaaatacaaatatctcaatgatcaaatatgactgggagaaacaaatttacaacaattatttcatccaggttttatttcacctaattttgcatggaaatacatagaaataattctaaaacatgctaaacaattccccgccctggtaagaaaatatattaaatatagtcatgagttatttaacagggatacattctgagaaatgtgttagatgatttcattgtcatatgaacagtatacctacacacacctaggctatatggtagagcctattgctcctaggctacaaatctatacagcatgttactgtgctgagtactgtaggcaactgtatctaaacatagaaagatactcgtgtatccaaacaaagtattcatgtatctaaacatagatacagtaaaaatgcatatcataacctcatgaggtttgtcctgttatgtgccacatgactatattttaatacttaatgtttcagaaacagcattctaagagtgagtgaaatccaagcactttagaaggctgaggcaggcggatcacctgagatcaggagtttgagaccaacctggccaacatggcgaaaccccatctctactaaaaatacaaaaaaatgagccgggtgtggtggtaggcacctataatcccagcaactcatgaggctgaggcaagagaatcacttgaacctgcgggtcggaggttgcagtgagccgagattgcgcaactcactccagcctgggcaacagagcgaggctctgtctcaaaaaacaaaaaaaaaagtgagtgagtgagagagagagaaagagtgtgtgtgtgtgtgtgtgtgtgtgtgtgtgtgtaaaatgaaaggcttggtcggcatgatggctcacacctgtaatcccagcactttgggaggccaatgcaggaggatgacttggggccaggaatttgagactagcgtgggtaacttagatccagtctctacaagaaattttaaaaaaagaaaagaaaagaaagaaaaggcttataaacagtttttctcttcaatccatttttactatttttagctgtgctatctgacattttagtagcactgtctacctttttgtccaagaattcctagtctttccccagggtgttacttctgagaccactattttataattcacaggttttatatatacacatatacatacacagacacatacactctaatacatttgctgtgttggcaggactaaggcaagaatgacaagggatgggagggtaaggactgctaccttctatactccttcctttctagaaatgtctacaagagttcagagactagtcacctatttcttagagatctataggtcaataacaatcaacataacacaaagacttgtccagttgttttcactccagtaactccaagaaacatttaatagaggtcactaatcaaacaggagtcagtaagtaaaaagcaacttaaagttagttgaacttaagaggttataaaacattctattcacttattttttacattaacaataggaaacacagagctataaaacaaaaataaattaagtcaattttttctggtctgcttgtctcatctcctctgtgtccataacagaacaaagaggagatgaaacaagcagaccagaagaaaaaggtgggggagggtatactctacatatccagtgaggcatcatgatctaagatagaagggaaaaatcaaagacacaatgtaagctccatgagggcagatattttcatctattttgttcaggggtatatccctgaaacccagacctgtgctgccatacagcactgaaatttcttgaataagtgatcagatataatatacatactatactttggaaaagaacttctcaaagtgaggtcaacagacccccagagatccttgagaccctttaggaagtccaggaggccaaaattattgtcatgataatactaaggacattatttgcttttttcagtgttgacttttgcaatgatgtgccttagcataaatattctttgctatcacctactcagttaaaaaaaaaaaagaaaaaaaagtgtttcgcttaagttttagtatgtgccattagccaaaagactttgaagaccctccaacttatgcttttaaaaagcacttaggaccaggtgcagtggctcacgcttataatcccagcactttgggaggccgaggtaggcggatcactggaggtcaggagttcaagaccaccctggccaacatggcgaaactccgtctctactaaaaacacaaaaattagccgggtgtggtggcgggcacctgtaatcccagctacttgggaggctgaggcaggagaactgcttgaacccaggaggtggaggttgcagtaagcaaagcagagatcgtgccactacaccactccaacctgggtgacagagcaagcctctgtctcaaaaaaaaaaaaaaaaaaaaaagcatttagatttcaggggggaacttgtcattgtttaacccacgtgatcaagcagtcagttccttctcatatcttctgatagcctcctgcaccttcccttcatagcacttatcacatatcatttatgtggttggtacctatctccccactaaagttctgtgagggcaaggaccgtatctgttttggctcactagtgtatcctcaacacctagcaatattaacaggaatatagtaagtactcaagtctttgtttagtaaaggaaaaaaaagaaaactgattattatcacttctttttttctctggaaaacaataatttatgattattttcttcataatagcggccttctaataaaattcatggtaaaataaaacggtatgtgttcctaattttctccaacttccactgtaagattggagatggtgtaagtccctaactcaggtggagctgattcaacttcatcagtgaaaaatagggcagctaagaagcttcactaagttcaaatgggtcacaatacaggaggctccttgctttgaggagctattcatggctgagagttactaatggcaaaatttccttccctaacagaaatcattccttccttccaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaaaaacttctttatttcaagatcatctgaacagcaattttgcccatcaaagcgttatttttctgctacatctaattaacaaaatattcacactaaatattgaaacgtctctttacaagatttacatgaaagttgaataggtggttttaatgggaaatatgtttaaattaaaagatgtttcttataccaccaacctcccttagcatctccttctgaatgcttttttttttttttttttgagacagggtctcactctgtcgcccaggctggagtgcagtggtatgatctcagctcactgcaaactccgcctccagagttcaagctattctcctgcctcagcctcccaagcagctgggatcaccggcatcggccaccatgcccagccaatttttgttatttttaatagagacagggttttaccatcttggccagactggtctcaaactcctgacctcaagtgatccacccgcctcggcctcccaaaatggtgggattacaggcgtgagcctccatgcctggtccaaaatgcttcttaaactattaccatcatcgttattccactcttccattcctctctgctttaaaatgtctattaacaacttacagagaaaaactctagaagactggttttagctccataccctgtcactgcctatgtatgccttctctaccaggcaccatttcacttttcactatctgactcactcaaaggctacctcctttggaaaaatcttccccagcattgtcattctcatctggaatcctatctaacttttaacagagtactacatgaactcacatgtcaatcctttccattagtctgcaagatcaacaagatgaatggggtttcattcatctttgtattctccaaggcctagcataagctttggaaccaaattaatctcggttcaaatctcagttatgttaaaaaacagtagttgatcctatttaaatatggtttttatggctttctgactaaagcaaaagaaaaaagaaaactggttttctgacttaaaaaaaaagaaatatcatttttacatttagatgtggatgtctaatatttttacattttacatgtaaaaaaaatgaaaaaaaaaaccaccccttacacatacaaacagcaaaaatagttaactaataataaatatcagctctgccacttgttaccatatgccctcatgaaagttacttaaaattaacttatctgagacccaatttcctgctctgtaaaatgaaaataccaccaacccacctcacagatatactgtgaggactaaacccatgaaaatatacttgtgccgggcatggttgctcacaccttcaatcctagcactttgagagctgaggcgggtggatcacttgaggtcaggagttcaagaccagcctagccaacatggtgaaactctgtctctactaaaaatacaaaaattagctgggcacagtggcgcacgcctgtagtcccagctacttaggaggctgaggcaggagaatcgcttgaacccgggaggtggaggtggcagtgagatcatgccactgcactccagcctgggcaacagagcaagactccgtctcaaaaaaaaaaaaaaaaaaagaaaagaaaaagaaaatatacttataccaggcaaaatgcccttcatatatagtagctgctaatgtccattctgctttcatgtcaaaacaaaaaataaaagaaatcaatgattttatgaaccactttcattaattccttcttctctttagagtagcaattatttttaaaagggacttcaactacctagagcaacctgatccttcctcctagctaagcaagctgtacattttaagtgggaccaactaaagaactccaaattgaattcttaggttttatgaatctcatgcaacagagaagttctttatcctactcaatagtaataggccctctaaacctgggtggtgtgaattaagaaagcctgaatcccaagactacagaaag

SEQ ID NO: 16549 - DNA, 47555 bp, Human
acagagtttgacatacatgggttcatttgccatttatttttccctgtaggagtggatcatgaaggaaataaaaatttctcttttattatgctgagaactttcccaacaatttctgctatgaccaccttccaggagttttctagtcaccagatgccttggtaaagttcaatacgtaatctttggctctgaaagctgttcctggacaaaatctgagctaactcactgaagaatcaacagattgaggcaaccatccggtcagttactttttcctgcatcctgctggtgttggggtaactcccaatcctagatgaaaaccttagactttctgttgtcaggtgtccccaggcaatatcctacgggggcatgatagaaaagggtaactctggggtcagatagatgtacttactcactgtgtgaagttgggaaagctgcttaatttctctgagcctacttcctcacctgtaaaaatggggatcattattacctacctcacagggttgttgtgaggattaagagatgggatgtgggagcacctagccgtatctggcaaataggtactcaataaatactggttttacttccctttcctcttgccctttttccccaaaagtattgataatggaaaagcagtccctttcattcttaacagtcatttgggaatgactgggggacttttcaaaccttgaagaattggcattgctaagagttaaggtggacgaggctttttaaggtggctctaatcctctaattaaatccttctaattaatgaatcatcactatataaacctctctgttgggaccttactttctcaagttcagattctattagagaaataaatttacaatcacagggaaaggttttagggactgagttcccttcgctagaacgtatagtaattgtgggcttatttgcctgaaaagttgatttaggactaccttcacgcagtatccagggttattagtgaaagatgctatctgcctgggactttcacagtggacttaagtttcaggtgatactagggctgagaggcaaattttactagaacctctccttttgcatgttatcgcaacaggaaattttagtaggagattcacaggatgcactggtttgtttcggggtgtggaattgaagttgacttatcttggttttagttctaagaccctaaggtaggaagatctgaattatactggagagaagggcagcatggaaattttatggaggaactacaggcttacctttcaggttatcgagtatctgctagcgatttcaagtggccttttgccaatataggagttaagcaaatctcaagcccacagaaatacgtgaatagcaaaaggaccaggggacattttgagaggagtcagtgggccagagacggcaaaaagttattgctgaggtcctaagcacagtcggtgttacgatctcagatgtgagacgtgaacggcgcccaggccggatagcttgttcccattccattgatctgagataaccccaacggaggcagtgtcccatacttgggtaggggtcccgagtctccacagccagagatcaaaggagttttctggcaggcgagaaattaccagcagatattcccgcgcgggatgtaggctttaatttagaaatctccgccccaaaactggcatcttgaacgcgggagggcattatgagttagaggccccggtttttctccatttatccaaatcaggtagccgaaaggtaaatgaggcttcaagttgggcggcgggcagcgaacttgacagaacctcgaaactctgcagatccgccgcccaacccagccgccagctccccgtgacttccgctttcggtctcaactcctctccctgaggagagtggtttaaacggtgaaggctgcggggcgtcgccggaagtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgaggggctggaggcggggactgagtggtggtcgggagagcctaggcgcttggaaggcctgaacggggtctggtcgggccgacggaaaggaccctaaagggatctggagggcgtgccgggcgtggggcggggtgttggggttcctagctgaggccccagagggcgtgatgaggggggtggggttttggggttgcgggaattaggctgtagagggtgtgactccgggctagaattgcgtttagcagagagacttgggagtatgggccggtagatgttgagggagtaggaatatgggaaaagctcataaaggaagagttgatactaggaaggttttacgttgggttggagcgtgttggtaacgagaacggcatagagtatatgttgggcttgtataatggtttgtgagtttggagcgtcgtggttctttggcaggataaagctagcaggcttgaatggatggtacagagactggaacagaatggtcacataaggacgttgacatttgttagtaagagagccatttgaactgttggaagaaccctggattatccaggaacatgaagataggtaggtgagataaatgacaagttatcaggtataaaggaaaagagcttgggtgcagaggccatctctacttttccaccgtttcctatcatttttattttcaaagttttataacgtcttcttctgtttttacaaaaggatgggaaatggtgtgagctgaagaaatttaaagaatgatttctttgaggtttgtagcagaagatctagtgaacaagagattacacattggaggatgctgaatagttgctatagatgatgtgtagttggaatagttaccttaggataagttacagagttggacatattcactgtaaagactatggtagacttctggtggctgttttatcctttttggcctcttcaaagcaaaaccattgacttcaggaattactgtttatgttatttgatagtcgttttaattggctttttttaaacacagtcggatgtattttactcaacatgagtttcaaaatttttgagaggctcagtaaatcatacaaagaatactggcattagcttactaataaatcaagccacatttcttcattattagtgaagattttctagggtagtatttccattattttccaatattttctagggtagtatttccattagagaagaataagtaggagtaggggtttctacagaaacccttacaagcaatagaaatttactttttaaaacaattgatttttgaggaaaaggagtcactttaggggaaatgctaaattttcatggtataaagctccagagaacagaatgtacactgtaacccaagacttattttgtacattctaagtgcccctgttagtctcttcgtgtgaacatatttggttggttgtagattgcagaagctctggtaatagcttttttgaatatactataaagggaaagttatgtattggagcttaaggttccggtttgtatacctgaactttcagaagatgcgagttcaaattgtagttctagactgcgactgtctgtataacaggtggatatgcatggtccctggtacctagtaggtgctccttaaatatttactgttaaccagcctgagccagcaaatgttgaacactggtccttggggcctttgagaaatttgatataaactataacattcagggcgttaacttttttttttttttgagacggagtctccctctgttgcctaggctggagtgcagtggcgcgatctcgtctcactgcaacctccacctctcgggttcacgccattctcctgcctcagcctcccaagtagctgggactacaggcgcccgccaccacgcctggctaattttttgtatttttagtagagacggggtttcaccgtgttagccaggatggtctcaatctcctgaccttgtgatccacccgccttggcctcccaaagtgctgggattataggcgtgaggccaccgtgcctggccagcattttctttattgatcgattggttatgaaagtaaagatgtattctcatcttctgtgagtgatttgatttacactgaccaacagagatacccttaggacatcagtttattgtaatgtagttggaaactttgagactttcttccaaaatgcaggattaggcaggcagaatttggataggcggaacttgtccagatgtctagaagaatttttgttcaggattttatctgtagtgcatttaattaaaaacaaaattagacacttgacttagggaacttgaaaagcagtaagtaaaaatcaaagtactaaacatatttgcttttaatttttaccaacttcattcttttttaagtaagatttttaaaatattcttgagcaagttaaatccacaaattcaaataggttgcagaaacatatgttcttgcttgagccatatcataacacacataggaaattaaaattatcttctatgctatttctataagcaaaatgtacccaaaacagtatacagttttctttttcctggataatgtctcctttgctgtagatgcaagtcatttttactttatcactatggaacttagtttaagttgagatctatctacttaccctgtgtctcctgacacatgatatattttctttcttatgggggtgtagtttaacatggtgattaatagcatgggtcctgaagtcagactgctttaaatcctaattcccatttactagttatagccttgggaaagttaatttctcttggcctcagttttcttatctttaaaatggagaaaatagagctactcctaggattgctgtgaggattaaatatggtaataatgtaaagcagaacacagcttggcacatagtactagctccatgaagattagctattcttattaagtcaaaatgaatgttacagattgtaggtattatggaaattataccaaattaagcagctagtgtgggccagattatttacagacacttcagtattgtaattcttcctttgataacctttggtttgaatttcatttagatgttcttggaaagggctgggcgtggtggctcctggctgtaatcccatcactttgggaggccgaggctggtggatcacctgaggtcaggagttcgagaccagcctggccaacatggcgaaaccccatctctactaaaagtacaaaaattagccgggcgtggtggtgtgcacctgtagtcccagctacttgggaggctgaggcaggagaatcgcttgaacccgggaggtggaggttgcagtgagcagagatgacgccactgcactctagcctgggtgacaaagtgagactctttgtctcaaaaaaaaaaaaaataaagtgttcttgggaagatcttggtatatcaaattagtgtttaattatgacattctattgaaaaaataccatgcaaagcttcccaaccaatgttccagtgcttaggatggcatataggtgtgctgtttacaaattttttatagcattgaaattttaaatcatttttataagttcaaacttttacaacagttgaaattacatttgaacatctttggtatgatttcctcttgtataattcatgaatttggtaatttggttatttactatttaaacaattagagatgggggtctcattatgttgcccaggctggtctcaaatgcttggcctcatgtgattctcccatctcagcctcccaaagtgctgggattaccagtgtgagccactgtgcctaccctaccatgaatttggtaatttgaaaaaattttatttggtataaatactaaatttataccaatttaatatttaatatcatttgtaatactttgtatttttttcatgccataatttcataataagaaattttgtgtgtgcgggttttgtttttgtttttttttgaccccagggcaagcaagaaaattttttttcaccaagctctttcagctcaccccaatgagccttacaaatatttttaatgtgtgccatcatgtgacaaaggttgggaagcactggtataatggataagagcactgcttttggattcacacaaaactgaatttaagttctacctccacttattagctctgagacccagagcaagtaacttaaccataagaataataatttttacatatgtaaagcagagatgatgtttcataatatgaaatgagataatgcatgtaaaatgcttcacattagtgcctagcaaataaaaaatagtaagtggtcacttctattgatgatgatgatcgtgagaattaccattttagctacttttttcagaggtttttcagacagctgttttattatttttcatattaatatactattttcaaagatcttcaaagaattttaatatccttttgtggtgaaaggaattaaatgttagtcctttttttttactcatcactgtactaatgaagatacttagttttgtaagttattgaattatctgctctctgtatttctgtttcttgatagtttcctttagcaggttctgagaaaacataaaaaaaaactttgttctttgggatttgctggtggtagtatggcaaaaagccagttgcatgcagagaactggaatcatctaatttacttaaactctatattatacagttaattatatttaaattgctgcatattattggctgaatatgcttattattgagaataagactgccctttggtaaacatgccattacattatatcctcctatgggattataccctttattatgtttgccatttgcttgggataaggttcatggccagttacatttcatgtgaggatgcatctgtgtttcggggaaaaaaagctttgtgttttataagcatgtatcattctttgtgtcttttatttaaatgcattagtcacttttttaacatttcaataggtttttggggaacaggttatgtttggttacgtgaataagtttagtggcaatttctgagattttggtgcacccatcacctgagcagtctacactgtacccaatgtatagtcctttatccctcaccaccttcccaccctttcccccgagtccccaaagtccgttgtatcattcttaggcctttgcatcctcatagcttagcatccacttacaagtgagaacgtacgatgtttggttttccattcctgagttacttcacttagagtaatcgtctccagttccatccaggttgctgcagatgccattatttcattcctttttatggctgagtagtgttccatgggtgtagaggggtgtgtgtgtgtgtgtgtgtgtatatcacattttctttatccactcgttgattgatgggcatttgggctggttccatatttttgccattgtgaattgtgctgctataaacatgcgtatgcaagtatcttttttgtataatggcttctttcctcagggtagatactcaggagtgagattggtgcatcaaatggtagatatacttttagttctttaaggaacctacacactgtttcccatagtggttgtactagtttacattcccaccaacagcgtgaaggtgttcccttttcatcacatccacaccaacatctattttttttttattatggccattattgcaggagtaaggtggtatcacattgtagttttgatttgtagttcctgataattagtgatgttgagcatgttttcgtaagtttgctggccatttgtatatcttgtgagaattgtctattcaagtccttagcccactttttgatgggattgtttttttcgtgctgatttgatttccttgtagattctggatattagtcctttgtcagatgtatagattgtgaagattttctcccactctgggttgtctgtactctgctgatttcttttgttgctcagaagctttttagtttagttgagtcccatttatttatttttatttttgtctttgcatttgcttttgggttcttggttgtgaagtctttgcctaagccaatggctagaagggtttttccaatgttatcttctagaatttttatggttttgggtcttagatttaagtcagtagccctatacaccaacagcaaccaagctgagaatcaaatcaagaactcaaccttttacagtagctgcaaacaaaaaacaaacaaacaaacaatacttaggaatatacttgaccaagaaggtgaaacacctctacaaggaaaactacaaaacacggctgacagaaatcatagatgatacaaacaaatggaaacacgtcccatgctcatggatgggtagaatcaatattgtgaaaatgaccatactgccaaaagcaaatctacaaattcaatgcaattcccattaaagtaccaccatcattcttcacagaactagaaaaaacaatcctaaaattcatgtggacccaaaaaagagcccgtatagccaaagcaagactaagcaaaaagaacaaacctagaggcattagattacctgacttcgaactatactgtaaggccataatcaccaaaacatcatggtactggtgtaaaaacaggcatatagactaatggaacagaatagagagcccagaaataaagccaaataacttccagtcaactaatcttcgacaaagaaacaaaaatgtgaagtggcgaaaggacaccctgttccacaaatggtgctgggataattgacaagccacatgtagaagcattaatcacttttgcagtctgaaaatacggcccttttcaggaattaaaataatgtaattttccctgactacgctattcctgtagtacactgatggccatagagtagggtgcttaatactagatttcacagggcatgtaaggttctaataagcgctgctactacgtttctttaaaaaataatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctgagtagcttggactacaggctaatgccaccaccgttggctaattttttgtagagatggggttttgccatattgcccaggctggccttgaacttctgggttcaatgatttgcccacctcagcctcccaaaatgttgagattatagactgagattatagcctctaacttccattcttaaaagtcgctcatctgtaaccaggaaaaaacaatatagagagacagatggcaggaaaatcagtagctgtgcaaaaatggaatgttcaaaacgcggaagaaaaaactgaaacattgtgaagagtcttttggttccttttttagaggacaattttttacttggaatttttgaaaaatctgttttctctacttgagatggcttctctttctgcttttcccccagtgtattaatgaactatatcctgctacttacctcaagtcagtttatccagtatagaacttgccttcactcctcacccccaaatccacctgttgggaacttttctgtttcagtaccagcattctcaacttcatctaggctgaaaactgcagttgtttttaactcctctgttactctcatctcttacaaccagtcagttgcgaagtcctatgactcagtcattactagattccagatttttggactttaaggaccagaaaaatttttaaaaacttgtttttggtagactgacctaggattttaatattttatttttcttagtaaatacattttaaaaatctcagactactgtctgttatgattactatttagttctctttcctcccgagacagtctcactctgttgcccagactggagtgtagtggcatgatcttggatcactgcaacctctgcctcccaggttcgagcaattctcatgcctcagccttctgcgtagctgagagtacaggtgtgcaccaccgtgcccagctattttttgtatttttagtagagacggggtttcaccatgttggccaggctggtctcaaacttctggcctaaagtgatctacccgcctcgacctcccaaaggctgggattacaggtgtgagtcaccatgcctcgccattggtgaaactgttttgatgttctgaattggatatgatatgatcctctatttttgaaacctcatagtactttttatgccacttatagtctgccttatatatggttatttatatacttacctggtcctaaccatatggtcttttagggcaggaggactaagtatttctcatctttttgtctgttgcaggacttaatagaatgctaaagtgtttttgcccataaggaataggaacaccactcatacaagtcacaagtaaaagagaggtatattgaaaggacaaagtaggcaacttcataggtgttagacattcaagaataggtaagaaatgaaatacaggtaggttgtatgtacatggactgtgatacccaacccccaccctctcccctatttctcctagagcagaatggcctcccccgagtcttcaacttttgtttactctgacatcttctgtggctcacgcaccgcctgacccggtagttcaagtgcttcatgttatctgatgcaggctcccaggatcccattcccggttcctggtaaagagtatcagattggcccagccttgtcatctgccaaccacaatccagtcatgtatggttgggtatagcagagttgatggggtatcatgagttttataaggtgaccctttcaaggactggagtaggtcaaattctctattaaatgcatggccagagagttaatgtttaataaagagatgacagtgcctgacacctagtaggcactcactaaatataagttgaacataatggaatgacatgggagtattgaggaactaaacatatcactgctttactttctcattagttcatgagaacgtgcctgctcattctcaatattaccatcttgtatagttgggagagagaacttaaattcagatttaaaattaggccaggcatggtggctcatgcttgtaatcccagcactttgggaggctgaggtgggcagatcacctgaggtcaggagttccagaccagcctggccaacatggtgaagccccgtcttttctgaaaatacaaaaattagccaggcgtggtggcgcacacctgtaatcccagctacttgggaggctgaggcatgagaatcgcttgaacctgggaggcggacgttgcagtcagctgaggtggaatgactgcactctagcctgggcgacagagtgagactctgtctcaaaaaacaaaaacaaaaacaaaatttaaaaataaattgaagtagggtacaggattttaaagtcccattatcaacacattcaactcagaatagttaatgtaacctgaatttaattacctttgattttaatttaggaatgaattttttaaaatgcatataaccagctcagggtctgtgcttcatcatcaccctggctttttttttgtgctaatttttcctcttactacttttatgagtaccagaaaattatccaaagctaagagaagaaataaaacactgtttttgctccttattaataatttgcttctaagtttttgttagagagtaggtaaaaacgtttggcaaagtagattgctcatagagtttagctatccatgctttgtttttacctttagtttagttttatggcaggggaataggacttgttgaagggagtgggaaagaagggatgcaggtcttcataataaggaatgtcggccaggcgcagtatctcacacctgtaatcccagcactttgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaaaaagaaaaaatgtctagagcagtctgcactaaatttgttcacgttactgaagttcatttttaaaatttgttttctagccaataaaatatagtagactagcaataataaaacacatctctttgaactggtaactcacatcagaaataggagataccatgcaattaatacagggcaaagagaatgaaaactgagagattagtccttatcactgagcttcattttcctttctttttaccactgagggatttaaattgaacctcaggggtcctttgtctgtgaacttaatattattagccagatggaatattttagcaagttataaaggtaactatttttgtgttatgtctcttattcttgagtttgattgaagttagcttaacatcataaagctggttagaaagatagttaaaaactgaagttaaaaacctgaaaaacataaattcatgaagtacccctaatgtacatgttcaaaagaaaatacaaagaaatcactcagtatttgacttcccctccaattttaattgtcttttggtataattcttttttggtgtttagcaagttaaagttatctttaagcatttatcttgtccaggtgatcctgttaccggcttagtaatcagctgtatcatttctgtaattcaagctgtttgaactgaataacatagtgttaggatcactgtttaattgttctagttttgatagatacaatgctttatgtaagtgaaatatccgatttttcatgactttctgttaagttgtgacaaattcatgtatctgatgtgaactaagcaaagaagaaagatacctaaaagactaaatttgtttgacttatacctgaatagtggtctagtgatgttagaaacaagtttcaggaagagctagtcttcagatctgaacttcctttgatttccaagttagacttagatacctaaaagtttaagaaagattgttaaggattagctgagatgttactgtgtttgttgatccattactaattgctgttagggcttctttttgttgccaagtcatgttttcagatggataaatgtttttaatgttaatacaaaacatctgtttcttgaataatgttagtattttatatctcaaagaattcttattgcttaccttggaagtagatagtattctaagtcataataatgataattattattttgctgctcagtataataatctgaattttttctagctgtagtagctgttgagtcaggcttgccttgccgtgatcaaaacatgcactctatatattttaattgtactggctgggcaaagtcctgtaatcccaggactttgggaagttgaggccggaggactagcctgggcaagatggcaagaccttgtctctacaaaaaatttgacagagtgagatcctgtctcttaaaaaaaatcatttgagaaacagcaaaagtactctgtattcagtgctcttgtgatcctcctgtgtcagcctcctgagtggctgggactacaggcatgcaccactatgctaggctaatttaaatttttggtagacatgaggtctctctacagtgcccagggtagtctttaactcctgggctcaagtgatcctctcaactcagcctcccaaagtgttgggattacaggtgtgagccactgcatctgacctgattcactgctcttaaagagctgatgtgaaagtgagttttgcctaggatcttgtaagttattgaagggttgtttcaaagtgacatatctttaacagaacattttctcctgtatttcttgaagttagaacttgggaatcattaacttcaaaacagggcttcgtttgatataatgataaaactatgaccatgacttatgtaggtaatgtagtcctgaggtatgtgttaggatagtgcagtcttaattttggttcattccagggtattgaaaataatttgcttcttttcttcttctgcttctaagaagaaaagcatatttcttactctatttttgttattatgtttgtaattaaaatccacattcatgtccccagcaaaagttgaagtagttctttcaactttttctagactactcaatgtttaaaaactaaggttttaattttgggaaaattttagatttacagaaaagttgcagatagtacagagtccctatatactttacacctgtttttccttaatgttgatatcttacatagctatggtacctttgtaaaacactcagggattaatattggtgccttaatgttaactaaacttcacattttatttagatttcagcagttttcccactaattttctgctccaggatccaatccaggatacaccattgcatttagtcaaggctactttttattaagctttttggttttcattgttgcactgttcagtgggaggctcatttattaacttagtttctagcctggagatagaaatgagaaatatacagaattcttaagcagttcaagtagggaagatatgcaagtaaactatggtaataaaatgtgattacagaaggaatagccaattttgtaaggaggaagagagagagagacatatacgttagggaagccctcccagaggaggtgacatttgaaatgggctttgaaaattaaatagcaacttttttttttaagtttcttccttttagaatattttactaagcgagaagctgggatgaaagttagataggaactcttaaggcagaggctggagagaagcatatccagacaaagggaatagtaagcacaaagactcagaacatgagtgagcaaatagatttgattgaaatgaagggttggtacaggaagagtgtagaaggtgagcctgaaaaggtatgcagaggatttggagagtgtttatgtgaagttttttggtagctgtattttaagctgtattatgtatgtatgtgtatatatgaatatatgtgtgtatatatacatacacaagatatgtatgcacacgtatggagtaggttctgcatctggatttaaccaatggcagatcaaaaatactgggaaaaattaaatgacaaaaataatacaaaaaaagtataactatttacatagcatttacattttattaggtattataagtaatctagagaggatttaaactgtacagcagaatgtgtgtaggttatatgaaaatactacaccattttatgtaagggacttgagcattggtggattttggtatcctagggggggtcctggaaccagtcccctgcggataccaaggtatgtgtgtgtgtataaaatttaggggaactcatccagagactgcattgttctccttcttattacctgcctttttgttttttttgccattccaccactaattcatgctgtaacaaaaggttaagtagaagtaaatacatatgtgaaatccatactgttttgggttttggctgaacagctttggtgagcatttattatagtaaaggaaattgaaattgtaggcatccttatctggcaactcagtttgtagtgtttgctgttggtgaattttaaaagtgtagtttgatttacattggattaaatacacctgtagaaacgtgccctatgctgctatcgatgttagagggccctaggtagggaggaatatgatttcaacattttaaatcccaaaattttacaattttgggatataggtgctttgataaatgatttagcattgcaattaactttggaggacatctgcagtataatgaatcattatttttatgggttaaaatgaaatatttggattatttgtgggttacagttgcttgtgtcagttctgttcccttttactctaaataaatatagttttcagtcatgtcatatataaatactacgtaatttaatgttagcatcaaaatggctttttgctgccctgctttcaaataaggagaaggaaacttaccaaagtccaaaattagaacactgagactgggcacagtggctcatgcctgtaatctcagcaccttgggatcacttgagctcaggagttcgagactagcctgggcaacgtggtgaaactccgtctctactaaaaatataaaaattagccggtgtggtgatgtgcacctgtggtcccagttactccagaggctgagggggaaggatcgcttgagccctggggcggggcagaggttgcagtgagctgagatcatgccactgcactccagcctgggtgacagagcaagacactgtctcagaagacaaacaaacaaacaaaaaacgttgaggcagccagaggatgatccctgtccttgctcacaaatgactgctcccttaagcaatcaaaggcaaggaaggaactctacgtacttctccccctttaaatgataacattttgaggagagctgcttagctgagtgagctgccttttttttaaaaaaaactcaagccaacccttccttagatgatttatgaatgtaaaatgcttgttaactttctgctttatggtttatgatgcttgtaaaatgataggattattgtccatgtatgtaattggtgaaggatatgaaactcagaacaaaccatatagtgccatgtaagttatggacatattttagttgttagggcttttaaaaaacatctccccctctgtcattacatgttttaccctctggaaatgtttaatgaaacagtaactgatattgggagggacacacaggttgcttcaaagataaatggtaatgtttaattttttatgctggacaataggtacacagattttttgttacacatatgctataagtattcccttttatgtatccaatatttatttaataaaaaacaacctaaagttttaaaggcaaaaaaggtaattctcatgtccttaaagcctattccattcagtttttgtgtgtttttttttttttttggtggcaaggaaaagaaaactcattcaaactaggaccaaaagttggtgggttgataggttattgttagaatatagaaaggtgtttgtgggaatacaggaagagctggagaatcaggccgcaagaactgatgcagctctgagactggccagactgttttctcttttttgtctgtttctgcctcttgctggcttcactatttctgcctttattttatttatttattttttttgctttcttacctttgcttgttcccgtctctttctctgtttccttggtcccatccgtttgtttttttttgttttttaaactgggtcaacaacctttgttgtaaaacaaaggtgcccttcccccattcattctgttttctcacttacttgatgtctctttttttgtgagctctctcctttaagtcactgcatatttttctgttctcttctctccagaccaaccttcctctgaatcttttcctttgtgaccttgttgtgcatgaagctctataatggtagcctaggtttttttccacatgtatctcctagtgcagattcctcagataatccagttggtcctgctcatcttttagagctaggtcacataggccaccaacagcctgtgactaggtgactcctgtgttaggtatttaccctcgattcggtcacaggaaaggttgtggcctagatcgtgtgggccatttcccactgaggtagcgaagtagggatttttatagaagagattatgggcaggcagatgttctgaaattctaatatgtcaattaagttttatcagaattttcttatgtgccctttaagcctttttggtaatcggtatgtgattgcttcctagaagaatctttttcaaagaaaaaccattagctctcttccagttacaactcactgccttcttttatccttaagatattcattcatagccaggcgcggtggctcacgcttgtaatcctagcactttgggaggccgaggctggtggatcatgaggtcaagagttcaagaccagcctggccaagatggtgaaaccccgtctctactaaaactacaaaaaaaatcgacctggcgtggtggcaggcacctgtaatcccagctacttgggaggctgagacagagaatcacttgaacccgggcagcagaagttgcagtgagctgagattgtgccactgggtgacagagtgagactccgtctcaaaaaaaaaaaaaaaagataattcattcataatctcactgaacaaataataaatgagtgctcactatgttttatatacccttctaggtgttagggatagaatgagatgatgagtgcaggggagataggacaagggtttgagagtaaggttagaagggagtgaggctagtgagtgagtccaaatttattgtcagtatagtcatgggatgagagttgaagggccaagagtgggtgtgaggctgaataaagatagcataggaatggaaatcttccgtttctgttaactacctacgttgaagattccatccattgcatctggcattgtgattaatgttattaagcaaccactgaatattatagaaactcaagccattcatttcacagatagtcattaagtgcctaatctgtcctagattttgctctagattggcggggggtgcacaaaaagaaatagcaattttgtgctttcaaggattgggctttgagcttagggctagtggagtcctaaacaggcacaaacccgaataattacaataatttgaccaagtactaatgtaacagtgtatgacattaccctgtaaagccaggttgagcctggtcagggtgcccctgagggagaattacatagatatggaagggttttcaggttgtggcagaaagggtttcattactattttaatcaaaatcaagaaaaccagttagcagcttatgagaagcaaggagattaggagctaggaatatagtcaaataatttttttacagtagccagagctggctagagataaaatgaagtgaggtggctgggaaggacagtttgggggctagttttggaaattaacctcttgaactgatggtcaaagggaataatctatgccagccaccagggtggaagtgataactgttcagaaagaatgaggagggcttcagcaaggagttgaagtctgagttgaataggggttttacggatgcttatagcatatgtagaggcttgtcatgtttagagggatagtgggctggctgaaaaactattttgagattgtaggctaaggaaacttagtaatttcacaagaaaaatagatctgtaacttctcccaccagaccgtaaagtccataaacttatttgtatttgaagtcaccatattcagcattttcaggcatgtaggagacatgtttgttgaaaaaaaatttttttatttgctcagtgatgtttttcctatctgttattcttctagccttttcttttattgaactaagaagcaactggttttttaattaagtatagtaccttgaaaagccgtttgaatgaaatgtcattcttttttgtttgttcgagatggagtttgctcttgttgcccaggccggagtgcaatggcgcggtctttgctcactgcaacctccacctcctggattcaagcgattctcctgcctcagcctcctgaatagctgggattacaggtgcccgccaccatacctggctaattttttgtatttttagtagagatgaggtttcactatgttggccaggctggtctcgaactcctgacctcaggtgatccacccgcctcggcctcccaaggtgctgggattacaggcatgagccaccgcacctggcctgaaatgtcatttataaccttactctgaatttttagagttacatacttatacctgttactaaaaggaatcaaccgggagcagtaggtactcctattggaaatagaatggacttactcctatgatctttagttgtagatactcacaattcttttttctttcctgttgtaaatgaaaggtgagaataagttagcaaaaaaatcaattttatttgctgatcaagctttcagcctgccatgagggaggggctgtctgtgcctattctagtcatatgttcctatatgtctgataatgggggcccgtagaagagagagtcttggtctagcactgactaaaaggttatctaaaaatagtgccatactgggacttggctgtccagacctctggaagagggactatactctaattataatcctgttattaaaaattttaagatttctatatagaaaccagtatttaaaaggaagaggagatgtttcaggtacccctggaataactgctatctcaggtggtagtggtgcagagagacctgtgaggaaggttcaaggaaaagctatagaggtataaatggttgaaaaggagaggcgatagtagacaggaatatctggggctgaaaatacatttaaggaagagaatatttttgttcttcaggatagggtgaagaaaacgactaatgctctgatatattatagtttgctgtaacttttaggttataagttgcagtttaagtgtgtgaattcagattctatctaggattttattattatgaaaccactgctaaatagttacaccatttttactggaattttgaaccaacatcagtatccaagttgttattactaaataaaactttgcgaggccttaacgttacttggtgatattctcaacattggaaatggcattcataaataatagctagctaacatttatggaacatttactatgtgccaggcactgttttaagcattttttattgacccccattcagatgaggaaattcattgtgcttgaaggcacagaaatagaaattcacatagtatactcatgtactttctttggactggctttagtcaaatgaaagagaaaaaagagaaggactcaggggatagtgtttttttttttttttgagaattagccatctgtcagggttaatttttaaaatcagtctgtatgtgagctgaatgagtttgctcatatgtgataatggtttatttgttttagcagttccaaattccaatcacttggggccttgtttaaaaattatcttgcaaagaaattatcaccatctctcactttgcatacccataatgtaatatatgttattgaggggtggagagcatatgctctggtacctgctcagagatctttttaaaaatacaattaagaacatgtgtctgggtgcagtggctcgcccctgtaataccagcactttgggaggtgaggcgggaggattgcttgatctcaggagtttgagcccagcctgggcaacatagtgagacttcatctctactaaaaataaaaaaaaattagccaggcatggtggtgtgcccctgtagtcccagctactcccagctactcaggaggctgagggaggaggattgcttgagcctgggagattgagactacagtgagctgtgattacgccactacgctccagcctgggtgacagagcaagactctgtctcaaaacaaaaaacaaacaaacaaaaccccatgtttaggtaaatacagtgattctacattagagtacatattggtgaattttttttttggtctaacagtgttgatgattatgtatccaaactgtagataaacacagatgattttctttttctttttgccagaacaaggtcttgctctgtgcccaggtttgagtgcagtagcacagttgtaactcactgcaaccttgaactcctgggctcaagagattttcccaagtagctgggattacaggtgtgtgctaccaggcccagctaattttttgtgttattcttgttgtttgtttttttttggtagagatgaggtttgcctatgttgcctaggctggtcttgaactcatggcctcaagtgatcctcctgccttggcctcccagagtgatgggattataggtgtgaaccaaccattccctgtccccagatagttttctaaattaatcctctccctttattctctgcagattgccttgcctcttttattgagaatgaaactaacatggcttccttcctccttttattctcaaaaatctccgtgacttcacctctcatccttttctcctacttatataggatatcctttaaaggataaagcttctgtgttgaacggatcctattgcctcctgtttctgggacctttccaactttttctcccctgtgtatcctaaccccctgcatagttccatcccttctgcatacagagtcctcttcagttcctcccttttgaagccatagctgctgtctttgcagtatcctttgcatcttcccattctttgtatttcaactattacttccctggtgtattgaagatgggcaactgaatctctccttaaacttgtgatacatttttgaaaaaagatagataaaagatgcagataaaattaggaagttctgaacaccacatgtgttgtggagtagggagatggaacataggaagcagcttggggaaaacgcaacaatgagatgttatgaaaagggagcttactgctagaacaatggagcacagagagttgaggtaaaagtgaagagcccagacctaataagaaagggttatagaaagtgtttcaataatttggagaattattagataaactgatggttttaaaaatagtgcccctgagatggaactggaagctcaggagaagatattagtgtgataataaagggaaaggcaaactgacattttctcagggagccttggaaaaatgtgagagaggtagggcaacagagggttttttgtttttttttttaatcagcgcatccatagggtaggattaatgagataggtagaaattgattctgagattaatggatttattatttcattcaagataatctcacatgaatgatggaaatgtggttttcaatatataaaagaatggtacacattaattcattaatctcaacttttcttaatttagtagctcttgttactatggataatctgggaattctgtcttttaagcaatttaaaatataactggtatgcatttgtattttcttcccagagtagaatcattggattttttagatatgaatgagaggattcacctttttataacagcatcctaagaaagtcactatgtgctatttgagtattaactatttagtactacccctgattatcgattatgtaataagacaagatcatatataaatgtaccttttgattctgtaagaatgtagttgtctagaatttttatatttggattttaattaacttttggttagtaaagttgagaaatatttagtaaagaatcatggttactaaatattattcattgtttagtaatatttatttgagtagataatttatgtcatgaccagtttaaggccctgggaatgcagggatgaataagccttcatggagcttatattttagtggggaagataagaaatgagctaatctgtcatgtgaagaagtggtaagtgctatgaaaaaatataacacagaataaggggagagactgtgacggggtgggagctatttagatagattagtcagaaaaggctgttcctgtgaggaagaaaatcttgcaaaacttatttcaggtaacagtaaacgcaaagacaggaaagacagagtcaggacctaactcagtaagaaccggtttggtatgttggaggaaaagcaagaatgctggtctgacaagagctgtgaggacaaagtggagagtaacaagagatgagggtgaagaggtaggcaggggccagagcatattgcaccataatgcccatggattttgagtataattgaagatcgtgtgacaagatctaatttacattttacaaagtttattccacctactgactggcaaactggctttagaaaaggcaaggtctgaagcactgaactatttaggaagcttttgcagtgatctaggcctatggtttccaatgttcaggaacaaactgttaaaactattatattaactatttatattgctttatttaaaaaaattaagctttactaatatttaatatacagattggcactggcatccttgtcttatctgcacgttagtcacatgtcatttaacatttttggcttgagcaactggtgaatgttggtgccatttactggaatgagaagactgagggaggagcagggtttgttttgaggtgagagtgagttggggaatcagtatctcagttttgagcattttaggtttgtgaaatctaaatacctactagaaatctaatatcaggtagatggtttagatatatgaatctggagccaaggttagaagccaagattagagatctaaatttggaaatcattagtatagagacagtatacaccagctttggagccaaactgtgaatgcaaatttcagttctgccacttactaactgtgtaattataggcaagttacttgacatctgtctgcatcatttatctcatctgtaaaatgggggtaataatgtctacctcatagggttattgtgaggattaaattagttattacaaacaaagtgattagaacagtgtggccgagggtactcactagatgttaactgttaggatcagtttttgaatagtgtttaagccatgagattagggccgggtgcgattgctcacttctgtaatcccagcattttgggaggccgaggcaggtggatcgcttgagcccaggagttcgagagcagcctggcaaacatggtgaaaccccgtctctactaaaaatacaaaaattagccaggtgtggtggcgtgtgcctgtagtcccagctactcaggaggctgaggcaggagaatcacttgaacctgggaggcagatgttgcagtgagccaagattgcgccactgcactccagcctgggtgacagagcaagagtctgtctccaaaaaataaagaccatgagattagataacttagagaatgagtttagatagggaaaagggccaaggagggacccctgaagcaatataacctttagaattcagaaactgggttgggtgcggtggctttcgcctgtaatactagcactttaggaggctgaggcgggcagatcacctgaggtcaggagtttgtgaccagcctggctaatatggtgaaaaaccctgtctctactaaaaatacaaaaatcagctgggtgttgtggcaggcgcctgtaatctcagctactcaggaggctgaggcaggagaattgcttgaacctgggaggcggaggttgcggtgagccgagattgtaccattgcactccagcctgggctacagagcgggactccatctcaaataataataataataataattcagaaactggagagaggagattgaggagtgaagtaggaatcaaacctgaagggtatgttggctagaagcctgcctagtgaagaaaatatttcaacttagacaaattctgcttgagaggctaagatgagcaccaagaattgaccaactgggtttgtcaagatggaagtttttggagaccttgagaagtagttttattagagtggtggggatgaaagcctgattagcatagctgaaggacagaattggatgtacgaaattggaggcactgagtatagatggcacattagaggagttttgctgcaaagagggatagagaaaatggtgtggtagctagaagaaaatgtgtggggtcaaggaaagttaggggtgtgtatgtgtgttgatttaaagatggaaaatagtatagtaagtttgcatgctgatgagaatgacccagtggaaagaaaaaactgatcatatttgagatgtggaaaatatcatgggaaattgcagcagccatgaccttgagtaggtaaaatgaaggtgcataaggggagaagttgattttaaaacattggcagagacttttcatccattgatgaaggtagagaatattaatggaggtacagatagactggtagatgtcgttgtgggaaaatgtagttttttctgattgctttaatttttatggaaaagtagggtaggatcatcagttgagagtcagaattgggagggggtttataaaatttgagagagaggaggtggtgtgatataggcatcttggaagataggaaaatgagttgactagggaagatctagcaggtggatttgtcaaggaggtcagaaggctagcttgacatttgtggtcatttgtttaaagtgattccagctggctaaggagggcagggtggtcttgagatgacatatggtgagaaattgataggaacaatgccttttctgcttctatttgaaacatctttagtcctgtgactggtagtattgctctcagaacatttctgtggtataggcaggcagcaacagaggaattaataaaaatgaatagaccaaaaaataatgatttcatttttgcccatgttcagtgtttatatcatgttttatgtagtgaatgagttcctccaaaagtttatgttgccatctgtccttggatatgcctattttacacaaatgataccaagcaagccctaggacactttcaataaattatacttggttgctgagttatgtaaagaaagcaaaatgctgtagtggagaagctccatacattttcttgatagacatgaaagcctcaccaaaattttccctaggacccgtggttttcatcaatctagagttatcattcatgttgatattatacttttatgttgattaccgagaaattcaaagtctggttttcttttcttacaggtgctggagaatctggtaaaagcaccattgtgaaacagatgaagtaagttggaatgtagcgttttgttagactaggatttctcctaatgcatataaagtccatagtatcttttcattttaggtccatggtattgacttgtggttttctttgttttaaagaatcattcatgaggatggctattcagaggatgaatgtaaacaatataaagtagttgtctacagcaatactatacagtccatcattgcaatcataagagccatgggacggctaaagattgactttggggaagctgccagggcagtaagtgtttctcatttcctcttcacttgctcttattcagcagatacagttaagttaagcaaaatttttgcttcatgttttagggaaatgaatttaagcaacaagataaaatgtagcaaagtactttgtgctcacttgagaaatgttagcaatctactttagcaggtgttagatataaccaccccaagaggagcctaggaaatgggattctgtgggtgcacggtaggtttctgggataactgttctattcaattgctttttttttttttttaacagcactgttgacttttatagtagtagataatagtacattaaaataatctaagagaaaggttgccatgatatgtagctctgctttctgaggtgtacagattaaaggccaaaatcagtctcccagaataaattctgtaaggacatgagcactaagtccaaattcttgaatatctaagtcagatattcaagaatactgtatactacatggaacctaaggctatagaattggagtataacatgccctagtataattctttaatgccttgcacatgtcagctatttaaaaagttgtattattataataatacttagtggaccctgaagatctagtttataaaattagagcatgtgtaattaggatgttttatgccattggggagggtgccaatatgaaggcaggagatctttgatattattatcagctaaaatccagagaaggctgggaaattatagaattatttcctacatctaagggactcactggctgtgttcagagtgtcatacttatgtgccatggcgaaataaaaggaaatgatttgggaggtctgcctggaaaggcaaaacctatatgtctatgaagttgcttaggaactctcataagccactcccaacttatcaaatgcgaatttatatttgataaaaagataggaaattgttgaggggaaatactgaaagggtagtcacagttggatagtgttagactagaaagtgtcttagaaatggcataaaggaagaggagctggattagggattgtgaaatgagagacttgtatcaaaaaataagaaaatatgtgaatgtgacttttatatttttgtgaaatatatcacagagactatttttctatgcatctgagcagggaagtttggcagtcaagcaaaaataaagcctttatccttgtcttaccctttcctattccttctctcaccccctgcttttgtttccttcttttcctctttttcttctttataccagctctatctgtggtcttattttttcttcctcccttttctcatttctccctatcacctaactctacttctctgttgtatttgttgtatctggtaactggtcagtagtactgtatttattctcttccttctctctgttggttttttctctgtctcagttatttattcttttagtttgtcccttttctctttccctctttaattttattccccgccgtctgtcttcctttatttatctccctaccctttcattcctttttttttttttttttttttttttggagacggactctcgccctgtcgcccaggctggaatgcaatggctggctgcagcctctgcctcccaggttcaagcgattctcctgtctcagcctcctgagtatctgagattacaggcgcgcacctccacgcccagctaatttttgtatttttagtagagatggagtttcaccatgttggccaggctggtctcgaactcctgaccttgtgatccgcccgcctcggcctcccaaagtgctgggattataggcgtgagccaccgctcccggccccatttctttccattatcaaatcaattgtcattaatctttgtatcctaatactcttgtgtcaccagatgcagttgacatcattagtccctctcaggcctcctaaatcatccagctttctggtgtccacacaacctagtctgtaatcctatattataatttttaaacattgctttttatttttccttctgtgtgtaaggttttatgtttatagctcctctcttattgtcttctagtatttttgtttgtttgttttttgaggcggagttttgctcttgtcacccaggctggagtgtaacggtacgattttggctcactgcaacctctgcctcctggattcaagtgattctcctacctcagcctcccaaggagctgggattacaggcgcctgccaccacggctgactaatttttgtatttttagtagagatggggtttcgtcatgttggccaggttggtcttgaattcctgacctcaggtgatccacttgccttggcctccccaagtgctgggattacaggtgtgagccactgtgcccggcttctactctagttttttatagttggttagagagtgtgaatggaaaaaaaatagagctgagtgtggaataggttcctttttcacatctgcttaagtgtggaggtgtgaagtttattgtaaagaggggcctcttctgtttttttttttgttgttgttttttgttttttttgagacagagtttcactcttgttgcccaggctggagtgcaatggtgtgaccttggctcaccgcaacctctgcctcctgggttcaagcgattctcctgcctcagcctcccgagtagctgggattataggcatgcaccaccatgcccgcctaatttttttgtatttttagtagagacgggggtttctccatgttggtcaggttggtctggaactcctgacttcaggtgatccatctgccttggctgcccaaagtattgggattacaggcgtgagccaccatgcccagccaagaggcacctctttatagacctttagagagggtttattgtggggaagcaagagcaggtcagtggaagaaattaagtgataagaaaaaagtgtttgctcctaaaagaatatttaaagagtcaggacagcaaaaaaagtagtaataattccctctcttttgaagtttctaaaattagagtcatggtttttttctgttttttttttttttaaagtagtgcttaataaggttatttgaatacgtgcatgggtataggtcaaatttcagaaccaggggattatgaagacttcacatgttagataaagcaccataccttgcatatgtacaaggacatgctcactgctgagtatgtttgccaatttgtctaatatttcaacttttctcattcatttgtttaaaattttatctttgaaaagaaagggaggggcatatagatcttagctaaggtgttttttttgttttttttttttttttgagatggagttttgctctgtcgcccaggctagagtgcaatggcaccatctcagctcactgcaacctccgcctcctgggttcaagcaattctcctgcctcaaactcccgagtagctgggactacaggcacacgccaccatgcccagctaatttttgtatttttagtggagatggggtttcaccatgttggccaggatggtctcaatctcttgaccttgtgatccacccgccttggcctcccaaaatgctgggattacaagtgtgagccaccatgcccgaccagctaaggtgtcttagagttgagcctagtctaccgccatgccaccctgaatgcgcctgatctcagaagctaaatgagagtgggttgagcctaaatattactagaaagaatacaggaaaggatcataaaggaggaaatattactaggtaaaaaccattagagctggagacccagagtttggcaaaaataatttgagtgcaccatggatggttttgttttgctaaggtggatgcacaagttctggtaattcacaagtctttggagttttaggttgtgagttcacctgtggtctgaaatgacttttgcttgttagtttatttgtcttgatgactacttaagatacaaatgattgctcccctttctcctttactttttctttacacgttatatactttttaaattttttatttttatagttatttggaatctctcaaggtagataaatattagatgtggatgggaaaatcatcccgtgagacctgtgtttaattttaaaccaacaagtagggatggatagaataaaggaaaacaataaaaatctcataatccatttctgtcctctccctcacatattttatgtttaaaaactataaccacctagaaaactatggctatgtctgggcccagtggctcacgcctgtaatcccagcactttgggaggctgaggcgagtggatcacctgaggtcaggtgttcgagaccagcctggccaacatggcgaaacccctctctactaaaaatagaaaaattagctgggcatggtggcagatgcctgtaatcccagctacttgggaggctgaggcaggagaatcgctagaacccaggaggcggaggttacaaggagccgagatcacatcattgcactccagcctgagtgacaagagcgaaactccgtctcaaaaaaaaaaaaaaaaaaaaagaaaagaaataaagaaaaccatggctatgactcatgaagttatggttactttcttttcctcctgctcccttcctttccctctctcagaacattattattattccttattcctttagggaaatctagggactgtttgaatctttccctgagggatttatttcccccattaggcttctagaccttaagtgcctccatctcctcttcttgttctactgtctgggctgaaggcaaagaagagaatacttttttcttaaacttgattaatgttttactccctttgaggtgtttagactttacctcttatgtgctagtctttttatttctatttttagtgtaggcttcctttaatagaacgggaatgttttacataatcctgtctcataaaccagtttttttctctcaaaaattattagcaatctggatggagatttgtgggctggccagaaatgatcttttctggggatggtggtgtgtggaggagtggtggggaagtaaaatcattcctcagctcagttctggacttaaaactgtagtgaaatgagaataaggaaagacttaattataaattctgtcatgctggcctgtcagaaaaggtctctgtaacaacacctcttttaacataacatgtaatgtgtctatattttaaagagactgtcatcaagtcttaaagaaatggagagtcatctgtctctttcttaactgctttcttcaggatgatgcccggcaattatttgttttagctggcagtgctgaagaaggagtcatgactccagaactagcaggagtgattaaacggttatggcgagatggtggggtacaagcttgcttcagcagatccagggaatatcagctcaatgattctgcttcatagtaagtaatttttctctgtgaaactataacagagaataacttggtgacactacagaaattttagtccccacttaaggaaatgtttaagtaatagacactcttagacgtttataggatactttataaaaattgtctaagtttaggattatagagcccttggtcatttgtatgatttggagaaaaaagttccctcttggaatgtaaatgggagacttggcaccacaaaattagttccatggcattttattataagcaagtgaaggaggagagacatctgttgtggctgggttctgaatctgttccaactcataagttccctctgtgtaagggcttggcactgatagccagctagagagggaaattagaatagtggtattcctttttatgcagccagctctctgtgtctgggccgcactatggacttcactagtaacccttttgccagatcacagtagtagactttgtatagaaagagaaggttgagtcatggaatgaagttgaagtatctttttgtcaaggatattatcttgagtgttaatatagttttagagaatttgtaatgaatacttatattaagctattacatgttatcctattttacctcttttacatatacttatttatgaaacctagattcagaatgtattttttttgttttgagacggagtctcgctctgtcgcccagactggagtgcagtggctccatctccgctcactgcaagctccacctcccaggttcacaccattctcctgcctcagcctcccaagtaactgggactacaggcgcccgccaccatgcccggctaatttgtatttttagtagagacggggtttcaacgtgttagccaggatggtctcgatctcctgacctcgtgatccacccacctctgcctcccaaagtgctgggattacaggcgtgagccaccgtgcctggtccggaatgtatttttttttaatgtacttttgcggggcctggtgagcacttgttatctgtatttctctctgtactggatgagggcacgtttaagcattaaagttttttctccaatattactgttttcctacttttcacgtcatgattctagcttaaattgttacaagaagaaattaaatgatatagtcaggctgtgcataaggacagggatactttctgaaaaatgcatcattaggtgatttgtcattgtgtgaacattgtagagtatgcgtacacagaattagatggtatagcctactacacacctaagctatatggtatagcctgttgctcctaggctatgaacctgtacagcatgttattgtactaaatactgtaggcaattgtaacataatggtaagtatttgtgtatctcaacatctctaaacatataaaagggtaatgcaatggctatgatgtcactggggctaggagtgtttcagctccattataatcttacaggatcactagcatacatttatacagtctgttgttgaccaaaacattgttatgcagcacatgactgtatttgaaaacttgcttattctttcaatgagaacttggctttagaaacgtttcaggattcttgcctaccttttaataacatcttagttgcaagtattgatagcttaaataattctaccagtggtcatcaaaggtagattataattgctttttttcatctttcattcagaaagctctgaatcctctaactacatgtgcttatagagattttcataactgttgatctaagcttgcctctttacattagtgatagtatttggttttatagatcattaatgattcacttacattggtgccatctgctcatcagttttctagcctggaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcactatagttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttgggaggccgagacagacgaatcacctgaggtcaggagtttgagaccagcctggccaacatggtgaaaccccatctctactaaaaatacaaaaaattagctgggcgtagtggcgggcacctgtaatcccagctgttcaggaggctgaggcaggagaatcatttgaacccaggaggcggaagttgcagtgagccgagttcgcaccactgcactgcagcctgggtgacagagtaagactctgtctcaaaaaaacaaaacaaaacaaaacaaaacaaaaaaacctacttttgttaatatatatagactctatactttaattgtcctatgttggattcatattttttcttattatttctttctttttttaagagacgggggtctcactctgtcactcaggctggtgtacagtggcactctgcagccttgacctcttgggttcaagtgatcctcctgcttcactcaagggtaggaggattagctaggactacaggcatgcaccaccatgcttagctaatttttaaaatattttgtaaagacgggtttctttatgttgcccaggctggtcttgaactcctggcctcaagcgaccttcctgccttggcctcccagagtgttgggattacaggtgtgagccaccatgcctggcttatcatttctatgatactgaagatctgattctgttttgccacttaataactagtaacaggtttaaaataggaactaatttagtctgttcatttgctatgcacatggttggcttcaccaagtaaaagtaaacgtgtcttttatttagttatctaaatgatctggatagaatatcccagtctaactacattccaactcagcaagatgttcttcggacgagagtgaagaccacaggcattgtagaaacacatttcaccttcaaagacctatacttcaagtaagtcattagcctttttgctaggtgtgccaaatacaagtatctttcattttagtttaccatctcttaatcagggtaaaatttctctgggcagtattccttggtttaaacttaacatatttatcagcattgtttgaatattttaactgaatgggggcccaaacatctcttgtttctccaaatagcgtcaaatgtttgtgtccttttagaggaatttaaattcaaaaataaatttaacttgcctcccagtaaaatttttcctgtgataactggtttgttttaattttattattttcagctgcttttttgttagactcaccaattcagatattgaatgtttaataggataacaatattaaacttatgaaaaccagttttttttcggttagttacatggttttgttttgccattttgatttaaaatagaaatgcttttctcaccagtgtcacttcttattggtttgaatttcccttcaagttgaatggaatggagcaagtattgtcatggctcttaaagtaatttgtgcatagtgtcatgtacaattaacttcttaatacagtgcagaatggaaaatagacttggggatagaggtattttgggttggtaagatgacatataaacagtgatttttttggtttgtttttaaatttttatttttttagagacagggtcgtactctgtcgtccaagctagagtggagtagtgtgatcacagcccactgcaaccttgacctcctgggctcaagtgatccttctgcctcagccttccaagtagctgggactataggctcatgccactgtgcctggctaatgttttaaaaaaattttatgtagagacaggatctctctttattgcccaggctggtctcaaactcctgggctcaggctattctcccacctcagcctctcaaagtgctgggattgcaggtgtgagccaccgtgcccagcccaactgtgattgttttagagagagaaaattctagtattctaatacaaataactttctcattagcattagtaattcttttttttttgagatggagtcttgctctgttgccaggctggagtgcagtggtgcgatctcggctcgttgcaacctctgccttccgggttcaagtgattctcctgcctcagcctcctgagtagctgggagtacaggtgcgttgcaccacgcccggctaatttttttttttttttttgtacttttagtagagatgggcttttaccgtgttagccaggatggtctctatctcctgacctggtgatccgcccaccttggcctcccaaagtgctgggattacaggtgtgagccaccacacccagcaacattagtaattctaaaacaagcctcagcttgtctctgtgttaatggtcttttataaatattagaaatgtttattttggttcccattttcttcttttgtgacctttgagattaggagtaaacttttccccttcaatataccatgtgttctttagttatggcattatgcttatatgtagaatgtgatgtttgttattattgcatacagatgtaactactacctcaaatcctctcagttctttctctgaaaacaactgttccacaggatttgtgaaatccacatagggtttacgtattactagataccagttggggtcttgaaatcctaatacaccaaactagattttttcctggtgcaggaaaatagcagttcagctatgaatgcttttagaatagacttgctgcttatctttagtactgatgaatttatttagcaagagcagcaaagaccacatggattatcactcgtgagaccataagaatgagatttctttgtataaggtttgtaatctacttataattaaaagttgtgatcattatttagtgttggaaactttcttattggtgttgttatataaatcagtctttagttaggcaaatcctaactgtcctgtctttttatgccatgatcaatagccagatctaattaaggtgccacacctacttgattgttggcatgtagatatcttgttatgaagtactatcatttcttccttttcctcttctctctaggcaaaactactatccatttattcaaacatttattgagcatctaccatatgcaaggcattgtgtaattgcttacttgcctctcagttaatgaggtaatgtttataaaatgttgatctcttagtgaatgatattgtaaatgttaatatgtgctaaaagcccaccttggaacttcacagtgttatacagactttgtagaagaaaatgggggagtaaattgaagttactggtgtgtctccccttgagacctccatggtgaaatatatgatgttagccttcctaaaacctgtattgtgaccctatattaaagccaacttgtgattacatcatttcaggtgtcatgaccaaaggtcaaaaagaatcgtgcaagatcaacccaaaggaagagttgggtcataaagagataattcctttcaagcatacattgagaaatcaccaactgtgtcttatttctttcaatttctgggggaaaacatctctggaaatgtaggcctctagtcactatagatcttatacattaaaccagtttggcagagtttagcctttaaaaattgtgtcattttcttcaaacaccgatcacaagtaacaatttgcatgtgtacatcattagacctaagtatcagctaaaacacaaagcagtgcagatctttttactataggaggtagttgaggatgctgttgatagaagttcagcagttgactcagaataccaagtaagtcacccagaagacagtattggactaaaactaatatggagtgtaacataaagtttgtgaacagttgagactttattaattaggtttaagtaagactcggagtttggaaatattggtcaaggctgttttttagttattgggttcatagaatcctaccataaaaatataatttatttgtttttacaattaatctctaattttttttttaaggtaaggaaaacaaacttaatagggagaagttatggaagcagagtgcaaatagggcatttagaggcaaaccattttgagagtcagaacatgggtgctggagttagagtgcctaggttcagatccccagtccctgtttgttagtagtgtacctttgagcaaatcatttaacattgaatgtgcctcaatttctttatctgtataattgggataataataatagtacttctaggagtgttacaagggcaaaatgagttaagatgtttagtagtagtgtctggcaccatggtaagcactcaataaatataccattattattattatctcaaactgtattatttagctctttgcttttcctgtcttttcccctccttcctttaatccatttcagtgcttattctgctgacttttcacacatctggtacaagctttgatagagaagaggctcagctatctaaaatgagaatctagattattcacaagttttattttctcatgttgttgtcttgtacttttagccaggataattattttgactgcatttaatctattctttttcttctattataaatgaagttttgaatatgtaatagtgggaagtttcctaatcatttcagtttaggggaaggtgtatgtgtgaccttgctgaatttgctttctttccccttgcgcaggatgtttgatgtaggtggccaaagatcagaacgaaaaaagtggattcactgttttgagggagtgacagcaattatcttctgtgtggccctcagtgattatgaccttgttctggctgaggacgaggagatggtatgttggagcttctggtaaaaagcctgtctaatgtagccaggaaatggaaaataacttattaggaagattatctgcatccatttcctcattcaaccaaaacttagtatctttaatttttttgatctgtgccctattactctaaaaaagatgttatagccaccttgagtatgtggaaaggatgttagccagcccttcctcctacctcctctcccccaaaaattacaaaaatgaggactgacactcaactttatcttattggtgtttgacttatttccgtgaatgccatttagtgctgcaaaacttgttggtttgtctttttcattaacttaatccacttttactatttgctactgacctatcatcctttatttctttttcagaaccgaatgcatgaaagcatgaaactgtttgacagcatttgtaataacaaatggtttacagaaacttcaatcattctcttccttaacaagaaagacctttttgaggaaaaaataaagaggagtccgttaactatctgttatccagaatacacaggtaaggggttatgaaagattttattggaggtacacatcttacttagatcaacactttggtggcattcataaaactgcctttttttttttaatgattgattgggagagtattcagtggtagtggcattggcattaagcctgtgattaaaagcccctaagtcaagagtgccatatcagacacaattgagttttctgtgtttattttaaatttctatcttcattttttgaggaaaatacaaaaggagaaaaagtaaatttgggagctgggcatggtggctataattctagctacttggaagcttgaggcaggaggatcatttgagcccaagagtttgagatcagtctaggcaacatagtgacacccccctgcctcacaaaaaataaagtaaaatttggtatatgttgaagaaaatacaagggtaaattttaatcattgtgcccaagagactgacatgtagttgcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacgggaataaaagcattttagaaaagaggaattgcatatatgagaatatggaggtaggaaaatggtatgaccagttgtggaacccagaaggaatttggtattactagagtttacagtggcagggaagaagtggttggagagatggtcagagatcaactcatggagggccttatatctcatgctgagacgatgatcagttaaaggtttaatatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcaggaaccctggaagcactctttatccccatcttttttctctcctctctgtgtatcttttttattattctttctttcctaaccagctttctctgctattcagtttatgtgataacagcctagtcacagtttctgtatctctggtaaaaagatcagactaggctgggcgcggtggctcacgcctgtaatcccagcactttgggaggccgaggcgggtgaatcatgaggttaggagatcgagaccatcctggctaacacagtgaaaccccgtctccactaaaaatacaaaaaaaattagttgggcttggtggcaggcacctgtagtcccagctactcgggaggctgaggcaggagaatggcatgaacccgggaggcagagcttgcagtgagccgagatcgcgccactgcactccagcctgggcgactgagcaaaaaaaaaaaaaagatcagactagactgggattgcttggccttggtttcaaattccaaggagagagattctggccgtggttaagtcaggcagaaatctgtaggccaatcagttgaggtcaggggcacaaatgtaactgccagggatggatcactatgaaacttatagatcagaatcaggtatttccagagaaggggaactcttattagcagagacactgtaaatgctttctataataaagtgaggctgggtgcagtggctcatgcctgtaatcccagcactttgggaggccgtggcaggtggatcatgaggtcaagagatcgagaccatcctgaccaatgtggtgaaaccctgtctctactaaaaatagaaaaattagctgggcatggtggtgtgcgcctgtaatcccagctactcgggaggctgaggcaggagaatcgcttgaacccgggaggcggaggttgcggtgagccgagatcgcaccactgcactccagcctggtgacagagtgagactccatcaatcaatcaatcaatcaatcaatcaataaagtgaaggggtaaagcaggggtaaggaagtgggaagagtcagaggtactcccaggtttctgtcttggatgctggtgctgtgacctgaattcatgtataggaatgttgatttttaattattcatagaacgttgaaataatatctcatggacagttatattcgaggttgaggagaggttggggtttgagatcatcagtagtgaaaacatggaaatgggtgaaatgacctatggagataatattatagaatgaggagaaaaaggaccacaggtagaacgagagagaatagcagcctctattggcaggagaggaagaaagatatcataaccaaaaggagaggttaaaaagtgagttgattaaatatttcagtcaacagtgttatctgcagataagtaagatacatactgaaaaagagcctttggagttaacagttaggaggtcgttgacctgctgttgagagcagtgtcagtggaaagttgagtacagtgagttacagaatggaaagtgaagaaagaagacaagtgtagactactcttgagcaacgtgggtttaaagggaaaggagagatttaagaatgtttataggctgagggctaagatcctataagcaaaagagatacattaaaaaacagatgtaattgaaggagcaagatttgcaagcaggtgggaaaaaaggaattaagagtctaggtaggataaatggataaacaaattgtgttatatacatacaatgaatattacttacccaagaaaaggaataataatagatggtacaacttgtatgaaactcaaaacactgtgctaagtaaaagaggccaatacttctattatatgatatatccaaaatagggcaatttctgtccatagagacagaaagaatattagtggttatgagaagtgggagaatgggaagaaaagggagtgattacttaatgggaatagggtgttgaaaaagttttgtcactagagagaggtggtgattgcataacattgtgaatacactaagtgccacagaattgtacactttaaaatggttaaatatctgttatgttaattttcctcaataatttttttaaaagagtataggtagagcaattgatttttgagcaagaagtaagacacctctaagaccagaagtacaaataagtgcagatatgtaacattttgagtgaggtggtaggccaaaaagttgagatgtagtttaatcctcatggcctctgttttatcaaggaagttggaaatgtggttacctgttcagagtaaagaacagagggaggtgagaataaggtgagtttatagaaagcaaccaagttttaggattgggggagagagatgtaagacaagtaaaataattggcattaatgttgaaggcccagcttagagtcttcacacaaagcaaagagcctttaatatcatttccattttctttgttgttgttaacttccaagcctatcctccattgtcttcattctgtgtacagattcttacggtccttatttgccaggtattattatctgttcctagcagacaaaattcacttttcactcatctgcctcctttaatttacagaggttgttttccagattttaagaacctgcttcaagcacctacaaagctgttttccttcagttctttaaatattttaattaatattcttttcctttccttttttttttttgagacagtgtcttgctctgtctcccagacagaaatgcagtggcatgatctcggctcactgcaacctccacctcccagattcaagtgcttcttgtgcctcagctctactacaggtgcccaccaccaggcctagctaatgattttttgatttttagtagagatgtggtttcactaagttagccaggctggtgttgaactcctgacctcaagcgatccacctgctgcggcccccaaagtgcagggattacagatgtgagccaccgcacccagctccttttttcttaagctccgttttgttacctggtcttctttatatctttgttattgatatttttgttatgcttcacgttactgaaaatagcctgtagtttattggaataatgaattgtctttgttgcgtttccctggctttatagccagtttctaaggctactctaaaggttctataagtagacaagatggtgtaaaaagcaggtgatttaagggtattaattacaaatattgttgagacaggctttgcttttggttcctgtcacctttctttttgtaaaaaataagagcttcattgagatataattgggaaaccctaaaattcactcttttaaagtgtattgcttttccttatttaaattattaccttaaggctttgaagctaaacctctttaaaactgtggaatgattttgaaaagaacaatttaccttgttgaattccttttttttttgttttaatacaaacaatcccatagcgtttattgccatcttttagtaacataagggtaatcaaaacactatgaatgaatgttcatattggaaaaaggacatctaaaagcaaactgtatccttctcaacaatttctcacttcattgatcctttctagttggagacactttgtagcagagtaatattatctccttttagcatgatccgacccagttgttttaaaaaatatggaacgcttcacgaatttgcgtgtcatccttgcgcggggactgtgctaatcttctctgtattgttccaattttagtacatgtgctaccaaagcaagcactaccctgttgaatttttattccaagatcactccaaggaacacagcctctctcagaccttttaagcagttgtgttccctagaaatgcaccttcctactttcctagtttccttttatactttctagatttttttagctgaaaagtctaaatgaaaaggtaaagagaaatttaacgttatgttttcctcaatctttgtgtttgatgattttattttgttaccatgagagtccactctcacgaagaacctaattatagaaacacctaatgattatagaaatagagaattctactcatatttaattgggttatgttccctctccataagtaaatggtaatggtctgacttagttgagttcaggcagctgttacaatttgaactgagagtactgggtgtccgttttaggttccaatacatatgaagaggcagctgcctatattcaatgccagtttgaagatctgaacagaagaaaagataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagtttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattcagtaatatagga

SEQ ID NO: 16550 - DNA, 15775 bp, Human
cacaagcagggtgggcaatgtgaactggccgttttaatgtatttgtacccgcacgtccttgcacaaaagatccaaggctgcgcggagtaattgctattagaatagtgggcatggtccctaccgccgcaggttcggaccttcaaagtgacaatttatggatgctccctggcgctccagcgcaggggaagcccactctgaagacgccctccccaccccctcctctccttccttccgactcaggagagctcgacacgccggatagctgcggccagccgtggccatcctggccccccgcctccgccttccccactcccgcgtgcagccgggacacgggaaaggaaagctttggaagtcaagcgccggccaaaagatgacctgcccgcgtgtctcctcgccccctcccccagccgtgtcacatggcggccccaaccaggcgggcagtgcgccccgccgcggagacccagggccgcgtcgcctgggcagtgggtgatgaaacttcccaggcgcattaccgcagagggcgcgggcggggcgcggggcgggggtgggggatcgagagctggtaccggggctcacctgttctccaggaggagggtggggacggggggaggggcgagtgcgcgccaacgccgggtgcgtgccctggggcgcttgggcgcggcgctcgtgtccccgccctcccccagccctgcgagccccccgagctgcgccgtggggtgacgggaccgagagcagttcctgtccccggccccggcgcgggggagacgtgagcgtgcacacgtacacacacagcaggggaagaggcgctccaagcggcgcccaactttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacaggtaagtgcatgtgcccccgcagccgggagctactgggagaggacaccgtgcacccacgcggcgcgccccaggcgtttcgccgggagccaggcgcccacccagggccacgcaaactcttgggatggcacgggacgtgcaaagggaagcgcgaggcaaggcgaggtccgcgccgggctccgagggcccggaatctgcacgtgctagcagggtgatgaaatggctggggcaggacttgttgctgtcctccccagggtcgaggggaaatgaagcagcgtctgacgctgccagcgccagcccccgcccccgaatcccgggtccggtgcaaagcgcgcttcatcccggccggcacgcgggaggcccagagggtccccggagctgggctgcgccctgcgcccggagaacttctcttcctggcctgccggcctcagtaagggtgccgcgtcttccccctcctcaaaagatgcccgacatcccagaactttgccggcgagacaaatggcattgcgaactttccccctgggggcactgctttcggaagggagcgtgagggcagcgcaaagcgtacctccgcggtgctgccgccatccccagctcctggccaggtcagcaagccaagaaatggtgacacgacccgaaccgtgcgcctcctctgctctaccggctcttggctcaccggcaagctgcaaagcagagccaggcgtgcagggcacggggctggcccttttcccagctcggaaagagaaagaaaatctgcctacagctccttcgctccacgacccctcccccgactttggggggccgtgtgaacgcggcagcggcggcgtgcgtgcgctcaccgcacgagctggaatgcacgagtgcccattagggacgccccaagtgagtgaatggcggccctgtgcggtcctgccccggcggcgcgtggggtcttacggatcctgtcgcctccacatgctggggccggcacccccaccaccccgagaccctcgcccaccctccccctcctctggcgcttcctctgagaactgaacctgattctcggtggtcggtgaccctcaacaatacacgcccctcattctctggctagatttaatctgatgcgggttatctgctccgaccccgcccttcttccaaaatatacttttctgatgtaattttgtggttgatttaaatcagagacttgggtagtggaaagggagggaagaggctttgcacgctgcagcctgacagttaactccctccgtctgccccttccgagagaggactgggggccacattcggtgaagggctgcaagcttcctcccgggctgcgggaattctaggggattgggtgatacctcacccggatccctaattaaaaggagcctgcaacctctgatagtggcgtttctgaaggctcgcccccagctgactccactcctaagcctgctcgccaaccgcagcttccctagctggtattttaatgcgaagggttgggaggcactgccttaataggaattttgttttgatttttaggtgttgaatcataaagctgaattgaaactgctttttagatgctgtcatttgggggtcaggaagcaaatggctgtgatttaatagcagcaacttctacagatcaagtagagaagggtacttcattgatgaagtacagtcttcgactcaaaattttatttttgtctgtgggtttaaaaagcggaaatatattttgctctcaaactaagtattcccacaaatactttaataaaatggaaaggatgaaaaggaggaatgctcagaccagccttctggttgtaatttttgtaatttttcggctcttttctacaaatatttacaaatagagatatttttcatgagtagattaaaggacgaaattttgtttcccaggctttttaggtcctgaaatagtcattactaagtcttttttcctccttaaattttcctttagttgttaacttttatttcaaatgacctctctgcattgcccagcatgggttagagttttgtatatatttgtatgtgattttccttttagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccaggtaaaaatccatccagagcatgaagaatgtttggggtgagcatacatgattgaaacgttcattggaaagccttgttaaccaacttcctttgctgttccttgtggtgtgttttagtgcttgcaagcgacagtctaggtataaaacattatgccagtgtctcccttctgcactcataagctgtgtctacacaggcagggtggactggagaccaatgtcataataaacgataaacaccttgtaaggggacacgctgtgtctggccacccagaactcagtctccaaagcccactgcatgagaggcaggggcaggaacccccaattatacatttcagaagtcatttcacctactaggaaaatgagacacaaagtatgtagaaatccgtcatgtggtgtgtgggcagccaacccgaataactcaggacctccaaaagagcagacttctattcctcctgagtagcagatctttctctcccaagctgaccggtcgaaaccctgattgagtccttcagttccacactttccttttgctctatatgataaatatagtcagggcctgacccacttcggttatcccagggtcccaaggggaacgcggagttgctgctcagggcaaggcaggaacacaacaagcaacatatggctccagtgccaacaacgcaaatacatttttagatggcatgtggcatcagactcaccttcttcgtgttctccctggccacttatatgccctgttgaaacgccctgttactatatctcagaaacgtctctcctgcttcattggagagcaatgccaacatttggaggtggccatcagcttaggtgagatttatggatgtcaccagtccccatccactgacatatagtagtgagcctgacaaagcagtgcctgggaacaaggaggggaggcgaagacggggctggcagcctaaactgcagaggatgtgcggtgtggccagaggggaaactgaaaccagggaaggaaagaggtagaactttgaactccttgaggctccctaataaagcatcactctggattaacgggaattaggaaacgtaataggaaatccggaggaaagacgtgtatttaagggcaatcccacaggatgtcagggaagaataccaagaacagattgccacagccctcgcataaattcatcttcctcttttttttcccaaccaacaggaatacgttctcaagttagagacatccctttcaagttgatgctcagcacataactgcttaataaacgggcacaccctgccctccattctgtttggctctggctggagagtcaaaagagagggggccacggggaggccatgcgggccacatggtttttcagagatcagacgctatctgtagacatttctatggctgctaaagacaaaaccaaaataaatgtgctggctggcttcccacttccaacctaaacccatttactttctcaactcagtgacttccgggcctgtctaaaaacagaggggtgacctctccgacgacagctagtttctatagtaatgtggggtgcggggattcccgggtaggcatcccacaatgcctccgggctgcgcgaggttgataagggagcagcaccgagctcgcctccacacccccaacagctgtctcctttctaggataagcacaatcagacggggttgccaggaaagagaactgcaggccagatgtatgcctggctgccttcgccactcggaggcagggagcgtgggggaggggccgccagtgcggcagttcagactccagatgctgccaggcagggtgccaggccagccttttagaggcaataatccgaacagtttaaaggagtagagtcattttcaaaaaggaaaagagcgctcttcctggtagggtaggaggagacaagggtatggatttggggcgtgggaggcacggaggcagaaagggaggtacaatcagcaatcaatctcggtgtcgcccctggaatcaagggaaaaaggaaacgtgtgagatttggacatgcaggcaccttccacttagggaagactgcttgtgagaaccgtgagggatttatggatttgtgtctggccaaattccctttgtgttccagaaaagttgccaccacacaaccaacacagggctacctgagggacacatagccacggaagcccccgttggagggaaactcacagagtagccagggaggaaggagggagatgtgttcgtctacagaatgaacatcccttgttgcccagtgctgggggtgtcatgtcactctggacgtgcctccggatgtcgcattgcctgtcacctgggaggacgtccgtctctggtggggccttggggttctgatgtcagaaatatcctgtgtaagcccaagaagggctgaaatgtccaagcatgtaacgaggtcttctgctttctgcccctctctcccttccccggcctgtgtgttctcagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgagtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaagaatgaaatgtgtcgattcagtaatactcttcatcttccccttagccaagaacccactagctctcagaatattctgagtagctgtagaggtgtccttacagacagcaaattgctaataacatttgttgaatatttactaagcgccaggcactgggctaagggctccttgtgaatttttcacttgatcctcaccacagccctcgtcacctccatttgacagatgagaaaactgagactcactaaggcagagctcacacagctagtgacaggcaaagccagacttgggacctggctccagtctgctgagcagtctgcctccagaacctatactcttaaatcccgaaaacagagctatagatgcttttcctgcctccttaactttcctttcccttagaaggttcggtttaccttctctcatacattagtgccctctcagaggaaatgcaaaacaagtgccaaaaactttaatcagctaaacacttctatgccaaaacaaggaaatgtgaacttacttatttcaagacttgaaattcaatgataaattcaggatgcatcatttcttacaaaatatttcagccacaggatcctaaattttgcagcatggtaaagcatgttggtacacaattgttcctaacatgaggcagggccaggagcccctgaagattttttttttaaatattgacaatggctctttcctaagagacacagggcagaaagaaagccactagccaaccagttcagtacaagtcattaccagtttgatggcactgttggtctctccacggtgactcattgagccaaatcggtataattttatgaactcttgatcctcagtttgtgccacaaccttcttccagttatgtccctaccacaccaacaccacttagatgacagagaacagcaagcacctcctgtctctttccacttggttataaggtcataggcatcttgcaacacccttgctacagtgttagaatcatacaattcatggcgaaactctgcaggaagctcttgccaaaagcaaaacaatattgcattttcctcgaattaggctaacgccttacaaaatattttttattcttcaaatatttttaagggaacaatagcagccacagcatcatcaacaacaatgatagctgtctttttttatgtttttttaattttttttctaatggtctaggcccttggccagggcctttacatgggttatctcatttatctttcccaaagatgctacaagatagaaattactatgcccaagaggaggaaagtgaagctaagagattagagaactcggactgaggtttgattcctgcttttaagcttcggaattgctggtatacatgactgaagccagtcatcaggaatagacttcaaacctgctcccagcctattatctccctcctagacctgaaagggctcacagctccccacatgtggtgggcttcttgtccttttatcaaatatatccccattacacaaggagaacactctaaaattcccttccttcaggtgcctctggaagagaaaaatgccccatggctaggaaacaccgtgagcttcactcgcctctagccctgtcccccattagagagagtttgctggcctcaggaatcggtggggaatggggcccattcctagtttataaggctataatgcatgcctggagcacaggaattctatctttcttggagaaaagtattctttgggaaaactgaaggttggaagtcccaccccctccccttaatttaagaagaaggtaaagctctctggcgttctagtgtctccttcttgggaatgtggccctcggggccatggtctcctcacaccattcagaatgagcctatgaccccccaccccagcctgctctggaaatgcaggcagcccatataagaagcctggtcacatgctgttcctcttgcttccccctaagtcagcatctctaggcaggggtctcccctaactccagcttcccaaaaacccccattacctttccttctgaagccatgatgtggcggtgcatcgacttgtacttctagctgaactgcctgttttttaggtttttttttcccaaccatcttaactgattaaagtatcctatcagtccccaaatatcaagaagcccatttccaaatgtgtggcattggtcaaaaaaaaaaaaaaagagagaactgaatttgcttttcactttagagatgaggaaatcacagtcaccccagaatctgcaccacccccattcttcaacccaacccccatccacaccagaacactcacccccagttaatgctgctcttttcaagctcttcctctccgctcccctcaccccttcctgcccgccccactttctgcacagcatctgtctccccctagctgccgcctgcctggttttacccccactcgccatgtcactgggtgctggcaggctccaggcacatccccctccaagtattttttaaaatcctttaggcttgctgacacccagttgaacgagctggactttgtcattagacacgggctgagcttgcagcctcagaaggcaccaggccagctcggaacacggcttggattaacttggttcggcacacacacccctccccgcagttcacagcttcctcctggagagagagagggccaagggcagaggacagcatgggctcatccagccttctgggatccagatccgccctgggcttctgggggctcatctggcagacagaacgccctggccgggaaggcgaaagacagtctgcatattcccaagacagccctccccttactctggggaaaggagcttgaagacagcatccagttagtatctcagaaagacagaccctcacccctgcagtgtgctcacctagccctggtgccgcggcaggcacagtcaggtgctaaaatcctgttgctgctttagcagacacactcggtgaacttgagctccggaggcagtttctagttttcaaaaaatagaaggaaacaagcacgcgtggagcatttccctcatattgcctcctgcatgcccacctgcccacctcagggcagtccaagggacagggttaggttgtcttgcgctgtcaggggcctgccttagggggtttaaagccctttgcccagcggccatgcacagacttgctgactccaaagtcatcaagcaggccctaaacagcagctggatctctctcagccagagcattcctcctctctgctctgctctcagccaagccctgggccctgaagcccagaagcttccaagagccaccttctccctgcttttctcagtttttgcatccatgaggtgaggacagttcactcaattccaacttgaggaataattaataaaaaggcagtaaactacttcacacatctcaaaacacagtctgctctttccacatagcaacaactgccaacttgcaaagaaaaggctccatgggctgtaacgcagcctctctggtggcccagacttagggaggacaaatcagattgctccttgttatgaatgacctcacattccatggtgacttccctgctcaaggtgatggcccaaagctgcaatgcttgtggtcagatagatcagaaactttgccagcgaggactgcctaggaatgctggttagccatgtgaaacattctataccccccttggggggttttaaaggccagtgagaggttaaaataaaagctcagtgagtggcccatgagagcccattgctggggacactctttaccagatgggcccataaatataaaaagcagatgctcctgccttctgcacaccttgtccaccccctggagtaaattattccagtggttttcctacagaacaacccaagacaaccggaatggcctgaggaactggctctgccctccagaactaggcgagttcattgcacagtgagctgtctctcagtccagacacaggggcccctgaccgccagccttcaactccaaatctaaggaagcccagactgaaagaataaagatgctcagatggccacacctactccccagcctctgctactgagaaagggaatcactgcatgcacgggcaatgacgtcccagggacatggtcttcctccctcccacttcagctcttccatactcctccagatgcagaggaaatgcatccaataacttccaaaaacacccttcttcatcagaagcctaaacccggggcaaacacaaacatggggaaaatggtttcttgggggcttctcatagagggcacgtggtcctaaaccttcatggtttcctcttccctaccaaaaagaatcctctgtttggaagtctatgtaaggccctgcaccatttgcctaattatgattccactggaccccagagccatctccactctagctgaaactcacctagttagtgtagcctaaaggcacccagagctctcctgccattattcacgcagccacctggatttctcaccatccccagagggtcttccttttagggtcctaagctcttaccctatgcacctgtgagcctgggacacagtggccacccaataagtgttggttgaggccagtactccatagactatgagaaaaggcttgaagtcatttgagagagatcttccaccgaacccaagacaagcactggccatgcctccttcccagcattgcccctgccctctgtggtccattcgggacttgctccattcccagcctctctctctctctctctctctctctctctctctttgctttcaatctttagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcgtcattgtctgagagggtcattgatgtccggtgcacagggggacagctgtgagcaagtgggcttttacgtcaagagaatcctatgcttctgtggatgttcagcctacagggaaggaagttagatgaagaggactaccctaggcttctccgtcaga

SEQ ID NO: 16551 - DNA, 87617 bp, Human
  misc_feature (1)...(87617): n = A,T,C or G
taaaatggggagaataatgcttaccagataaggttgtcagaaatatcaagtgagatagtgaatttgaaattactttaaatgatgtgtaggagtgaattgctatgcttctgccatctggggtgaaaaggggctatggtccaggtttgtcactttatctatgccacatatctaggtaaaggggctctctcctttctctccttccctatctcatggagtatcagtttgatcctctttccttaaacattcgtagatgatttgtgcctaatagaagactttaaaatgacctgcaaagtggctcaagcctttccaaggagaaagggactattggtgcattggtgtaagttcagtttctctcagaatgctaaccactgagaacactgcagtaagcttgacagacaggatccttgctctggttgcgtttgaattctagttgagggaaagtgaatgatacacaggtaaacatataaataaaataatttcagagagtaataagtactacaaaaaaaaagaagaaaagaaaaaatgcaacaggtaatgttatagagtgatttgggggaggaagcattaggtaggtggccagagaaggcctctttgacaaggtgacatttgggctgaaattcaaatgacaagtattcagccatataaagatcaagatgatgagggtcccaagcaaataaaacagcaaataaaattaaaaaaaaaaactttaaaaataccttggtacaaaatggaggccattgtaggaggaattactgagacggggagagtgggtcatgaggaggcaggagggttgggcacggatgttgtacgcggagcttcgcagtctgtgattcaaaaaatagaaatcaggctgggtgcggtggctcatgcctgtaatcccagcactttgggaggctgaggcgggcggatcacgaggtcaggagattgagacaatcctggctaacatggtgaaacctcatctctactaaaaatacaaaatattagccgggtgtgatggcacgcgcctgtagtccccgctactctggaggctgaggcaggagaatcactcgaacccgggaggcagaggttgcagtgagctgagatcacgccttgcactccagcctgggcgacagagcaagactccgtttcaaaaaaaaaaaaaaaaagaaagaaaagaaatcaaatgagcaattacatgaagaaaaggaagttattttgccctctgcttctcatgtgtacattcattcagcagatataactcaacctctattgtgtgccagtcaccatgctaggagatgaagatacagagaaacataaaatatggaactagtttttattagcctggcaactgaggatagaggtgcatgagtaacacaatatgatgagaagtgtagtggagggttgtaaaggctgagggatcctagaggaggcggtgactgactgtgccttaggggccaggaaaatttgcatggaaaatgaggatgctttcacttgcagataaagcataagtagtaaggaagggagaaagtctcagccaaagggaagggcaggtgctaaggccctggggtgagcctgttcagagtaagtggtcctctgtcatgatgggcacatagcttgtcttgctagtgaaggatctcgtcaaaaagttagtttagagagctttctctgggacatggtaaaagacaacctggaatgaagtactagcggcagtcaggccagtgagtggggttggcaacagagcaggtaggtagacctgcatttggttgctggtcacagaaatggagagtgagagatatttctaagtcaggatgccctagtggcagacccccaagtcctcgaacttcagggcagaactgcctgggtgggaactctcccatgtctccttgatttcactgccacctctgctggcgtcctctctcatctccgccgccagcccccgcctcctttctcgggaagcttgggtctccctgggagcgggtctgcccttagggggaggcctctgggctctgtgccctgcagctcggcaggcattcgaggcggacagaaacggggcttggcgccccccgcgtgcacgtgtgctagcccaggcaggagggagcgcctcggcggaggagtcaaggaagagggggagggagaaacgcgccagaacctcggcccgggcgccctcgtcggccgcggaggagctgcagcctccaacaggttcgtagaacgcgcgctcgctccctgtggctgagccgccctcctccgcgggagcggttggcggagagaccccggccacaggccccgcgctcgagagcttcctagaggcggcttcctccggcctctccccctccctggagctctcagccgccggcggctcttccggggcgaggcagagggcgcctcgggcttctcgctccagcaccatctcggggacagctcccgcgccgcaccgggtccctatcgggtcagcactgcagcggcggacagcggcggccgggcgggctcctccgcaccctccgccctggttccgcgcggctgctaaggaccgtccctcgcccccgcgggccgctcccaacgctagcaccgcggcggcggacagctctctccggcggcaccgcgaaccgcgaacaaagccgcgggtctggggcccccagcgcgcctaggggtggcgtgaggccgcatcgatcgggggatttcagcttctcccagagaggtgtcaccggcgagctaggcgggggcctagcacagccgcgcgtctccggcttgggtccgccgcccgccgaggcctggccgtgcaatggcggggcccagctaagagtgggcaagagggtagaggggaaacaggcacagaacggtcccggctccgctaggcgggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcaggggggagggggcgacccagacagcaggttgcgaactcggcttagacctgggaggttgcaattagcaagaaaaaaggttgagggcgtctgtgaagccgggaggttcccaaacagggaagccagttccgcggcaggaaagcatacgtggaagagaaaccttttctctgagagctgaggctgggagggccctcggatcacgtgacactctagatcactgattgtctccgcggaagacaaggcctagggggcaggggtgattcgcccaaggtcactcagcaatttagtagcaaagctgggcctaaaacccgggctctctaactcctgggcctgttgcataacattcatagagaagtcttttaaaatcccagatgcaaggagaatagcagagtggtttacttactagcatatgaccttgggcaagtgactgtctgagactatcttcagctattaaagaggaatgagaagatcaataatacccacttcgatgagaatttaatgagagagccatgtaatgagcttagtggcacatagtaaatgctcaaaaaatggtagatcccatgactgctatcatactttctgtaaacttgtactggggacctgttatataccaggcactggctgtgcactggggaggcagagaagtagcttgaggaggtcacaggccagaaaaggaaacaaacagttgcaatatgttatgataagtatcaaggcaactgggctgtgggatctcagaagcaggagtcacgaactgtaaggaaagaccaggaaaatgaccccaggcagacagagctgtgtgtcaaggccaagagatgtgaagtcccagccaccaaggcaatgtcactgtgccagagggtcctcaggatgtggactgaaagatgagagtggagagaaaggctggagccggtctccaaagagccttttatggatggaatccttcaaacatatttagaaaaatagaaagaatagtataataaccccccacatacccatcattcagcttcaacagttggccaattttgtttcatttatacccacacccactctcatcacacacacccacatccactctcatcacatgcgcacacactcacactgacttatttggaagcaaacccaagacatcacatcatttcatacagagggattttaacatcagtacaacttctgccatgcagatactggacagccttggaagtcactaactcaaatcatgacctttctacctcaattcattctgaacatttctgtcctttgcagaatgttttgagaagccacactatagtgatgagccacatgcattaaaagaaactgtttcagaaataaacaagggatgcatcaacactcaacaggttttaccatgccagaattgttcatgtccactacctacagtgggctttagaccaattactaaagacaaatcaaactctacagagaaaaagcaagagcttctctttcaaagtaatctgaatcgtgagttcctaaggctagaaagcttagcattatggaaatcattgatttggaaatcatcaagcccaatagccacattttacaaatgaggaagagggggtaaaaaatggggagaaaatggcccaaagttccatggtgcagagaccagaaccgagatctttgaactcataaacttaagatcccattttcttctctagctcaaagaggctggaaggtggaaaaggaaggggggcaagaaatacccttctttgttctcaagaagatggcaatgtatgacagttggtcttgatctttgagatccctttgcaaatttcatatatatatatatatatatatatatatatatatatagtaatcacagcttactgtatcctcaaactcctgggcttaaggggtcctccctcctcagcctcccaagtggttaggactacaggcatgcaccaccatgcccagctattttttttattttttttatttttattttttttgtagaaatggagtctcactatgttgcccaggctggtctcaaactcctgggctcaagtgatcctcttgtctcacctccctaaatgctgctgggattaaaggcatgaaccatcccacccagccccttccatatactttctaagtaacttgatcttggtggcaccttctttctggctgctgtgttaacctcccagctggccccttagttctcatgagcaaaaggctgcacagtcagaagcccagatctcatttttgtggatttttgccagccctgcttttcttaaccagatgcatatgaggccttccttttccgatttgccctgaatttggctgcacacctagctcacagacctcagctccttggaggtgctaaatgagtagtatttggctcaggctctggaaggactcagagctcttgtgccttttgagaacataaattctccccattactgatgaaatgtgatggccatgatgggtatgtgtgtcctgactgggctctggggctctgattctgccagtcaggctttccacttttcagggaagcccctgcctatcaaatggggagggcagtgtctcacaagtttccccaagtcttaggtagaaaattcagagcacacgcaaagagctcttagcatccttggtgaagggaagtcagccattaaaagccaataagagccaataaaagtccccttgaacccaggaggcgaagggtgcagtgagctgagatcatgccactgcactccagcctgggcaacaaggcaagactctgtctccagaaaaaaaaaaaaacaagtgccttgttctgggagtgtgattgcagtccagacatagacaagtgatcaagatagggcatcccagcttgtgaaattatcccagctatcagcttgggatgagactgacttagatgcagtatattacctgggcctagctgaactgcaatatgtaagatcccaaagggacttggtgagcatctcctcttccttcaagacgcttactcattgaatggctattctgtgtcgggcaccattccaagtgatggtgatacagcagaacaaggcatgctaatctctgttctcatggggcttacagacccacagtaggcacagtcattgataacaattgaaaagcaaatgtgaaaatagacagacagagaaggcctgtgtgaactagtgacatggaattgaggcctgaatgacaagagtcagtcatgtgacaacgtggggcagcacactccaggcagaggaaatcgctctggcagaggccctaatgtgagcctggactgcatggggacagatgggaggtggagtgagtgaggggagagcagcagccgccaggggcagggagggggcagagaggagatcatgcaggcccttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctctcccacctggaggaggtcagcattcagctgaggagaccataggcaagcaagaacaacagtagcccacgctaagggctgccattgtgggaacagagacaagaagatttaagtcagcctgggaagcatctgggaaggcttcatggaggtgggcaatggatgtgggattgtatctgggaaaggagagtggtaaggctgctgcacaggtggaccaaggggcagcgtgtggtagctgtggagggcatggcccaggagctaggctgcctgggttcaaatcccagccctgccattgagaagctgtgtgggtttaggcaagttgtttacccttgtgtgactcgatgtcctcattcttaaagtggagacgatgagagtccaaagacttatttcaagggatttctgtgagagttaaacaagttaaaatatgtgcagcactcagacattcctggcactcagaaagtgccgtatgagtacgagtattctaaataaaaacggagcaaaatggagatgggcgagccgggagcacatgccaagaagtgtccactagagcccggctcggggcctcgaatcccagaccagagatgcccaccttgctctgtaagcaatgggagccattgaagacttttaagcaggggggttcagagtagagaggaagataaaatccaaaggcccagagagggaagggaactaacccacagtcacacagccagttactggcaggagtctctgtcctccagctcctccactgagttaacatctgtaggagaacaaaggcagtatatattttgtcccatcattgcatcctcagagtctagaataatgcctagggtattctcagaaaatatttgtggggtacattgctgaattggtagccagttgggccaggaaacatcagaaaccttgaatcctctagaagctcagtgctttcaggacaatggtgaaaccagtctcaggaaaataaaccaaacttccagaggtgttgacgtggggtctcaagcccttccaaatcctaggtcctcctgtgatcaaagacaccactgcccacactttccctgccgccccctcaatctgcaacaagcattgctgcatagggttcagaagttaatcttggtaaagtgcctggcagatgaaaactgttcctcagacattcagtgtggtaattgccaatgcggagaaaatgtatctccacgtttgcaagaggcaggcctttttgttccacaaaaaccagccattagaattcctgtctctgactcgtcggaagctgcgacagccaggagggcaagcagggtcttgcagttcaagcagcaaatggcaaaaggctccgaggaactcagccctggctctcacatcaggaacacctctgcagagtagggcatggggccaggtgcttctccaacaggagagagcctcagccctgacccttcctagctggacgatcttgagcaagtcccaccatctataaaatgggggtaataccgccagggcccactgggtcattttgcacaatgacaggcacataccagatgctcaacaaatgtgcttccttccttcctttctttttttttattttccttttttttttgagacagagtctcgctctgtcacccagactggagtgcagtgtcatgatcttggttcactgcaacatccacctcccaggttcaagcaattctcctgcctcagcctccagagtagctgggattacaggcacccgccatcacaccagactaatttttgtatttttagtagagacagggtttcaccgtgttggccaggttggtctcgaactcctgacctcaggtgatccgtttgctgggatccgaagtgctgggattacaggcatgagccacccagagtgctcggcccaaatgtgctttcaattgtgacaataacactgtgggttagggttatcatcccatttcccaaatgtgaaaactgaagcccaaggaatggctcattgattcgtcaatacccactgggcagctgtatgagccaataactgttttagaagctggagagacagggaagacgaagacaaggaccatgcctctatggagctcactttctactgggagacagaagccaggcaagtaaacaaaatcatttcaccaagtcatataaatactaggaagaaagtaaaagagaggagtgtgccgaggaggatgaggctgtttaaatcagggaaggcttcaaggaagaggcattgggactggcatctgaatgagaagctgcctatgggacaagcgtggaggcagaagaaacagaacatgcagaggtcctagggcaaaaacaaacctgacaagattgcaggatagaaaccaagtgagcaaggaggagagtcacagacggtgacagcggaaaggctgtaaggcttgggttaggcaggaccttgaaggctgggggagtctctttgggagacagaggggtggcgtgatctaaattgtgatgaagtcacttccctcagtcactcagccagtaaggggtggatggggtgaagcccatgtcagagtgatcccctgggccctccttcaggccacagtccctgctgccatctctagagcaggtcagccaaggggcaggccaagtgatgcatctgcaggactcacctgctgggaaataaatccattggcgctggcggccgtgtgggcgctgcagtgccttgcgggcagcatcctaatgccgggaggatgcagggggagggagacgacataaggccaccaggactggggtgaggccagtaagacacctgcctctggtgcacaatttaaggggatgctgaaaacttgattaagataaataactttttatgcaatttttttttaaattaatgcaaaaaaaccgtgatgaataaaatatcaaaattttaaatcaagacaggatacaaaagagcagggattagggtgaggaaggtgaaatgaattgtgcataagcaggatctaatcttggcccgaagacatttgcttaactgcagggacactgcctgggccaagcactgttcccactaggagccagtatcaagagccagtctgctcatggtgaaccaaaaataagaaactgttcctggtgggggccccagagaacactgcctgccttggctgtggagacagaagcccagagaaaggatcacacatcaaggaggtgatactgggcctgtaccctaaggtgctgtgtaggatcagacccaccccttgtatgctttgggagcctagtaaggtgcattgcctctccagcctcaatttccccatctgtgaatccagaactaataaaacttagtcaccaggattcagtagggtactggttaaagtcctctagcgcctggctactcaatgtgtggtccacggaccggcaacatcaacatcagctgggagtttattagaaatgcacgatctcagctgcatctcagaggcattgaatcagaacctgtgttttaacaagaccccccggtgattgacgcaccccggtgattgacacacacgtttaagtctgaaagcctggtcaactcttggcacataaaagatgctcattaaatgttagtgctactcccctgactacccaaccctgttagattctgacttcagacaagaggaaaaacccaagacgtaagaagagatcctgaggtggacacctcatgcattttaaaccagcaagttttgaagcgagggaccctggccaagctgtttctatacttaactgtatgagccctccattttgttcacatgtaaaatggggataataattataggtagcttctatggttgttgtaatattaggaaaacactcagcacaatgcttggcacatagtaagcattcggtaaactcttgctgctgtggccgctgctggtggtgggtcaatgaatttcaatagagcatagaccatgtgatgaaatgaaatcaataacattcatattaattattctttgccatttgtaaagcatttcagttgacgccatttcagccaaccctaataacccttttgagtaagcataagatatatccatttttcagagaaaaaaatctagactcagggatgaggtgacttgtccactaggatttaaatccctggagtctgacactaaaatctgtgtcagcaacagagaatccgagcaataagcatggaaaatataaaaaatgggatgagacagcattagactgcagagatccctttttgttttgcagaagggaaaacggacacctgtggaggggaagaaacgtgtccaagatcattcacacagagcgtcagctctggggtcagaacccagctcccaaggctttccgtgtccagaccacctccctcacctggttggccagcctccacctgatgagccgggcaggctgcaagtggcaagttccctgggtgggtctagtggtcagggggcatcccagccccacctttccttccagcacagtcagaggagctcacgttgccaaggggagggctgcgaggttgccaggacatggtctgcaagcagtcaggtggtaggggaagcctttgctggaactggcactaggagctgccacagcgattttctcgtggctgggagaggacctccaactccacagcatgggtcagctgatgagagggttgactgccacagacgcccatgtcaccgctacacacacacccaagccagcaggctgagtcccattctccctcagctccacacctcatcaagccctgagtcctgatagctactcctcctatctttgccaccccaagccactgccttagcacagttccctgtccacagcctgttaagagcaccccagattccccaccttcatgctccctttctcatccttgagcccctgaggtgcctggaaggatctagagcgcagagctgagccctgcaatggctccccatcaccctcaaggtgaagcccaagctcctctaaggccccttctaaactggctctgacaacccgccagtcttttttttttttggccctgaggctccagccaagccaccttcctcccagttccctcagtaaaccatgcatcccccgtgtctttgcagatgctgttccttctgcctggaaagcccttcctgcctcactatccacttggcctctgcaaatccttagctccagactcaccttttcagagaagccctccagcttctctaaggtgatgaagagagaggcaccttagagaaacctgtgttagagggggtgacacactgtagcttaaggatctgctttcctgctcgtgtccccattcggctgtgaactttttttgtttttgagacagagtttcactcttgttgcccaggctggagtgcaatggtgccatcttggctcaccgcaacctctgcctcctgggttcaagtgattctcctgtctcagcctcccgagtagctgggattacaggcatgcgtcaccacgcccggttaattttgtatttttttttttttttagtagagatggggtttctccatgttggtcaggttggtctcaaactccccacctcaggcgatccatcacctcagcctcccaaagtgctgggattacaggtgtgagccactgcgaccagcctcagctatgaagtttttatgtctcactcttagagtaagacaagagaccttggcagagtcattctcctacttagttactcacgggtttccactgtgcgagatcaaggcctctctgggcctccgtgccatcctctgtgtggtaggggttatgacattggccttgccaggctagcgggagtgttaaggattgtgactgtgggggtttggcacacagtaaatacactgaaggtggtggcattgctgttttgtttacaccaacaccaccagtgcccagcacagaggcacagaaaactcaccagcaagtgcgtgctcaacgggcccctcgcctgcacaggagaatgactagtgtgtgaaaaagctctgtaaggaatgacgctccattctaagtcataataattctagtagttcacgcttttgattctccctgcctcctagacccaagtcatcccaacatgtgttctgcccactcttcattcatggaacaaaagtttactaagcacatactatgtgccagatgacgcgctagctgtttgggactgagcagtaggtagacattaaacacagaattgtaccacctctccttctttccttcccttcttaaaggccagcctcctgtccctgcacacaggtggccccacctaaggacagggaagatgccatttgctcccaggtgctcattccctgggcagacagcaggctgcagcccacaggcgcctaccctttctccctccccagcaagctggaaacaggaacatctgccctgtttttaatccagttgctagttttaaattcaaatattgtcagctccctgagagcagggatcatgcctgcccttttcactgcagttgtcaccagcatttagaacacagcctggcagagtcattcacccacttactcattcattcattcattcattcactcaacatatacttatcaagtcctgctaaatgccaggctctggggaaaccactgggctcagccccaagaagctcctattccagcaaaggaagaggggagggaagtgggggtctgaggattgtgttaggaggtaaccatgcctggagtgggctgatccctgtgggaatccctgattcactctatactgtctccctgatctgggccaaccgttcatgcctctcatccttagtcctcacctctgcaagtgagacaatagtatctgcttcctggagccactgagagcagggctatggttactaaaagaagaggaaatagagagctgggggaggaggcgacaggttgtcctgggaggacattgcagccccttcagttgctggggccttggtgccccgcccagtgggggcctggctgcagcagagagcaagagctggagagagaagagttccagctccacacctacccctgtgtgatcttaagcagaccatctccccctctccgcatcagtattttcatctatcaaatgaggatggaacatcgacctcactcatcctaaatatgtgataccaaatctagcaaacttgtcacgatgctcagtcaacaattatttactggcacctacaatctgcccggccccgtgcagagctctggaaacaaagtcatgtaacggccaacctttgccttttacggaatgcatggtgccccctagaatcaagcagaggaaggtaattaaaatttaaggagctatagtgtaaaaaaaaaatcttcacagacgtggtcttatttaacaacagcaatcataacaagcacttatatagcactgagtatatgaggccagtagtattaggcatcccattttacagatgaggacactgaggctcagagaggacatccccaaagctggaattcaaaaccagatatgattgatgataaatcctgtccctttacaccaatcagaaatcacatttaagtaagaaaagtatggtcaattgtactaccaccaaagtacggtcaatggtacagtgctacccgcaccagtgaacaagatgagtaactactatcagattgggtgaggtgggccaggagttgggtctgatgccaggcagggtcccatcccgcccagccctttgctggaatcaagagcagcagtggtggcctccggagaagtgagggcatgccttcactggggtctggggctccatgcccattcagcaagccaattccccaagaagctctctccttagccctcaacctcctctctcctcctccaggaaggtgtggtccctgccatgctatctgctctgctcagcgactgaaggtgcccgcatcccagctctgccaggaagcaaaggtaagggcactgctcagcactaaagccctggatagtgttcagggcatcccctcatccctggagccctgatgaagggggcacgtcttcccctctgtgattgccaagaacagtcctaagatggagtgagatggatcagttgggcagtgtgatggaatggtgtttaccttgcatgttcagagccgtttacaacagagaagcactttcttgtgcaatgccttattcagtgctccccaaaaaacctgaggtggatattattatccccagttacagatgagaaaactgaagctcagagagtgaaaggacttgcctaaagacacacagctggtaggtagctaaggctgaattccaagctttttcatgtccgtatcccaatggcctgtgcacattgtaggtgcttggtacatgtttgatgaatgaatgaatgaactgatgaactgcccaagatgaatggaaaggcagggctgggctggcacttggctctcttgtcactgtcagatcctgtgctttttctgctgagccacggcttcctgcactgatgagctcaacatcccccatgccaccccctccccagcccaggatcccaaccatcttatgggtggaggagtcaacctcagctcctcttccaggtggccggccaagctcggatcacacccggcatccctcatccacatcgcctcttccccaccacccacgaccagtaatccagtgtgcatagttgtaaacttgtttctttaaataaacagtcttgagtttcataccaaatagtctcttaagagaaggaacgtctccaggccacctcgtatttagcatacagtgagccacatatttgcacagagagagtgtatgtggatatagagatcgctcgatcgctatagatatcgttgctcatccagatgggagctatttatgatgctgagtcattcgcagagaatgccactgaggaattccaggctgggctccgagccccagcatcacagacctcatggctctctgccttgtcttcactgttcacaaatgagaggtgggaggggggcctcccatcacagggcagggacagaagggaacattttggccacaggaaatgaagatttcctcataactagttcctactgtaagtcattctcctccatccagagccttgcacccttagggatcatcttgtccaattccttcattgtgtaggagagaaaactgagacccagagtggggagggactggcccagtgtcacacagagagtcggggacagagctggtgctaaagcccagaccttctggctgctgtctggggtttccacattcccagcaaccttcttcaggttttgtctccaatgtcttggcatttcctctcactgaggagcttctcatcttccaaaatttggagatgtcactgagcacttgcacctttgggctcttgcaggacaagagctgactccagcttgtttgggtactccagccccatgcttagtgcaagacctgcacacactggctgctcaatacgtgtgtactgagtgttatataagaccaaactcagtaccaattcctggggaacccatttggaaaagcacccatctatctccaccctctctttcttgtctctaagccagttccctatccatgcaaaaatagactccctcccactcaccacccacctctgcccaattctataatgaatcaattttattaataggctttgggatggaaacttgacaaaggctttttgtgaaagtctcgctttatctccctacatagttcacttctcaaagaattctaataaactggtcaggtggaatttggtcttacataaaatattcattaatccactctttccctccatatagaatgtattggtttaagcattcagtgatctctagcctgtgttatagattctattcaattgttctaagaggcagtgggatgagatggaaagagcacgggctttggaatgagggccaagttgaagtctagctggccccttactggtttttctttcacattgattactctgaggattaaatgagataatatatgtaaggtggatggcacatagtaagtgctcgatgcaggtttgtgaataaatgaatgaatgattatgaatgattggttcaggacccatataaaccagatcttaaagctggaggagccagctgactctgcattctgagttaacaaagtcatactacccaggaagggtggtttgaaaagtcttgagaagcaaacttcaggattaggctgttggttggcctgtctccaggccagaaaggaggatctttctccagcccctggtgcaaggggttccctcagctcaagaaaaaatttgagtctggaatctgggttcaaaacagaaaactccttgaaaatcaagactgtgtcattttattggtggattctgcctttctctcaactagagcctggctcagagtgatgtcgaataggcagagaggtccacagcacatattcatgttgtgaagatgaggtgcattgacttgagttgatctgagttgacttggcttgaattgacttgagttgttctgagtttactggtggactcaactcttgggcccaccgagagagaagcttcctgaaacttggacttagctaagacctggctggtctcatagcacaggggagacttcacaggtgatgttctggggacattacagagtgtcccgaagatagaggcctttcagagaggaccagggccatagtcagcactgaagagctggatagcagtcttggctcagtcagggggcaccacatggctaaatgtcccttaggaatctttaaaatctattggaactctgccaggaccttttcatatttttaaggcaatagaagcctttcttactggcatagagggatctttttggggtacccacttcagtgggaggatggcctccaggttggaaggtcaactagactcagcaatggggagagaagacagggtgaggctgggaaccaggcagagtttcatactacagatgctgggaccattgtaggtgggtcctcccatggaagcgagggtttggggatctgagtgagatgtgattctaactctagacttatgtcaggcagtgtttgctgaagggaaaatgacccagaaagtacactgggaaatcaggcaagacctatagcctcaccatgcggagggcagccagcacagctcaggccccttggccagccccatcccaggccctgcccaccacagaatgcagccagcacctgagggagacaggaatgagaacaccagtgagcttcaggtgagcaggggctgctcacacgcttactgcacttgaccagtgtctgtctctcacacgggtctgggaacccaccaaaggaaatatgttgcgttcctatcatcccctttgtaccccctaaaaatctgggtacagattttagacatcagtgtttgatgagtgaataatcaggtcagagtaagatttagaaagccagtggaagatttcaagatggcaaaatggaaaatttcaagatttcaaggtggccaaggtccaaggtagagacgcctagccagaaaaaataacatagacccagaagctgcccctcaggaatttggctcatggaaaaataatgcactaaatggagccaagggacagggtggtgcaatgtgagcttgaaataatgttcctcagcatcctgggcttctaagaaggttctcagggcccattatgggatgggtttggggaagagaaggcctcaaagaagaagccctagatcctccaaatccatttcaaccacaaaagcttcgcttttatctgttgtatatgttggatttcctcctaaatttttacttttaaagggttcttttgattttaaaaagtgcatttgggaaagtactggcattgaaagagcctatgcctttggaggtagactgggtccagatctcagctccatccctttccaccagtgggacttggggcaagtgtccctttgagcctccacattctcagccacgagccaccctcccagggctgtatgagcacagctaagcggctctggtacctcccagaggctggcacacgtgtgattgattgatgctgtacaagatgactttagctggtatacagatgaacatttattattttaatagctcgcaagtgatgcgtgttagaaatatatagccagcacactaaactgtgatttatgaaaataatatggcatttcctctgaaaataaaattgtgatctttttaaaaaggcaaatcaatttaaagagaaatactaagtaagtgatagggcagaaatcatgaaggtggcacaggaatgactgaaatttgggggaaattgagagaatctatgtaaacaccaatcacagtgtctgtcacttaagaagggctcaaaaagttagttcttatatccttctattttagctccctggggtggttgaacctagaaccatgctcaaaaaacaaaacaaaacaaaaacaaagcttcctgggacaaagtaggggcccaggcccagtcggtctggaacagtgtggggtgggcatgagacaggcagccatggatccagctctgatgggcagaagtggtcaagtgtggccagggagctggccacaggcacacagagcagtccgaggctgctgaggtagcatctcccacaaagtgggcacagaccatcggggatccatgagacaatttgaagagttattcaggcacaaattaaatagcactgggagagaatgactgcctttttggttgattacatcaaggagagagtctcaattgaaggttagcctctccttaaccagcttgatttcctttccaaggaagaggctcagacttcagccggcaacagtaactagctggaagtggataaacgatgttttattttccatttatttgtttttaaccatggccttctatttacagaacaggatactgcactcctgttcatgagaaggatcttatgttctctttccaaatatatgtattaaaggtcaaaaaatgaacctgttactcttgctaagtataaagtgagtaatagtaaatgcaagatgtacatgaggaaaacagagagaagtggtgtatgactgaggcaagagtcacctggcaaaggtgttgcaagggcttccatggctccagagcccatgctgggcccagaggcaggaatgtctccaggccccaccacagcctccggggcagtcctcaccctggggagggcaaaggaggccccatcctaagaaggagggagattgctgggcaggtgacccagagcctcctgcctgagccgggagtgcagagaccaggacagcagcctggccagcagtcagtgaggtcagggctaccaccagagggtggatctgaaacagaccctaggcctctggtttctggcaaggttgattacatccagaagggggtcttaattagaggctgtggtccagtggttgatcataacttggattatccagcgggggcaggaaggagctgagggacaggaagaggcagcccgtgtcagcctggtgttcaaggaatcaggtgtgaacctcaacagttcacagcagccttagagaggggctgggtgtgaattagggtacactgatagcaagcaacagagactaactctgtcagactcagacagaaaagggggttatcgaggttatcagatgggacccagaaccaaagggaaagctggacacagggctcaggaaaggaccagagccaaagctgcacaaggggtctggaagcaggacctgaggccggttttgtccaggtcccctctgggatgcatctcagccacagccgcttttttcctccttgcatcactcggctcatgagtcacagccccaggagggagacagctggcttggcgtgggtcccgtgtcctcctctcggccagcccaaagcatggcggcttgacaggactgcttccgagattgaacgtgagggaggggtggttcccacaaggaaaatcaaagggctgtcaccagaaggaggaggagtggattctgggcagctcaaaccagcaaatgtctaccagaaggatcccagggagtacgaggcactgtggtctcctaggtttcactctctgggaccatccctgaggcctcctttctcctaccctgaatggacaaacgtcaccatcccagtctgggagcagtggtctgctgtacctgagtaaggtggtgagctgctgcagtgagggtcctccgatgggctgggggccctaggggaagggtactgggcaagtctgatccttggccccagggctgaaaaggatctgctgggctgaggaagtctaatgagaaccgactcactcaggggctgcaaacccgctcgtcagcaggcttggcggagagcacatgcatggaggaactgtgacaggggacagacatgcttagctagcaggacagccgctgcccactccagggagtggagttaccactccaacagttaccacacaggcacggggccccagggttgatggttacacctgggctggtttgtttaaatgaaggcccaaatcaggagttctatgtgaaactcctccttttttagtattatcaattcacaggaaaacaattaaatgttgtgttgaccaaacaatatgtaccaccagtttgtgaccatgggaactaacttctactcatccactacaactaagatgagacatcacttcctccaggaagccttccatgacttgcccctccctctgccttgccaccaattctttggactcccacagaccctgtatttccttttgtcacagcattgaccctctgtgttacttggaggcacacaagttcgtttgtttttgtctgctgctttttgactgtaagctccttgaggagacccactgtctcttgttacatctatgcccagcatcatgcctgacacacatgaagggctgtggcattgatggaagggggctatagggactgcaggtctcaaggttatactgtggcaaccagttaatcctcaaatcctgttgtgacttaatacaacaaagatttgtttctccttaacatgatgtcttctgtggagccagcagctctccaggcagcatccttccaatcggtgactccgggatctaggccggctccgccactatgcagcagcggaagagagtgagtggagaactcacagtcactcttttttttttttgagacagagtctcactctgtcgccaggctggagtgcagtggtgcaatctcggctcactgcaacctccagcttctgggttcaagcgattctcctgcctcagcctcccaagtagttgggattacaggcccgcatcaccatgcccagctaatttttgtatttttagtagaggcggggtttcaccgtgttagccaggatggtcttgatctcctgaccttgtgatctgcccgcctcagcctcccaaagtgctaggattacaggcttgagccaccgcacccagccaacagtcactcttaatacctcagcccagaagtgacactgattgattcttctcacaggccgttggccaaaactagtcacatgacctatctcaccatcaggggcgggaaagaattcactgagttcacgttcttgcagcacaagccctgacctgccgctggcagtgctggggagccaggggtccaaaaggaggacttgggctatgcgtggggcagaggcagccaggaaccagaggtgctcgagacacagaaacttgccagcatcactgagaaccagaggtgcctcatggctggtacatgaaagcacctcttaatttgcatgtttaactcaacacatcctaaaaagtgggaaaagagtggggagagaatttcattaacctgagctttccacctttccttatttttccaatcagtaaacactagcaaatgaaaatcaagttgatggaaaaatagaggtcaaatgccaatgggcaaactgttcagaaagaaattgccacctggtcccttcaacatcttacgtggtgtccatggtgacccaagagcgactgcagctgttggaagggctcagacgccagtgcactcggggataccgaccctcactgctctgacagccttggccagaccatggccgacagcaagtcagtgggccccactccagggggctccaagacacttgccatgctttcttcaggctatatcacaacagcagatgtttctttgggatggaatcacaggatcttagatggctctagaaagagcagaagcttaggagccagaaagatctgggttcaaattccagttctttcctagtaagtcaacttcctacctagcaagacccttcaccgctctgagtttcagctttatcgcctgtctaatgggtacaaggataacacctacctccctgaacaactgcgcatagtctctgacatcacgtgtctaatgcgtaatgtcctaacgcacagtatgacctcaactgatgtcactgtttttccttttcccccactggggtcagagggactgagtccaacctcccctgactgcagccagccagttcctatttgcacacctctgatgacaagaagctcactactcttcctactgcccccctcgccctacaagccctgagcatcttgctccattttttaattactcccacgatgtttgtgaagagagggtctgatgtccctagggactagggattgaggggaaggtgcctggctcacttccccacctggctgactaatcacagtctttgccctcaggagttgtgcgggggaactgagtatagtgaggatgaaggaggtgaggggatcagggtggaggaatgtgtatccatttctggttcacaaaaggaaacagagaaacccatcacacatgggagacaggatcaggactggggacatgtgtcccatagaaaagaaatctcaggaagactgccacaggacaatgatggaggttcaacctagggttaagtgtggggagccacagaggggaaaacaggagcctcaaataagagcaaactttccttcattcattctgcaagcactccctgtttctccaccctgcctggccccaggctgagcataagcgcaagaaatgaatccgtggccttgaccttgggagagtgggcaggcatgtagatgataacatggaaaccatttgagtattgctgagataaaggaaagttcaatgggggctgtgggagctcagagtgggggtagctggcccactagggaggggaaggatgaggaggcaaacagaaagtcgggagaaaagggataccagctagaggggcaccatgggcaaaggcatagaggtgaaaatcagcctgtgtgtggaaaacccacccctttctctagtgcttgagcagggagtggtgacaggtgggctgatccagcagaaaagggccttgcagacagccacagagcagagaccctgtcccaggctaggaggaagccatggaagggcgagttgtttttcatttttgttttttcaggaaaaaaaaattactgaactataacctatgttcataaagttctcctaagtttacagctcagtgagttttcacaaagtgaacacgcccacgtaaccttccccagctcgagacacagaaacttgccatcacggaagctccctttgctcccctttccagtccccacctccctgcaaaaggagctgctgtcccaaccttttttttttttttttttttttttttttgagacagagtcttgctctgtcacctgggctggagtgtagtgatgcgatctcggttcactgcaacctctgtctcccgggttcaagcgattctcctgcctcagcctcccaagtagctgggactacaggcatgcgccactatgcccagctaattttgtatttttagtagagatggggtttcaccatgttggttggccaggatggtctcaatctcttgatctcatgatcggcccacctcagcctcccaaagtgctgggattacaggcgtgagccaccgcgcccggccccgacttctaatttcatagattcattggctgtttttgaacttcatataaatgaaatcacgccgtgttggacccctgctcagcgacgttggagagtctcttgagttgttgcatgtggttgtcattcattctcattgctggagtaaatctcatcgtgggactagaccaaaatgcagttctagtgttgatagccacttgggttgttttcagctttagactcttgggagaagcgctgccatgaagattcttgcacgtgtctttggaaaaacacatgtacacatttctagggggtttatgccaaggagtggagttgctgcatcacacgagatgcgggttcagctctagcagatactgtcaaatgtttcttccaaaatgatagtagcaatttacattccctactgtagctacttggtggaagtttcaggagctccaaaccctcaccaacatttggtattttccgtcttttccatttcagcgattctggtggatgtggagtggtgccgttggaatttttatttccccaaagacgagtaggttaaacaccttttcatatgcttcctagccatttggacatcctctttcccaaagtgtctattcaaggctctggacagggagggtcaagggccgcctttcattttagaaagttatctctggcagccaagtggagtgtctgggattggaagtgggtgtcctggaacctctggctgataccaggggcatctcttaggtaccaggtttcatcggcttcctctgccttcttcactcctcacagtcaccctttgacctcacaggtcaaaagtgttatcagtatttcacagatgaaatggccaggctcagagaggtgaagggcctgcccaaggtctcacagagggtgcggagaggacagctgggatgttctcagcctgaagcaggtagcccagggaggaatagaacagaagggaacaaaaggaaggtgaagaagcagctacaaggacatctatctcactccttattttgcagaaaaggaaattatccacctgtctccccagttctctccccttccttcccctctctctgcatcacaccaaaagtccctacagaggtcagcagccatctggaggtgagtgtccccagcctgagactgtgttggaggcccagtgatgtgcagggagccaatttggtcagctcctgtctctgccaccacccaccgtgtggccctggactggtcacgtcacctccctgagccttaggctctttacctgtttcaataatcccttcctctgggccttgtggggagaaatcactgagggaaactgatgcagtgcccagcagggcgcctggcgtcatgagcccttagtttacttggcacacactcattccttcccccgacacttctgtgactagcggggctccatgttctgcccaggccccctctccctgggtagcagggtcagcctcttcacgtctcatgcagccacaacaggccactggtgggttcctcactgcctgaaagcaggtgtggtgggccaggcatggcattccctcccgcatcaccttgtctccctgcagctgcccccactcaggctgacagccacacaatgagtcccagaagggcctttctcgtctcaaggactctcagctcagagcccagacgcctttattttaggagctgtggttagtaaagtgcttcatcaacgccacctccaagcagccccccgccccctaccacacacagcccgtgtgactgtctcacccgccctgtccttccactccttaatccgtgctgcatttcatgagcatctccaggcactgtgctaggcaccaagaggcccaccagctccctcccttcatggagtttcctctgcattgagagaaacagacaataaacaaatatatggacatggtaaacaggatgccttcggatggtgctcagggccgtggagatgatggagaaagctataacagagagggacaggcagtcggccgctcggtcccagagcagagtcaggaactcccaggcctgctgctggggatggtgcgtccttctctggtttgggctcttcctggagggagcagtgacactgcagacctcctgggggttgtcctgggatttggcaaaagatcctggctgctcctgacccctggcacttcctccatccaccagcttctcccctcccgccccataggatttcttcctcccaatcctactggatcctgagcaaactgagtcctttcctgatggtttccccatccccaggggcaagggcaactgaaccccacacagggccagcagagaccctcagctctacgcaagcaggacactctttctcccttctcgggcctccaccttctctccctccttcacccccttcctgactcagtctctctgtctctgtgcctcatctcgcttttcccctctccaacttcctgttactctccttctcctaaatttcttttccttcttttcctttttcttttttttcttgaaatggagtttcgctgtcgtcacccaggctggagtgcaatggcgcgatctcggctcattgcaacctctgcctcctgggttcaagtgattctcccgccttagcctcctgagtagctgggattacaggcacctgtcaccatgcccggctaatttttgtatttttagtagagacgggatttcaccatgctggccatgctagtcatgaattcctgacctccagtgatctgcccgccttggcctcccaaagtgctgggattacaggcgtgagccaccacgcccggccctaaatttacttcttattgggacactcatttccttcaaataaatatatgtatttttaaatgcactgagcccctaccgggtgcaggcataaggtgaggagcttgggtctaatcaaagatgagtaagacatggacttccctgcaagagagatgagtcatgtacctaaataagtgaaatggggaggctgaaagtggccagtgtgataaaggagacactgatgggggctgcagagtaggagggttcctgagggcttcaaggaagaggtgatgtttttagtcaccttgaaatacgatcatgcaatgaaacgtgggctgactctgggcctctcctgtggacagttgtttaaggaccagctcatttgcctggaacgtagggaatttgaatgtcatctttctttcactttatagttctctgattctgactcacttccttaccgatctcaccaccttctccttcattttctctttcatctgtactttttttcttccccacctgtcccttcacagaccataagacgtacttttgagttttgtcctcaatttcgttttccttccatccttttctctcaagtctaagtcccactctctagcatccttccttcctaacctccaaggtgccctggtagaccacgtggactttgatgtctaacagaccagggtctcagcccagtgactcaactctctaagccttcatttcatcatctggaaacagcctcctagggctattgtacaaaccaatgagacaaaggatgtggaaacgcttcctactgtaaatgagagtctttaccgttaacgaggctctttagacttaagtgacagaaacccaactcaagatggcctgaagggaaaagggaaagtctgatgttgctaggtcagacacacatggccccagggcttcagacagtgaccacaacactctatctttctacatctctccactgccatcccccatgttgggcaggccttcctttgcagagtgggaacacagccatctccttcctatcagctgagcaactccagtgaaaatcgggcacccattccagtggtgtcagcaaagctctgtgattgaacgtcagtggactcagccctaacccattcccatagccaggcctgggtcccacgctatcacacggacccgttaatgatgggatcctcccacccaacccataaggaccatgagtgggaaaggggaacatcttcccagagaggggccatttcacagttacaaaaagaaggggaaatggctgttacgaatcaagctccttgagcaacggagacaagaaacacagggaaaggaacaggctcacgccttcttagccctcaggtgtcatctcctcaaaaaaaagtcttctctaatcccttaaggatgtgttgggtgcttcacctgtgctctagcagcaccttatgcttcccctattatcatatttttcgtgtttattatactattctatttgcttgtctgtctccttcacaggactttaagtatcgtcaggacaaagtcagtgcctgtcttgcctgttgctgtacacccaatgttgacaaatgccagacccttagtaaatgatggatggagggatggatggatggatggatggatgagtggtgagatggatggaaaacagacagctggatgggtgaatgcatggatggtaggatagatgagggtaggtgaatgaatgagtgagtggtggagcgtatgaacgatggacgattggttggataatgagtggatgaagggatgaataaatagatagatggatggatgaatggttcagagataactggtgagatcagtttggaatgggcttagcctgaactgcctgtaaacacaaacagagctgcccctcaagttgttgatagatgaaccccaagttcgggagagaggtctgggctggaaacagaggtttaggagctattaatacagagactataatggagtggatcaaggttacaggggaggcagcaaagtggggggagccaaaatcagacagcacctaagtgacacttgaacccagggctgtgtgatgatgtcagagcttgctttccttccttcattttatggcagcttggccactacttgaggtgacagcacagagttaatgtatctccctctcccctccctccccctcctcaaaccactcagccagaagggagcagctgcctgggaggacagagagacagattatgtaaactgtgattgccacccacaggaggaggaggagactgaataggtattgaaatgcgctttcaataatgcatgtcctcctccgcacaggcctggggcttgctggggaggagaggatccttaaagggaccgatcctcctgtccccaacacccacaggccccctgccagccatacaggtcccctgtgcacaattggagggctctatggacatccactccaggggtccccaacctttcaccctcaaggacgcctttttttctttccctcttgacttcagtggatttgactttttaaagattctgtttcccaaacatgctgcatttaagtcatgattaattcattttccccattttttattaatcaaagacacttaactgccagtcagagctttgatcagcaagaggtaagccacgaggtgaggtgatgtcattccaacccaaagctaagaaatatagcaagcaatattgttaggcaggccggccttgctgccagaaagtgccctcccttcttctaaccccagagatagaagagccccaggctggggaccagggaccctgcccaagtctctctcatttcccaaaggaggaaaccaaggcccagaaaggcaaatggacttgcccaaggccacaggatcagtgagacctaaaggccaaggtctggcctctgcagtttcaaatgacctagaacttggcagtgaaacaggccaagcaggggacctgaaagtcaagaggagggcaggagaaagagaagccatgagagccagcaccttcattgtgctcctactacgcaccagacccactagaaagtgtctaccaccttgttctcacacaacaactcggaaggctgagattgacattcccgttgcacagaggaagaaattgagcatcaaagaggatccgtggttttacatcatccactcagctgggaagtgaaggatcaggattccagcaggtgtgtccaaccgaccgtgaaactttttccacctcactggcctggctgtgatggaggcgaggagatcattcagaccagattggcatttctgtttgccactcaccagtgtgtgaatttagctaatgatctcacccctctgagcccccattccctcctctgaggaactgggatagcatctgatggcttgagtgatggtggaggataagaaaacagggttaaagaaaatggggcacagaaactagggtacagagaagctttaacttggcgaactggaccgggtacagtggctcgcacctgtaatcccagcactttgggaggccaagacaggcagatcatgaggtcaggagatcaagaccatcctggccaacatggtaaaccctgtctctactaaaaatacaaaaattagctggggatggtggcatgcacctgtagtcccagctacttgggaggctgaggcagaattgcttgaacccaggaggcagaggttcagtgagccaagatcgcaccactgcactccagcctggcgacagagcgagactctgtctcaaaaacaaacaaaaagaaaaaaaaaaaggaaagaaaatggggcacaatacttagaaatggcatcctctcgctctattccctccttttctagtgaaaaacttccaagctggcagaagccagagtgtgagatctgattgcttctgtctctggggatctcctgggttgtagttcaggaaaactttaccctgttcttccactgctttcagttaaagggactgttttcctctggtccagtaattctaagacaagggttgagagtgggacgagagtctctgcctgtagcttgaatgctctcctggtcaccaccatctgcttccacatctggttttattgctgggcgggagatagcttgaccattcccatcacactcctggaaactccgttgatttccccaaggcagccaaagaagctggagtggaaatctcagctcccagcagctagagagggtgaccctgctggacttgccacagttgctcctcctggaccaggcggaggtggagtaattgactctctggtttcccctggaagtggttttaaatgaataagtgcaaaaaaaaaaaaaaaaaaaaaaaaaagcctggtaactggggtggggcactaagcaatttcttgggcaggaattcagcagatcggatgcttgtgccagtggtgtgggctgggctgagactcagggatgcacagggcttggtgcagacagggtgggagcactgactagcggcaccacgaggttagagggctgcgataaaggtgtgtgaagggcactgcaagaacccagggtgggcgccactgactgagtgggtaggatagtatgggtgaggtgagcttctcagaagacggacctttgagctgagcctggtaagaaatggggaatttcagatagtgtagacagatgcaaagatgggaccacatgagagcattctaaggaggagtccaggttgtttgaatacaaggggatggacaaaaggtagggcaggagcgcaaggctgggccagatgttcgaaggccttgaatgctattcccagtgcgaaaggactccacgctttggtcatggccacagcatgagcatacctggggtggggctagtgtttaagaaagatctctatgagaatcaaactggaagcagatgttcccaagcaaaagcgataggccagcaggaatcagacggaccctcaactgggctggagagatgtttgtggcgggtgaatgggttggatttggtggctgattggatgtgggaaggagacgaagaaaggaatctcccaggatggcacttgctttggggcccctactggcccctctaccctgctcagggtggggagagaggacccaccaatgcctaggccaacccaggttcccagggaagcttggacagggagggcttcccaacacccactccctcaaaactgaagagaaaacttactacttgtattcttgagctggtcaacacactcagttgcaagtgagcaaaatccaacttaaagtgacttcagcaaaagggggaatgtgtttggtgtgtgtaatgagaagctctagggatgctgctttcccctacagttggatcacgcagctcgaatgaggagagtaaacctcattctctctccctgtcttggctcagctttcctctgtgtccaggccagctctcgtcacagggtggtttctgctgctccagacttacatccccacagctcagcagctgcagcaacaggagactccaacagccccatcaaaagttccagaactgagtctcattggccccttttgggtcacatgcccttccctgcaccaatcactctagccagagggtggactacactgattggcctaaaccgtggtcatgtgccctctatgggagaacaggctggggcctcaccctcaactaaacctcactgaaggtgactgggggaggagcagcttccccagaggaaatggggataccctttctaaaataagggaaattgttgcttgattgcttttctacagcagctgagggcaatgcagagtggcccctcttctttccagcatctgacacccatattatggtttcatacccaggcctcttcaacatacctttaaagtccaagagatgatggccgggtgcagtccctcacgcctgtaatcccagcactgtgggaggccggggtggttggatcacctgaggtcaggagttcgagaccagcctagccaatatggcaaaaccctgtctctactaaaaatacaaaattagctgggtgtggtggtcagtgccgagcacctgtaatccagctactccggaggctgaggcaggagaatcgcttgaacacaggaggcagaggttgcagtgagctgagatcacgccactgcactccagcctgagtgacagtgagactccgtctcaataaataaataaataaataaagtccaagagatgaaccagcagggagatgcacttgaccttgtgcacatttacaaaaaaaccaactgcaactattcattcatagacccatctgcctcctgcgtgccctggccagccctgcctatcgagggtgatagaaagacccagactctgcccccaaggagtttacagtcagtggagtctattttaggtataactcctggataatttagtagagtcagacttactctccaaaaaatacacttcactgcatatgtttttctggtattcggatgcttttatttgcttttagattaactgcctcacatgaaaatcatgaattgaaaagacctttaaaaattcaccatttacttctgagtcaattttgtcttcactgataaaaaatacctaatatctattgcacatcctcactgaggcagcctctgggagtttcacgatttattctctggaaatccggatctgggtcctgagaaagtgtggtggtcccttcatggactaagagggtgagggtctggaaactgttctattggaacagcgagctacagaatgatggtctggacgaaagaagactcgggggcatgtgctctctattacccagcatctgtatgtggaagcaacgcacgttagagggtagagagtagaagtgattgggaatagattttttagctcaatatgaaagagaaatatttagagaccagagctattgcaaaacaaatagactgccgtataagctagtgagctcctcattcctggaagcgtgtaaacagggactcttaggtggaaagttagaccaaatgacctcagcctcttccaactagaagattcctcaactatgggctgaacagtgtttgagttttggctcaaacactatttttctctgtggccttgggtgaggcgctgtccctctctgagcctcagtgacctagatagcccccacagcgtcttcctcttctaaatactttgccttgctcatgtcagatattcacacctgcctctgcacactcaggcaatttctgccccgtgcatatttcgaggctccagagcctgagcaaaccagcccaccaaacccacaggtgtgaggcagcttctgtctgtgccttctgttcctagagaggctgtgattcatggccatgggggatgcctcccccatctgacaggtggagaagtgaggtctgggggaggaaactaaccactggagccagacgcactccccgcaaacacacctgactgggcctctcccacctcaccatctccctgtccccattattggccctcaatccacaaaggaccctgggaataggcctctccccaccacgtcaggtgaagggcagccactgaagcggatgcagaccccaacatcttggacctgagaagtgcatttcccacagatctctccataggcagccttaaggctttttgcgtttgatttttacaacagccctgcaagggaggcattaccgtccccaacttctggggaggaaactgcggctcagcgaggccagcaattgtctgaaaccagctggtaaataagctgcagagagggcactggaccaggcccacctgctcagccatgctccctccctggggtcgcgcagaagctcacctcgggaagaaggccccgctcccccaggaagggcccccttgccaggacagtcatccagagccacacctgaccccagttcctgctgtcactctttgctaaaagatggaggggactaggtgggcctcgagctccaccttccctcgaacttctgctgggtcttttggagaagccacttgccctctctgagcctctgcttcctacctaaggattccatcaatctaagtctctgcacccctatatctccatctgagtggggaataaaacttccggccacacagagtcacaaagcatcctctaccccttgtctgccctgatatgaccctgtaatgtggagagcagaagacccactgcacaaatgaagaaactgagagactttaacttgtgcccaagatcacacagttaggaagacacaaagccagagatgcggtcctgacccttactactcaggcagtgcctgcccaggactctcacgcagacctagctggggccacagaattcacaaggatgcggggtaagctgatgacacacttgtcagtgggccccaccagccaccaggtcctccctccctcccagggcctcactgaagccaatttctgcaccatcagagccgctgaaccttctgctgttggtggaagccagtcacaggtcactgcctagcggtctctctcatccaccagcgtggctgcggccctccgtgctctctggggttctgaaaacagaactgtgtggtgccaggtgatccagaagagaagcagtgagagctggaagggcacatgaagggcagtgtgggcagagggacaggcagggagggcactgccgccacagagctgccctggttccctgcccccgggggagcacagcccagcaagagggaaatgatggcatcttttgtggctgaattttcacaactcatgagagaggaagagatgattagccccatttttcagctgaaatcattgatgctcagacatgaagcaacttgcccagggttacacagccagggagcagcagagcccaggtatgaaccatcatgcctgtctccttccccgcccccggaggtgcgtgatgcccccacagaggagagtgaagcgaggcagccctcctttaggagggggagttttaggggtgaagcaccccacccccagctgtccagccacccttagcctcttcctctttgccacaggccatgcggcactaacaaggactctggtggtctcttcgagggaccctcatacatagctctgcaggcaggcaagggatgagcacaatccagtctctggagtcctcactccccagagctttcctggaaacagcaggaagctatttttaaagcagcatccgcaggcagtaacctgggagatgagtctccctccagatcctcacccctgtgggctgggggcagcgttcaccctgctcacagctcagccaagaagcccagatctgggaaggagagcagggaacatgtcacctgccaagggaagcaggtgggtctgctccaaacaagcctcgattttaccaactggaaggggccttagagcccaagggaaacgtgcgtgtgttcgtgctcacacagttgtgtcagtgcgattgtgagcatggctgggggtgcgcgtgtgtgctcatggcagctgagtgtctccatatcctatgcaggcgtgacatttaggcataagtgcgtctctgtgtctgtgaaagccagtgtgctgatgtcagcttgcctctgtgtgtgtgtgtgtgtctcggtacatctgaatctatttgttcctgtgtgcatgtgtgtgggtgtaagtatgcatcagtgtttacgtgtgtctgtcagtctcccagaaaccctggaaatacatgggcagaatgttagaagtaggaagagcattcgctctctccagctccctcccttctctccccactgctcaagtcacagaaggggaaatcgtagctcagagaggggaagggacttgctcaaggccagtcagccgcagagagaactggaacccagatttgcttcctggctcccagggcccgtctactcagtcaccccattcaggctccattcccaaggccaaaagctgctccctcctgccctgacgcaggtgagaaccaacagggcccatcttctccctgggctttgacttggctgctgagaggggaaaagtgtctgatgcaagtgtctctgttatgggctctgagcagaacattgactatgattcaacaaaccatagtctgctattggggcagagcatgtacaaagcctaccagctgcccagccctggtcccgcagatatcccaagagaggccaggcatggcccctgccctcaagatacccacagctcagcaggaggtcagataggtcaaccaagaactatgacatgggattaaacatgcctaacggaggcatgcagagaattccaaagcagcacagaggcagaggcaactgattctgccgagaggatcaaacaaagctagtgaggagatgggcgacatttgagttggggtttaagagagaaataggtatgtcagacattgaaagagaaagggccttctaagctgggggcacgagttatgccaaggcaacttatccacttctgacactgttctaaagaggtccagctcttccctggtctaccctaggactctgctggctctgccctccatgtctcttgtctgtgctcctattatttccaccatctgggatttattcattcctttagcaaatatgtcctagccaccaaaaaggttcctggccctgaaagtggtacaggagataaagctgtaattttgagcatagtctccatgtctgacggcaggagatgggggtagttaatcatcaaccagtcacagctcctcatttcctatgtgcctggccctgtgctcagtgccatgaggaatggagaagaccatgaaagctcattgagcaccatgcttgcaacaacacagagagttaagtcttgaaggccccatttctggaaaagaaagttgaagctcagagagatgacctgacttacctgaggttgcacacagtgctgagagccaaaccagctccgtgtgatgagtgtgggttctttctgccaggctgggctgcctgccttcacaaccagaaacatgggcgttggaaactgctgcttctgctgttcttttgcctataattgtctccttaacgggcctgtgacgctttcagttatgttcttttgtaaatgccagacaagcttggggacccaaggcagtagggagattgtctgccaaagaaagtagaatcaaacctccccttccaaggaatcttccaaacccagcaggtttgaggttaaaattggagagggcaggaatctcaggggtcaagactgggcccctatgtgccttccaagaaagcacctcttcctgaatctgatgctcagaccaaaagaagggaacatgcatggagaggacccaggcaggccccacacatgaagcccttagcactctgcttgcctctttaatgtgagctaagaaaaaaggattaggctgggcgtggtggctcatgcctgtgatcccagcacttcgggaggccgaggtgggcagatctacctgaggtcagaagttcaagaccaagctggccaacatggtaaaaccccgtctctactacaaatacaaaaattagctaggcatagtggcaggcacctataatcccagctactcgggaggctgaggcaggagaatcacttgaacccagcaggcggatgttgcaatgagctgagatcgcgccaccgtgctccagcctagatgacaaaagtgaaactccatctcaaaaaaaaaagagaaaagaaaagaaaggaaaagaaaaaaggattaatctgcattgcatggcctccacaaagctttgggattttttgaaatctcttttgttacggaggcttcataatctaccttgtgattaggaattgccaccctgattttgcagatgagaagggctggctgcttgggatacagagatgaagagagtacagtccctgaccccagagaactcgtggtgaagaaacacaaacgcacagaaggcctctagggtgctcaagtctgtaatacaaagaagcatggggggctgtacaagggacacaggggactcgtttccaagttggaaagtcaagaaaagctttctgaaggagcagacatctaagctgagaccagaggaagaaagttagccaggcaaatggaaatgggggggcctggtatgcaataggtcaaaggctccagcccaaagcctagatcccactccaggactctttgagaaacactgtttgacacatccactgggcaggtatggtttggaagaatttagcagttaggatctggggtggggatgggaggctggagagggattccacagccaaaatcagtcagtccccagacggaggggactctctccgccccttcctgccatagccaggccccttctttgaaaactttgcccagaccgcaggctcggctgctacctaccttctgttgcctgcctctggttttcctccctcacatcccctttcctggtgagctggggacccatctaacctggaggcccaggttcctgcagggcacttagtttccatgcatggctccagcccccatgggctcagcgttcctccctgaaacatcctctctggctgctgttttagcgcaagattttgcttcagggtaaatcctacgtttcccaaaccaacggcatcttggcgtgtaactgagatgcacagggaatccctggatttgaagtcaggaaggcctgcctctggatgccagctctgccactgatgtagcttggcaagttcctacgtgtctctggaccttgatgtccacaaatgtaaaatggggtaatgacaccaactgcacagaattactgtgaagattcaaatgaaaccctgcatgcgaaaactgctcagaaacggtccagagatgtgtagatacaggcaggtactactgctgtgaccctggtcacagaaatgtccattcactcagcaagtgtttatccagggcccgggtgccaggctctgcactcagagctggaatctaacaatggactaagtagacgcagagtctgccctcaaggacctcacagtctgggaaagagacagacatggacaacttcaacgtaacgcaattcatgcttgggtgggaggaagcacagtgggcggggtagcagggggagtcaccttaaacctaggccagcctgggaaatgcagaaaagttttgtggagctgggtgtggtggctcaagcctgtaatcccagcactttggcaggccgaagtggacagatcacgaggtcaggagacatcaagaccatcctggctaacacaggtgaaacctggtctctactaaaaatacaaaaaattagccaggcatcatggcgggagtctgtagtcccagctactcaggaggctgaggcaggagaatcgcttgaacctgggagacggaggttgcagtgagctgagatcgcaccactgcactccagcctgggcgacagagcgagatcctgtctcaaaaacaaacaaacaaacaaaaaacaaacaaacgaaagttttgtggaagcaaaatcccagtggagcaagccaggacagggtcggggaagagtgctccagagagggacaacaggaggggcaaaggccagggggcaggaccacagggttgatggggacatggcaaagagagggagctgaggctgtgaaggcaagcaggatacatcaattttaagatatgtttgaagttcatggtattttgttaatttatcttaaacagattgcaaacaatgtgttgattttttttgaaaaagtaaaaactgccacaccatcacatacgtttagatcatattacagttaccggagcctggagcagctaaaacaagaaaaaggttggaaaacacaacattgggaaatagttcaatcaatgcataagacaggaatagtcagcaaaacagctccctttttaaaaaagtaatttatagcatcaaaaatctgaatcatgcctcactggtaaattctaccaaatatttaaggaagaaataataccaattctacacaaaatatttctagaaaataggagggaaccttcccaaatcattttaagaggccaggtaaattagcttgatacagaaaccagacaaaggtattacaagaaaaccacaggccaatatccctcatgaacacggatgcaaaaatcctcacaaaatattagcaaatggaatccaaccatctgcaccttatttccagatgctcacagctgagctcttcccagtgctgaaatcgaagtttttgttgaaatcaaattatttatttaagtgagttagtaagagaagtcttggttgtaagtggtttttatttatttatttatttacttttttttttttttttttttttttttgagacaggatctcgctctgtcgcccaggctggagtgcagtggtgtgatcttggttcactgcagcctccacatcccgggttcaagtgattctcctgcctcagcctcctgagtaactgggactacaggtgtgcaccatcacgcctagctaagtttcatatttgtagtagagatggggtttccccatgttggccgggctggtctcaaactcctgacctcaagtgatccatctgcctcagcctcacaacatgctgggattacaggcatgagtcaccgcgcccagccgcaaatggcttttaaaatctcaactgactaggccaggagcggtggctcacgcctgtaattccagcactttgggaggccaaggcgggcagatcacgaggtcaggagatcgaaaccatcctggctaacacggtgaaaccccgtctctactaaaaatacaaaaaattagctgggcgtggtggcgggcacctgtggtcccagctacttgggaggccgaggcaggagaatggcatgaacccgggaggcggagcttgcagtgagccgagatcgtgccactgcactccagcctgggcgacagagcgagactccgtctcaaaataaataaataaaataaaataaaataaaataaaatctcaactgacttaagtaaaaagaataaggtgaagcactggttcgtgctcctggtcactcaggtgactggaacgaggctcttactcaagtccacagggagccagctgcctgcacccctcagctctactctcctggggttgtcccattgtctcaggcaggttctccagcggggtggcgagaggttgctattctcaccaggtgtttgtccaaccagctgcaagtcatctggaaagaggggccctctttctggggaagcccagaattgaggttcagccagggtgggttacacaagggttttgcataagcattccgtcttcaactaccccgtcctctgtccaaaagatagaggccttggcacagaaaacaggataaaaacagtagtaatcattctcaatccatgcctccctttacagtctatgaagctccagcagccatcgtcccagctgatccttgccctgcaaggcaggcagagcaagtgccaatgtcacacccactttacagataaagaacatgaggcccagagtgcaggcagtggcacaagtggtgcagccgaagctgtgttcagttcagagctgcaagatgccacatcccagggcagtttcagttctcaagaaaacctctctagaagaaactagaccctaacttgggtatcccaaaggagtcagggggaaaggaagcacggggccaaggcttggtcaccactggtctcattcactcccttctccacacctgcaaggtggtctcactgacctgaggctctgagaggagctgtgacctggtcaaggtcacagggctaggaaaggaaattcagaccccaagctgtgctttcccctgaccttcacttagctctgaagaaaggcctcggggcaaccccacggggcgtctctgcacggctccccgcagcaggcagcaggggctaattggaaactggagccttgaaaccttcccgccctcccctcttcacctggagccaaggccatctgttcccttttgtcttcaggctgcaggggaagatgaaactaaatttaaatactaataatacttaacatttgtctggaaagtgttttgcacactaattgctgattaatcctccccaggccccagagagatctccctgtctttgtgtccccattctgcagacagactggtggctttcagacagaaaggagctggaccagaaggctggaagatggattcggggcgtactgtgcaagacctttgccagagcctgagcaatttccatctctactcagctggatgggcgtggtgaataaattcattcagttcattgttgctccacagctaacaataaagctgggagctgggtccaaatggtgacttggctgtctaccagctgcttggccatgggcaacccccaccccctctgagccttggtttccgtatctgtaaaatgtacatgatgctccctgttggttgggtcagcctccccagtgttaccaagccacggggccggacactgggatgctacattgaaccaaacagagaaggtcccagcttccatgcaacttgcagtctagtcagagagggagataatagttaaaaataagcaaataagcaaggtaattacagctcgtgatggtaaggctgttagaaaacaattttgtaaatgtattttttaaactgtgatatacctcaaagattcttctgggtggtagagtcctatttttgttgcaacatttatctagaaatcagagatgtgttccccaagaaatggttgcaaaagacggaaacatagaccgggaaattttgccaacgtaagggagcgtcctaatgggtcctggggcagacagggcgccgtcagctgcccacccttacattcctgcatggagggcagctgtagctagcatttctcacccctcctgtctttttttttttttttttttgagatggagtcttgctctgttgcccaggctggagtgcagtggcacgatctcggctcactgcaagctccacctcctgggttcacgccattctcctgcctcagcctcccgtgtagcagggactacaggcgcccaccaccaagcccggctaatttttttgtatttttagtagagatggggtttcaccgtgttagccaggatggtctcgatctcctgacctcgtgatccaaccgcctcggcctcccaaaagtgcgcgtgagccaccgcgcccggccccccttctgtctttcatctttatacttccccaggggtttctgggctgccccctcacccaagcctcagagccaggtctttcttatggagttggaggctgtgaccacatggttttccagcttttctagttctttgaagtcctaagattctacatcaggtctcataggccaccgcagggaatgaggggacccaggcaggggtctccaggccccccaccactcacgcagccagtgcatcttcactctaactttcttacccatttggcttccaaatcaaatgcaactaaaaatagaatcccatttctataaaatgcttgaaaaatagctttcttcagggagatgacttggagttgggacaccaagatttaaatcctggctctgtctcctaagagcaagtaacccagagcaggccggcactgtgaaatgaggttgctgtctgaccagagaacacaaggaaggtcgtcctggcaacaaacccagtgtaatgcttggggcactccataagcattttttaaaaatgtttttagagacaagagtcacacgatgttgcccaggctggctttgaactcctggactcaagcattcttcccaccttagctcttgagtagctgggattataggcacgagccaccacattcagctttaagcatgtttttctttttaatttttcctcaaaaaagaatgatacaacttttattttccatgaatttttgtttttttgttttgtttgtttgtttgtttgtttttttgagaaggagtctcgctctgtcacccaggctagagtacagtggcgtgatctcggctcactgcaacctccgtctcccaggttcaagcgattctcctgcctcagcctcccaagtagctgggattacgggcatgcaccaccatgcccggctaatgtttgtattttaatagagatggggtttcaccatgttggccaggctggtctcgaactcctgacctcaggtgatccgcccacctcagcctctcaaaagtgctaggattacaggcgtgagccacctcatccggcctcaaccttaaacaattttaaggtgatatgtttggtaatgtatctgtgatctttaaaaggtgtagagttttgggaatgtacaacatacaaggtaaaaccaagattacattaaacattattttatcctctgcactaattttgcagtgaggcacaaatggcaagtacactattaaatgacatttactgtcaaaattaggaacttcattggaattactctgaaaaacttaagccactgtaacttgacacaatgacacatttttccattttaggacatccaattatatataaatctctggactattacattcaaactcatttgtactgccaaatgtggcattttaaagaagtttctagaaaacaattgcaatcactgttgtttggggggaaggttatcaccctgtacataagagattaaattaaaataaaatgtaaacatatagtatattatagtgacaggtcgttcttaccactcagaaaggccaaatttatccatttctttttcgaacaaaggtgatttttttttctacagaacatatcctttgacataaaacaattacaatacatgcccattcttttttaaaggaaagtcttcagagatcttcaaagcataaaacatatgtttttttttcaaagactgacagaaatgcttaataatcactaaaatgccaacctcagcaactaaaaattagtgattcactatactgaaattaaaatagctttaacaagctagttataggtgttttacagataacagatgtgataaaacaagagttggagaagttttaatttgcgtcttttcttcaggtatttaacaagatagaatagagctgggttgcaatatcttaactccaccaccaggtggaccttgcctgagaaggccaaaagaaggcaaaacaaagtcacaacttagattttcaagcctatggcttctaaaagtcggtgtatcccattcattttaaaacagtagatgcctccttctttcacttaagaactcaatgtcaagtcttcctttcatggaggacgaaaaatcagcaccatccctctcagggcaaaatagagaaagcccactcaagcactgttttcctaatgcaaaggcatgaagttctttgcaggattgacagggtctcacctcttctgtattaggctggtgccagggaaaagggcaggcatggagaggaagcaagaagactgtcttgcaaaaatgtcaaggaaacatcccctgtttgcacacatgtgggaaagcgagtgggccagcacatggtgtgacaagacttttttttatagcatgctcagctcaaagagcttcctctgtgctgggcacacaggtgtcctctgcaagccacacagcagcctgactatcctcatctcacagaggaaaccagggcccaggaaagtgggtaattcaccagcctcccacaccacagttggggaaactgagatttgaactgagaactctctaactatgaagggctgtgccaggaatgttttaaggtagaaacaaggaaagcattgaccttcatgcttcaatccaagacacagagaccttgaggtgagtctaagacagtgattgctggaggctccagttcccatacataccctctggtgagcttctcagcatacatctcagcccactccagttccccacaccaccacatacatccccccaaaacctgcaaacccaacacggagacagacactcagatgcatagtcagaactcatgcccacacagaagggcagtttgtgcaagctcccagcaggtgcacacacaggcttacgtgggcaccagcacacaacaaagcacaaaggtgcacctgggagagtcacgcttgtgaagaggacattacacacaggagaagtgcacatcagaaacagcctgaagctagaatagaggcaaccagagcagggaacgtggggtacacctgccccactcctcaactaccctaaaacatgcactcctgctgctagcaagaaccctatgtctgagacctagattccagggaccccccaagtctcttccacactgcaggctcagaggatcaaggtcccttaccagcagggacacatgagtgcctctcacacagaggcatcctctcaagtggctctcagatgtgtaggagggccatgtctcccttctttgccttagatcagattggcacagtggttagaagcagagactgaatgggaatcccagctctcctcctgcctgggtgggagtgaccttggacaagtcttcttttctataagcctcaaatttctcggcaaaatgagggtatgatactcaccttgtaaggttttagtaagaaatgagataaagtgtaaacatccaataagaactgaatagatgttgattaccttttcttggaccccactctcctagcactcgctgctcaatgcagcagacagacagacaccattcaatcagccacaagcattcctcccataggccctcccttccaggggctaagaattgcagcgaagacagagatctaagcagataatgactgtccagcatggagggccatgaaggaggacacactgctggtatggtgggagcccagaggaggagacagcaaagcagtggcacagcaggctgcccagagctgtgggtgccagcaggatgggggccataaggccacatttcaaccgaaaacagcaggtggtaatcatttcctcaatgactcccactattgacacttactgagcacctactgtgtactagacattttacatgtccctgtgagtgaaccagtgctctaatcatacagcaaagatgctattattatctcctcctaaagaaaaggaaaccaggggagtaggcatgacctgctcaaggttacagagatcagggtgaagcctgactgcaaaccccacactcttccctgatgatcccagctctcagctcctttagcaaacggccccgcttcctgattgtgccttcctcctcgagttcactgggaagacacatggtaccgtggtgacccacatcaccatctctgcagagtccagcaccccgtggaaggacggccatggggcctgcactccagggttcccctaatcctcctcccctggccccagccaggccctctacctctgaggcccttctcacccacctgcacttgcaggacagctgctcggtggccccagcacaggcctgcgcctctgggtattaggcagcctctcctgagccctggcatctgccaaccctgcccttcttagactctttggctaaacacccaactcgtgacaaccatttcacagagggagaaactgaggaaagaaagaccaggggccctagaggtgagggccggcacccatgctctgaagagaacatcccaccaagtttcccctctaggccctggcgcaactgtgagtctagagacccctctccctacctcatccttgggaatcagcagccatagctttaaacagctcatccccccaggctgagctaggattacagcaggcttgccagtgaaggaggttaccagcgagatgagtcagccagccagtcagggtcagcgggtaggggagggccagtcggtcaggcagacagcagcagccacccagggtccagagccagtctctgaggcagccagacggggtcagctagtcagacaacaggctggcctggctcacagcctcctccagcccctctctcgagctctgccttccccacaagcctttgatggggcctcaaagcagtagccagaaagccccaagctgtaaacactggctcccaaggcacacacactgtggtctcacgcatgcacacacctgcatgtgcttactgtgtgaatgtccccccaacacacacacacagcgctgtgcatgcctaggcacgcatacaccaggcacacatgtgtgcatgcttactatgtcatgttgcacacaacacatgctcacagtcacgcacacacatactcaccaaggcacactcgtggcctccttcctgctcacatctttgtaaatgaacgcaggatctcccctgctgatggggcccctgaacaagggaaatccaatccctaccatcacctaaagggctgagaaagccttgggtcggggaggccactcctcaccagcaaagggtgagtgagggagcaggcagggcctggggtcaggcccagggtctcgctccatgtgagccaggctgtgagccaagtgggtgccttcaaaattaggtgctggctcctctcacctgggttcctccaactgaggggaaagcctcaggagagaaggtcgttgttacctgctatagccccgggccaggtggctgggcaagccagctgtagggagggttcccaggagcacagagctctgggcaggtcccagccccacctctgagacctcctttcaccccctacacagtgttctctgattcactgcctcctcatttggggccttgcccatgtggggcagatttgagggcagaagacctgtgtgcctacccagaaatgacccttgagcccaccccagcatcacctcacctataggacaaggttagtgatcttcattaaaaggggtggggtttctgtgcaatgctatctagggaccatcttgaggatggaaggcactgcccaggtgggaatcaccaatgcccagccagaggccaaggaacacgccaagaggaacagccagaggctgcctggcagttttgaatgttagcagcgggatggagacaggggctcattcccagaaatggaggcacccagaaaggcaagaagtttctgtttcttcatcaggaaaatcagtgcctaccacacagaattggtcacgcattcattcaacaaacctttactgagctgctactgtgtaccaggcactgcggttagaggggccaatagggacagacaagagcctgctctcttgaggcttctgtctggtgggagaagacagacagtcaacaaggggacagatggaaaaaataaaacagagattgtcagctgtgacaaggagggtggcttgttgtataagcaaagtcagagagggtctctcttgggaggcagcctgaatttgtctggccacctgaaaaagaaaccaccagccatatgaagaacagagagaacagccatggggccgagggagcagcaagtgcgaagggccggaggctggcggagcttgctgcaactccacgaacagagggatcctgtgaagtggaaataacgtgaatgagttttaaaaagcagggcgtggatttaaaaagtgcctttgcagggggaggaagggaccagatgatgtaggacattgtgaggacgaccaaacagcacgtttgtaaactccaagggctgggaagatgagtctttgtcgagggctggattgtatttctggaaagcacatttcaatgcaggagcctctagggtggatggaagacaccagaatagctacagaacagaggctctgtgagcttttggctgcccctctgcccagaacattccctaacaaggaccagttcttagaaggggaagccccaggcaggcccagatggtgacccaagagagccttccgtgcccatggaagcacttgcctgcagcttctgtggccaacagatcactctcctgtatgttttctcattttctcttcacaaccactctgtgtgggagtcaacagcagacaccttttccaaaccagaaagctccttaaaagggaatcacacatgtccctcctgtacttacaaccctacaaggatccactattcttggactaaaacccacagcccactctgggacccgcaaggccccacatcacctggctcctgcggcctctccggcctcatttcctcaactctgcccctgctcccacactgcagccacatggcctttggtctattgctccaaagcaccaccaggctctttcctgccacaggccctttgcacctgcttttgctctccttggcagattatcccatcaggcaaaggtcactccccctcatgagggccactccccctagagtaactgcccccatctgcgtcactgtgtgttattttcttcatattttcttcagagcattgcctgaaattatcttgtctttgcatgcttaggtagtatctttgctcctactggactgtgagtctcttaagggcggggactcattggtgctggttccacgggcctggcacactgcctggcacagagaaagagcccgagggatatttgtgggataaatggatgagtgatgtgcccaaggtcacgtggctgtcagataacagaggcagaacttacacccaggcctttgggctgctaagggcaaagttttctcctagaatcccaggactttgagggaaacccaggatgggtgggcctgggtcccaggaaaggggagtcatttgtgttcctcctggcttccacccctctggcttcatccccagcaatctgaaagatgcagatggcctgtcccctcacctcctgaaatcaatcagggcgagaccttagtgagggcactaaggtctgaccctcctgcccacaccgcacctgtggccttttccttccttcattttgaggcttggctggcaggtctccacttctggccatgcacacacacaaacacacacacccgcacccccctgcctggccaagtcctccccaagggtgggggtgaggcccagcactagccattctgcaccccctgattcctggtctgtgactccacaggacaggcatggcagatcagttctccctgccctgtaggttcccagggctcaagggcacctgtggtcagccccgcagtaggatgaagagtcaagagggctgcgtggagagtcagaggacctagactctagctctctccacctccctctgcctgtatgaccttgggcaggtcacttccatcccctgaggctcaatttcctcatctgtaaaatgaaaacagggtggatttaatggtctctgaggaatcttctaggttgaaagataaagattttttgggatgctggacatttattgaacaccaactgcataccatccccagatactgggcatttattgaacactactgtataccacagcaaatccatgactacacccagactcagagggacaaagaggcttgctcaagttgtccgagctagcaggtggcagaactgggatttgaccctggcctgcctgatttctcttccccaactgttctaggagcctttgctgcctcagccccccaactcaatgccactcccccatgcctgtaagctggacttctgtcttctctgtctgaaaagtttgcttttgcactgaatccctcccgggctgctggagtgtgatttgctgcctgacagctggaagtcaaagcagcaaggctaactccatcctgcaggcctagccaagctcaggggccctgaaagtttccaggggcagttagaccaagctgggcaaccttgggcacgttgatcaagctctctgaacctcggcctcctcatatgtagtgcagggaggctacttctcctatttaggaggcgttgagatgaatcaacaaggtggtggcaccaaggaagcaaaagggagacccccgcctggagtctgggtgtgtaaataaagaggcgtggggccaaggagggctttaggggcctcgtcccaggcgacgtgaggccaccgcaggaagtttctgagcaggggagtgctgtgaggcgaggagtattttaagaagattcttctggcagcacaggccaggttgagttggaggagccgcgtgggggagtgcgagcggcgcccatgcctggaaaactttgcaaatgaggccccctcttggagcccttcaggatccaaggcaatctgagaagcaggggctgggtccgaggtctcacccccgacacaggttgcatctacaacctcagggccatcagcatccccagagcaactcagacaggctcctagtccatcacgacgtgccttcgctcacagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcccagggcaggattagagagaacgggaggtcctgcttagctgcagactcaacaactcctgcagggggcatgagaaggcggctgcagaacctgcccagaccacacacaggctccactacatggtgccagtcacaacagagttaaccctggcttccccgattctgctagtcaggcagccaccatggcagaggcaccaagagacactgcctgggacccccagcccctctcctccaatccacatgtctgtcagtccccccgtgaggttcaagctttctcagctgccggcgagttttatggcctctgatgctgacagtgctgttccaagtctctcacctaacagcttcatcacagggctaatggtcactgctattcattcaacaaacaatctgtgatgcttgctttgtgccaggccctggggccaaagagatgtttagacacagccctgcctcaacagccccaggctggcagcaaagagacactgcaggagatgggagatagtctgtccagccaggaaactcctagaagtctccccagagcccatcatacctataaggagatctgaggggggcggggggcagggaagccagacacagccattggtaggggagaggaaggagtgtccccagcatgtacaaaggctgaggcatgatgaaaggccccaaaaaggagggacagactgctgcagaggggcccatctacccaagggggtcaggaagcatccctggaccaagcgatgctgagctgagttttgtgtaggagtacaagtcaaccaggggacaggaggaggacaaggcattccaagaaagggagaagcaagtgcaacacaggcaagggagaacagggtgtcttctggcaattgcaaggtgctgttcagtgtgactgaaggagagggcacgagggaggcatgggcagagtaagactcagaggactcaggggctatttcaggtgctgggacagagccacaggaagggtgggtgagagtcctactcctagagaaaagtcattctagttgaggagatgcaataaacacatttaaatgaataaagataattccagacagtggcaagtactacaaaaaccattaaatagagtagtgcaataggaagtgaggtcctgttttaaatatagcaatcagaggggttgctttggggaagggacattcaagccagaatgtgaataccaagaaggagcctgccaggcaaagatgagcatgtttcaggcagcagagagcatgtgcaaaggtcctgaggcaggaacaagcttggcaacccggggaaggcagggagtccgtgtggctgaagcagagtgagccggggagagcagaaggaaaggagggcatagaggagacggctcagtttgcatgggcttcagaggcccagagagtgactggattgcattctacctgtgctggtttcttctaagccaatggagactttcaaacagaggtgtgtcgtgatctaacttacacttctcaggatccctcctctgctgtgggaggctgtgctggtgtgtgtttttaacaccagccagtgctgccgtgtgtgcaggaccgatgtccacacttcacaggtggaaacagagcacaaaacagtcagtttgcttgtttgggtggcactgacctgtccattgtcaccagccagcagctcaaagggatgtccggctacccttgggtgaggacagggtagtgtgctctctgattccaaagggacacctgatggtgagtttcgcaacactggacgtccgtgtatactttcctgggactgatgtcacaaagaaccagaatcttccttaggccaagaaacatggacccctcatctcatacacaggacctcatgcatgcagccgaaccccacactggatgttagaggcacaaagacttgaccttgaggggctcccagcatggctggggagatagcacataagcagagactctccctgcacaagggggtgctaccacgctggacaggggaccacactggctgggggagccttctcagggagagaagaggagaggctcctggagagaagccctctgccgcaggtcctcgttggggtcatcatgggagaagccgggctttggagctggactcacctgagcctctcggtgttatagctcccctgctgcgtgagctccaacagggccctggaccccaccctggctccatctccccttggaagcaccttccttgccttgctccagccattggggtcatggcatgtggcctctcaccaggtgggctatcagcaaacatgagtcccttcctcaaatattaatggaattgtccctttgggggaacgaccgtgtgactctgagcatgagaagtgtggttttgggtaccatctgtttcccactgaatcaggggctccctgtgctccaaaggagccacatacacagaagtcatccttgggaatgtgtggtctgtgcagcgggccacaccacggcatcaaggcacatgagggcaatggcgcaggccgagtgaggaacctgctgttgatgctgatcaaaatactggagtttgcaagtgacagtttttttgtttttttttttaagcaaattagggttgattcaaagatttccctgtaacaacgtcacattcaggatgatctagcatcagccagatatggggccctggggtctgaggtcacccatgcagggcccagcaagggggtggtatttgggccgtgccttgaagaaaaggaagggctggctgtatggaaaacgcaagtctggcaggaggatgagtgggcgggagacagaggcaggaaagctgcacaggcgcagggagcctccagaggttcctttcggctggccagagcagactagagccgcactgggaaggaccctgaccactaaggtcaaggtctagtctagactctggccaacacacctgcacttcctcggaacacccccttgatgttccacatcaaaaggtgcatgatcaaataagttctagaaatgccacatgctgcttcacctctcggaaaatcatcatccacaggagcacagcaaaggccctgagaagtcctgcaggggaagtctgtctgattccatttagcccagcaatccccactcatttgaccgagggcaccctcatccccagaacccccactaatatctgcaagatccactttgaaaaatgccaccatagaaaggggtgaattgctgagcaggggcagagcgatgtgttcagagctgggctcactgagtcggaaccaggtgagggctgggagtgacgaaggggctgagggagccaggctgaggcagagacacaactaggaggctgtgtgtggtgcagagtggggctgggaaggcctgaggaaccagaggcaggagggaggtggtaggggcagagagacaagagatctcagggggtgagtagtccagatttggcatccaagcagaccagggatttgagcttaaggaaccacagagatggtagagccgctgcctgaggtggttctggtgggagataaataagtgtggctcagggcatcttgcgtgtgaggagcctgtggacaggtggctgtaccacactagagacaaagcccactttcttgtctcttcaaaggtaccctcaggttgaaaggtggccccctttggtttgagctggggagccccttaatgaaacacaccagcaccattcattcattcctccagtaaacagctgtcaggtccagttggggccaggttgaagggccacggtgaagcctgcacaaaggcccagtgaggctggggctgactgcccagggcaggtgccatgtgtcctgggtcataaacagtcacacaaggagaaagggcatcccaggcagaggcacgtgcagcttgaggtgctgaaaagggtgtggagaagaaacacgtgactggagggagatttcccccacaagaagtcacttcatggcccagacctcagctttcccacctgtgaaatgggcgtaataacttccactgtggggtcctctgcaaggcccacagaggaatggctgcggaagctccctcatccacactccaggccctactaggccttatgccagccatgggggccaccaagatgaatgagtctcaagaccaaagtgggcttctttgtgccactggcacaggatatctgctttttgccctccagggtttaggaggtggttattgctggaatcaacgccggggctgtcctcagctcccagggactaggttccagatgtgtgcatctggcagccgtgctttggtcctggcttgagtgtgaggatccgtgggccgctcaagaagaggcagatgtattttgacaagcctgccacagcttctgcagcatcctgagtcaaaataagcccttctcttgggcagcccctgggacgggctatttctgcaccgtgtttcttttttctacacagggggctgaacagcaatgattccagctaaaaacagaagctgccccagctggagcccacaatattcccctcaatgacagaaacctcagcgcacagcctgtcaggaactcaggaagtctttcgtgtgggctcaaactcagataatttcccctgagggtaggcagtccaactccaggaacactctgatagccttccaaccccaggtggttacgaataataaaaataagtcctcacaggaatacaaaaatttaccaatgacaaagtattttcttgcctaaacagtaacttgttgaggggattctattattcccattttaacaatgagcaaacggaggttttgagagttgacctgcctctggagggatggaggagagaagatttgagcccatagctgttgaactgtcttggtagaaagaaagagcctgcaaaagagaaaatggaattgcggcagaggtggcttcaaacagtttctcggtttgaccagatcagcaccaaacggctagagttcttgctttctgtgccaggcaccatgcaaaggcacgtacattcacacactgcatctcatttaatcttccgaacagccccggaaatggggattgctgttgcctttttctggatagggaaactgaggatcagagagacaaagtgtcttcttcccatttggctacaagtaacgcaggttcaacctggggtcttgtgcatccagcaaccatgcagaaaagtcctttgcctccctggtactggaagagctgaggccaaggaccagctaggtgggatgggaagtagggctgaccccagagaaagcagggcgggcaggtgaaggtgtctcgcggtgttttccaaacccagggaagcattggcatctccgtgactgtaggtggttctgtgggtaccactctcgatagcaagtcatatactgaggaatctttcaacactccagtcatgtctgtgaggaagtctcagtacgtcctcagcagtctctaatgttagccccctccctgtccatgaccagagggctagcctcagactgagggcccaggcccaacagcgtggggcaagacagtacacgggtttccttttcactgcatttatgtgcattgttaccttctgttaataacaagtgatactagttttctggtttaaagtgcccatgtgaggtttcttttttaaataaatgcaccaaagcattttatttttgcaagtgaatgaaatgagagaaatgttaagtaaatagcataggtggtttggagacgtggcaaataccatagaggtgctactccaccagtcaagccggggacacactggctcctcaattctgggccagccctggcaacagcctcacacggtgcccctggaaacagctgtgaggacccctgagaaactggccccagcgcccctcctccgagagctgcccggcctcttgtctttcagggttgtacagaggctgtcaggagctccaggcctcagtcccaccctgtcacctgctgaaagagctgggtaccaggtcttatttgtctctgggccccagttccagcacaggctcccacaggcttgctggcaaatatctgtctattgtgccctgagatatgctggggacaaggggcagagtctctcggaggtaaaattatgaaaatagcaacttgaacccataagaggagacggtacaaagtcagcaactgtctgcaccggccccttctctcatggacatccaaattcaagcccttcttgtgatgcaataggaaagggcggttctggaaccacacggccagagcacagatctcaggggcctctgacgactgagggccttgagcaagcggctgcacttccctccccagcttccccctctgtggagtgcgattgctgcaatgcccactttctaggtctgttgagaggctccctgagttcatgcagatgaagagcttacagcacccctggcccatggcaccccattcatggtacctgttcctccatggcaggcactggctagcaattcccagatgttatctcaagcctggcatcagcctgggaaagtgggctcagagaggcgcagtgccttgctctagatcacacagccagaaagtgctggggctgggtaggagcccaggttctccagcttcatgcccggtgccctgtccccagcacccctgagcccctacccatgtgtccttgtcctgaggcccccacttctcacagctcctccttcctttgaccagctcttttctccttttatcttccacagtgagaactcttttccttttgaccagggacagccaggccttcgtttgctggatcaatcttaaagctccctgctgaccccagccttcctgccacccttgctgcctgccatcccagcctaggtttcctccataaagtcactggggaagcaaggactcttgattgcatgacacagaaccctaactcaaactggggaggcgcaaatagtccacgcaacctttctgagcctcagtttgcccttcagtgtaatggggtcataatgctacatgcagtacaattgatgtaaggatgaaaggaagctatgcatgtcaaagccttagaaccgtgcctggcaggtggtgagcactcattatcagcgtactatttgtattattattactactgttattagcactactcaaggcatgcggggtcagagacactgccccatcttcaaagaactcactgttaagaaggaaaagcctaaatatgtatacaaagataagtaaacatcccaagatcacagcagcctacgagacagcagagccagagtgaattttgcagtgtcagagtgatacaacactgcagtcaaacaggtgtaccatgatccagcgccacagtgggagcgaaaaaattacacaatccattgattccacaaacatttaccaggtacccgccatgggccaggcgctgtgccaaggcatcggggctgcaacaatggccagacagacgtcatctctgcctctgggggactcccacccagcagaagagataaacccagaacaaataattattgaagttcagtggagctcagaagaaaaattatattaggccataaaatgtctaccagaaaacagagcttagtctgagggtgtagccagcaaggcttctttcctgaggacctggggattaaagggcatgacagtcggcagggagagcagctggatgagagcaggagagtagacattacacacagtatttaggggtgacatctgccttctaccataaggcagagcagtcgaggttcagtccagagtcgaaatgtgtggagtctaatcccagctctaccatgtgctagccgtgacctctcagccaatataagacacctcttttagccctagttccttcatctgcgtaatgatcacaatgtcagtaccccactggattaagtgaaataacacatgtgaactacttagcacaatgccagtcaatcctattttagatgcaagtgatagaaaaacaaatgtaaatggtttaaggccaaaggagttatatttgttcatgtaactgataagttcaagggtagatctctggatttcaggaagggcttgatccaggagctcaaaaaatgtgaccgaggttcagcctctctctgtctatcagcacctcttctggcgtggctttcctttgcggcaggctctttccacactgtgaccctgcagcttcaggctcatgctttcccagctcagtaagtccaacagaaagagaggttttctaatattttcaggacgagccccaggatcgagtctcactggaccatcttggatcacatgttcatccctaaatcctaggcctggattacatgccaatctctagagcttgagggaaaggagattcaattccatccaaaccacatggccagagaacgggaaagagtggttccccaaggtaatattaaggtgctatacggaagaaaggctaccagagaaaataggacaacctgcgtctaccatagcaaccacacagagacacaggatgaccatggacagtgcagaataatccctcagtgccacctcatcctacatccagccatggagtgagcctcatctcccatgcagacatcctggttccagaaggacagataggttaagagagcaaattcttggactaaacagcctagaagcaaccctggtatagcaccttctagttgtgcgaccttggcaagtttcctaacctctctctgcctctctccttctctgtaaaatgggcataacaatagtacttacctcataaggtggttgtgtggctgaaatgaggtagtataaagctcatgtaaacccattttcgttaagcacccaactgtgtgcctcacattcagctgagacttctgtacagtcctcatctaatcttcaccacagacatgggtttttgtacccctgcacttctgatgaggaaactgaggctcagagaggtgcagtgacttgcctacagtcacccagctagtgaatggccaagctggagcccagccccaggctttcaaatgcaacatctgagctcccgccacgctccgcgcagagccaagccgaggaatctgacaacccagcagcccaagtggaaagacagagcaggtttccaaggagaaggaggagaggtgttgggaacatgcagttatttacaggatgccgtgtgggctgcggcatgcgagagggagctgtcctgaggtgaggagggagcgggagagactgggtcctcagtttcctcatctacagacagagatgacgatggcagcctctcaccaagagtgggctgatgaaaggacgtggcaaatgtgcagggcctgcgcacagcgggttctcaggaaggtggggggtggggaggaccagctggggtgtgattggttggctgttgtcttcatcagtaggaccagagcctgacccagggactgtgggcctcagctttcccagaaatgaggaaggaacttgcctggatccttcactgcggaccttggttctccaaaaatggcaattcgctaaggaaactgagctgacaaatgcagtcagagaatttagaactggggactgaagaactgaactagggactcatgacagattctacctgcttattaaaacctccaaatggcccccatctcagtctgatagcatccaggcctctcactagggctgatgaggtcccaaacaacctgggactcagttcccattacattccctgccacctgggctccattctgtcctgggaacaagccaagctcactcccagctcaagggagcatccttcaggccacactttctgccccagatcttcagcatgggcctcatccaatttttcaggtcaggctcagatgtcacctctaggagccatactgggacatccctgtcctgtctttctttctcatatcaactggctttatttctgcagcgcactcaccactctgaattatctttccattcacagatgctccttgacttacaatgggtttatgtcccaataaacccatcgtaagttgaaaatactttaaggtgaaaatgcatttaatacactgaacctactgagcatcattgctgaacctagtctaccttaaacgtgctcagacacttacgttagcccagttgtgcaaagtcaactaccacaaagctgctttataataaagcgttggatatatcatgtaatttattgaatgttgtactgaaagtggaaaacagagtggttgtatgggtacctgaggtacggattctactgaatgtgtattgctttcacaccactacaaactcaaaaaaatcataagtggaaccattgtaagttgggagccattgtatctgttaattgcctgtccactcccaccagaaactccccattaggcagggccctcctctgccttattcacccagtattccagctcagagacatgcctggcccagagcacgtgctcagggagcagtgttaagtgagcacgaaggtgctggtctctgccagacatgggcatgatggttgattccagctgctggtagctgtgtgcctcccagcagcgccagggcctgtgcatacactgtctcagcccagcaacgtgcctgcaaggaaagtgtcaacatcccactttgcaaatgaggaaacttaggctcagagtggaaagctgacttgcccaaagtcacacagtgagggcctggcaaagtctggatacaaacccaatgccccttcctgccattccccggggaaaagagctctgaagaacagtacataataggaggtaagagaactccttcggtgagaccctcctggagccccaaagtgctcaatactgaggactgggaatcgtgagctggtgcctgtggtggacatgaccagagcacaaccatacccacttacccctcttctgagcacaagcgacaccacccttcccagccccctgcagcgggcaggcccaaggcactaggcctggccaatgaatggtgagcagaaatgtggctattggtgaatccacgaagaccctggcagggagcatgggccactttatctggcccatttgaggagagctacatcaaggcatgggcagcgtgaacagatgccacaaggatggctcagcccccgggggccagtgtcagtggggagccattagcacctccaacctgaggggcgaaggaggagcagctgccaagcctagagagggtacaagcaggaaatgtacacaatatattacaccaaaaatatcccagtgacaaaatgacatgatgatggggccaaagcatggaaggatcttgcgaagttataggcaccggctgcaaaatgcaaaaaagcctccaccttcagctgagagacactctgattgtgctcttttccttgcctctaatccctgccagtacctctttgataaaacccaagaaagctgaagaccaagggagcctgttgattggtctatgtggggcagcctcctggccacagggcagcagtggaagggaaagggcagaaccggagaaagaaacaagatagtccgaaggatcactttccagcatggaaaccttggtgacacacagctccctcttgctaccagagaagccacgtgatctgatggcatcacaagacgatggagcctccatgagcctcaccaacctagcatacagggtccctcctccaactacagcctggcatggtctgaccatcacagtgggaaccaaaacaaaactaagcaaaaacaacaacaagctaaggagacacatctgagaggctattgcaaagaaaaaagcatctttgggaaaacatttaaaacttgatgacttggaatcaggaggcgtagccagggcagagaggccttgaaattatgcagtccaaacacactctgaaagtcaccttgggaaggcctgtgggaccaagaataagaggcctttcaaatgcatcaaatggaaagaggccagataaagaactggcaagatgcttgatgatcatagctctgagatgaaaaagagatatcgagaagatctgaggaagccacagccccagtcccaactgaggaggaccccagggaaatccctgctcccaaatggtctcttggaagtaagggcaccaaaggcactgctcttgcaggcaaatgttccaactccagttgacaaactagatgcagacaaattgccaggaacagatggcacctgcccaagaatgccgacgccactcaaaggtgaaattgcagagctgttggccaaaagtatgtgcatctttgagggggtgtggagatatgaactgtggatatgatgtttggactttggcaaatctttaagcaagcaccaccattgtgaattccctctctttcagtcaacgtgaccatggggaccagcttgtagtaggtcaagatgcagcttagagacaaaggaagatcagcttcttctttgaatgtgagaatattaaatggtggggcttcccaggatttggacctgcctgataagaagttttctgaaggaggggacacacagctccaaagttacagattccagcaggtcccttccaggtggccgagacagaaacctaattcagagcaactgaagtaaaaaggcagcatttattggctcacataactgaaaagtgcatgagcagagccgggacctgggccctcacacactgtcatcaggaatttgtctcctgcccttcgctcagctgtgtgcttctctgcattggcatcaccctcgggcaggccctccccaggtggtggcaaaccagtcaccagctgctcagtcccacattctgccagccctgctaatcccatacatacagcctccttttggtcaggcactgtggctcatgcctgtaatcccagcacattgggaggtcaaggcaggaggatcacttgagcccaggagttcaagaccagcctgtagccccagctactgcagatgctgaagcagaggatctcttgagcccaggaggttttaggcggcagtgagccatgattgtgccattgctctccagttctgtctcaaaaaaaataaagaaaggaaggaaggaaggaagaaagagaaagaaagagagagaaagaaagagagagagagaaagaagaaagaaagaaagaaagaaaagaaagaaagaaagaaaaagaaagaaagaaagaaagaaagatagatagaaagaaagaaagaaaaagaagggagggagggagggagggaaggaaggaaggaaggaaggaaggaaggaaggaaggaaggaaggaaggaaggaagggtctctttcctgttggttccagctaaagtcccagggctgactctcattggcttagcttgtgtcacttgccatcctagagccaatcaccatggccaggtggctatccagcactctaattagctggctatggatctaatgcccacccatggcagtaggacatagagtcaaccccacccaaaccacaaagactgagggtggaagaagacaggaactccaggcaacactagacaggtcaaaaatgtattatgaccacagcaaattacaccagaaacatcccaatgacataatgccatagtgatagggtgagagcatggaaggatctcatggggttatgtgtgtgggtgagaaatacaaaaaaaaaaaaaaagcttcagaagaggcaagtgcaagatttaaacaaggatgccagagctattattatgctctgtgatccagaaagtggcctcagtctgcaaatcctgcccctgagatggggacctcaaaggccatgggccaagacaagttatttcaaccccaagtaggtggggcaatgccaggcatgtattctacctctggaaatatttgttgaccatccacaatcaaaaaagccttgggcttgatgttggggattcagggatgagcaaggcatgcacttgctctcaagcagcttaggatccagcagcaggagacaaccaaacatagggtaaaaagggcgccccagaggtgtggagggctctgcagcagggagcactatgtgggagaagagttgaggtaaacaggttgacaaaggaagcagaagtcagatcaagaggggccctagtaggtttggacccgatgctgcaggtaatggtgagtcactgaaggcctttgagcacaggagtgacccaagcagggtgacgcttcaccgccttaatagagccagacaaaggcccagtggagagtcacagagaggatcaaagggctggcaataggcctagaagggagacggcagagggaaggctagaaagctggaggcggggagagccttgatcaaagtcaggcaggggagcacagcggcttcctgacgctggacccaggtggggacagagcggccctgtgaagtcaaagagaatgttgctttgttcagctctcactgggaaaggtgagtgttgcacagatgcaccccaatgtcatttatataaccatgaccccctcaagagggggtgtaggctggaaactgggactaactctctaacaaagaggttctggcagagtcctgagtaacagtcataaaggaaagcagagggccacctgggtgtctggggacgttccttaatcattcattaaacagccacttcctgagggcctgttttgggcctggcccttctctgggctctgagcccagagacatgaagccagcatgcccctgtcttattctgtcatagcccagcacctgctgaaagcaccctgcccctgggtgtgtttgctcaagcagtgcccacttctcctactagaagagacagaaatttgtgtattttctcaccatgtatccccagcaacaagatgagtccctggcatacagtagatgctcagtatgtgtttgctaagtaaaggactccctcctcttcagtgagtcccatcctccaagagctcacaatctagtagggaagtcagccaagaaagcaaccttaagtataaagcttagtgctacaatgaaggggtccacatgggtgcatgggtagttccacatgggtggttccatcctgtttcccaaattagattttttttaatgctctagctgtgccatgatggtcaaagcaaaggtttgccaagtgcacagagcagacaaaggcattccacccagagcaaacagcacgggcaaaagttcagaaacatggttgaggttgtggcatatccaagaactgtaaatcatctggtgttgatggggcacaagtggctactatgagactgcagaaagcagtcagagtctgatcaccaagggccttcaaggccagtttaaagggcttggactttatactgaaggcaatgggaaggcattaaaggatttgtattagttaggctccttttggatccttaaagtgtctttaaacaagaaacaaagggaagagacaaaagtataagacccagaatggagtctctctggccctctctgctcatgtgccctcaattgatctctggggactgggggaccagatgtgctgatcagtccagcccagttcatgtgatctgccacccatgggtccaaatgaaatacacaggtgggctcctccaaagctgatgccacacgaggaaggagttggccaaaaagctgtgactacggcgtgttttaaggagaggagtgatgcagtcaactctgtgttttagaaagctctgattctcctacaggtctggaagccagttagaaagtaaagaagaaggtaagagcagaggcaggagaagtggtcccaggctggtggtgagaacagggctgagccaagctgactggaagtgcacaaaggcctaccccagagggaatttcttatgtaagtccttagggcacagctctgagccctgacctacagctccgtcacttttggtcaccttgagacctagaacacccagccccatcaaggatcagcccatggtgaggtcgccatatagggtgccctagcaagatcacccaaactctgggactagttgccttgaagctgcagacccagggtcagcttctagaaacccccaatctccctcaggaaatgtggccacctggagagagacaccaagttcagatgctgttgctgctgcttcttggctgtgttatcctgaacaagggcttaacctctctgagtctgaatatccctctctgaatacaaagtggagataatgatatttaaggtaacggaggcgagggcctggggattaaatcagataaagattatgaatcaccttcccccatgagaggctcagtcgatgaaaatcccttcctcttctgccctttaagcttttccctggcttcatcttcccaagacttccccaatccttttcttgtttgccaaataaaagggagttttgttttattttgtttttttgccaggaagaaacaactggaggttgagtggcccagagcagccatttttaaatttgtgggtggaaaattcctcctgttcttgggcctgaagtctaagtcccctctggactttcctcacacagttcccattttggaggacacaaatatcctaggccttcatgtgcaggagaggcagggaggaagccaagaaaaggggtaaaaagaagaagaaccatctcccccattttcctctaagctttaaattcttttctttctcattccaacttaaatacatgcaggaagattatgaggcagagttctttgaccaagaggatcataaaaggaggttttgtctagtggttagtctgccctgaactccagaagagaatgctatgccttgcctgggtgttggagagaaagagggaattaatacttgctgaggctatgctgctatttcctaagcattgtttgattagagccacacaaccaccctggaaggtagagatcactcccccatttcaccaatgggacacagtctcagggaaaagccacacaccatgggaaggggcagagaattagtgagatttaactccctgtctttacgtggccagtgcccatggctgccaccaccatgaaacctctgagatgacttggatggccccagagctttcatgcatcaggagcagggggtaccagccacccctgccccttccctgctttgagcctccaattccatctggcttgcaagctgtgtgtgtttgattctcttcctcagagctccctcttcactaagacagcacttaacatgttgtatggtcattgactgtttgcgggcatctgtctcccacttgcttctgagtgcttcaaatcacagagtctcggatctgaaaggatctggagagtgtgaactggtccgtgtgttagctcttagtgaagcatttgcatctctcactgtggaacgaagtgggggaagagaaactctggaacttcttgtacacctttgcctaggagagctcctggggtgctgtaggctctccatatatgttagataagagaatgagtgagtgaaaaatgcttgctacatagggttgtcatatggcttaaagggttgacatccgtaatgtccctaaagcaatgcttggcacactggaggtgtttaggacgtgtggagctgggcgctgagttatacctaaaaaagaatacttacctagagtgagaagtttcattaacttgttatgtgaccttgagaaagtcctttcccctttctcaccctctgtttccccatccgtaaactgaggacactgggttagatgaccagaaatttctctcttcatcactgatttctttaatgcatgcctcattgcctcccttcatccaaccctcccccaaccacatactcacatgcacgcatgtgcgcgcgcgcacacacacacacacactcgtctattaatctccagtagcattcctctgccccttggcactctttctctttctttcatttcctcgaccagaggccccataagcttattaacctctgttgtccatgttcaaccaatatccttgctttaacaagacagcaataatgtccttttgaattcatttttatcaacaagcaagatctgttttgtgggccagagtgtgctggttctaaatggaaagtagaagtcatttccagctcacttactccataaatgcaggggttctgccgactgcctctgcaccaagatggaaagaacatctatcttcacaaatgtaggcgacaccatagaggcagtcgttcaagggacaagggaaaaagctttccattccaaaaggaacaggaaggctggaaactaaaaattcctcctagaacgggaacaaaatcacactccagggtcacttccaacttcacaattcttgacactgagattcatagaatttaagattctaaagttgtgagtgaatgtgtgtaattggttgatctgaagcttccatgaatcctaaaatattctatggctccacgatccagtttttctgtaagatgagggtccaggatcttatgattctctgactctattgacccagggcaagggtttttcaaccagtcgatgtgtcagaaacacctgcggagctgggcaaaagatgcaaattcctgggcttccgtgtcagagattttggtttgtgccatgtgggatgaagcacaagaatctgcaattttttaacaagtcccccactccagtggttctgagtaggagtgggctactctttgacatatagtgttgtagggagcctataattctgtgattctaaatgtgattctaaaatggtcttttgcatgattctagtatcctgcaactctgttattctatttccctgtggctaaggaggattctaatgtgtaaaaattgtctttctgagcatgcatgggtttcactggtggagaggaaaagggaccaagcgtcctgagggtggacagacactcaggagggggaccctctcgagagcatggaaagcaaactttgatgctacactgattgtgcctgggcaagtccagagctgggactcagaaatgaggatgcttggctggggtcattggctagctctagggagaggccatcagagaagagttcttaatggacgggtatatccaaacacatctcaaagagttgaaaggactgaggttggaggagaggagacagaagtcataaatgagagttggaaaaagaaccagaggcaagagaggaaagatttactaccaaaatattcttcctttgataggatgggggcaaggagactgcagactgatttgcagacatgaaaatgcaaggtttcaggaaagcacaggatgaggggagctaaccaagtggggatatacagggctacagtgtgggctgggagacgactgctttgacatgctaatgagtgcctgaatctgggagggtgggacgggatgaaggctggcagaggacctctgaggagctgctgggcagatgctgggctgggagagaggctctgagttaggggcagggctttgggatagggaggggctcccccagggaatttccacatggactccatgcacgaccaatgagtcagagttcatatgttgagcctggtaccctctttctgagaaaagtgaagaatgaacccaggtatcatggctcctgcctgcaatcccagagctttgggaggctaagacaggattgcttgaggccaggagttcaagactagcctgggcaacatagtgagaacttgtctccacagaaaataaaaaaaataaaaatcagcaggcttggtggtgcacccctgtagtcccagctactcaagaggctgaggtggatcacttgagctcaggacttcagggctgcagtgagctatgattgtaccactgcactccagcctgggcaacagagcaagaccctgtatctaaaaaaataaaataagaatgaaaggtgctggggcttttgcagcttcccaggtgggatagaagccagcaagttggattaatcagggtgcctctagtgggggcagaatagacaaggaggggtcagtcactatctgtgacacattttgcctgcatacctgcccagtggtaatgacacactcctggctgcacacacacacccttactgccctacacaatagcagtgacacatgttccagcccattgtggcacactcatatctgcagccttaccactgatggttacacaggactacaccatttcatactgatggtaacaccctatcacctggggcattactggctgacagcaacactcagacatacaccaatatacagaaatggtgacacgtccccagagcctttgtgtctggcacagtctatgtaaatggtgccctctgtggttgtgcagtacacaacctgcacagctctatgtggtactcttgccttacagccaaatgcccagacaatgccattgacttattctactctaataacaccccacgtaggtctataccatcacacaccaacaacacgctgacataggagtcacatcccatcaggagggaaacaccaccacacaccgagagtcagagacgcacgcctgccctgccacacgctgatgatgacacacagcgcctgtgtcactgcacatgagtgctgccactctcccacctgcacagtcccacactgctgggcactcaaatacaccattgcacacttatgggtttgccctcacaccatgccattccatgttaaaggaggtacactgggaccctcacagtgatggcacccggccattgtcagtgacaagagggaaggcactcatcagatgagcaaggtggcctagagcccttctctgtgtaccacccccgcagttctgtttcctcgggcacacggccaacctcccaaaccaagaccaactctgcccctccaggcttaggctagaatgacaggatgtgaagccagtgtctggagcatttgaatgtctccctgcacccaccaacgtaactcccagcaagctcaggaccagccagcgagctccagatcagagctggtgcctggcatttcctagacaccccctcacctcccacatggcatccaggatgccctctgggctgaggcaattgcagggaagaaatgggctgacctttggacaggcaccttacgcaagctctctcactgatcaccacgtttatggtctgtgacagttgtcattcctcacacattgttcctcgatcctcacacaaagtactaacattagctctcttgattggcttcctactgaacattcaaggcatatacataacatcttacaaatctgttcaaatctgaacccctcctcctgcccccagggctcataaataaaagtggaaattcagctccagtcaggataagtcacctgaagcagagccacatctatattttaccaggtgactcttagaagctgtctacagagcaggctcggcaagaacctgcggctgggcctgtttgcactcccgctggattagagatgcaggagatgaaggaaatgctggcaacccacatgacatgaggaccccgatctgggtgtgaattcgtggcaggtttttttttttttcttttagtgagaaactggagaacagggaagactataaatgccaatgtaaaaaaaaatctgcagagcaaaagttacatttccataggctgtgggatgtgtcaggagagaagcagccccacgtgctggaaggaccacagaactcagtgtcaggcaagcctggtctggaaccctggctctgccaaagattcattttatctccctgggcctcaactttcccatcttgaacataagtgcttgtgtaaattaaatgagaaaatgtaaattatataaagcaccaaagttaacacctgagacataatgaaagctcaaatattcactattagtagtagtattttaatcattaggaaagacttatgatattcagcaactttttcaataatagtagggccttcgggaagcatgtcaaggctggtaacactgaatagggagcaggtactcatctcttcgtcacctttaatggctaaagtgtcatgatttaccccttattgtgcaacaaaatgaagtcaccaaaacttggctgagctgccttcctattcgccagtgagattttctgcagtgagacacagttcatgtcagcttaggcagttttttatagactcaaagatgcttgggttcaaagggggctttagccatcagctggaccagcctcccacacacctgccatcttccagagatagagaacccataaccccacacagggcagtctatcctatggctggacagctcctatggagagccagttcttcctctcagagcttctgcctgcttcctttacctttcccccattgccctaattctatcgccagcaatagaaaaagcaatagtactactcttccgctacaacagttattcatccattcaagcacttccttagcatctactttgccaggcacgttactaagcgggggaattataaattaagcaggaattgccagcccttaaagggttaatgccccctccgtgttctttcttccaggtgaaagatcctcaaatccttcaacctgccctcatttgacctgatttccaggtgcccaccaccaaactagccccttctcgagcttgacatactcacgtttgtcaaagtccatcttaaagtgtggtgtccataactgagctcagtattttccttaagcctcaactagatttgtagcccagctcagttgatgtccatgtcaaaagcaataccagttgtggaaaaactccaattgtaaccagagtgctgccagccaggtcccatttactgagaatattcttgaagcacatgaagaaagaggggacggggaggactgtgcacttgaaatgacatgatgtcagatctccctgcccagaattcccctcaggcattagtggaaagtctaagtcactctaatcaaagagcctccctgccactgccatccccctcttagtatctgccctaggaaagggaagaaaaataaagaataagcattctatgctgatggcccaacacagtgctaaacatggaactcagccctaaaggaggggccttccttacacaagcctgtaaggggagaacagacatagacttcagaaggtgattctccaggtgacgaggatgggttcaccaatggcctctgactggtgggggggtctcctgctttaaggcctctgctgtgatcgtgtgtgaagggataagttctccctcattggaacaaaatcacatttctgcagctcttgttgccccttccttggaaggaagccatccccttagaaggagaagccatctccactctgacataccttgatggatgtgaaactcctgcagatctttcacaggccttgtgcaaggcccctcctctctgaagccattttcctacacatcgggctggagtaattgggagccgaaagatggcaggcagaataaaaaggctcattaggtgagagtaataaaacaaaacaaaacaaaacaaaaatgagtgcaaggggaagaggaaaggctgggggtgggagcagatgttgtcctgcctcttggaagtccttttactttcttgggcataggaggaaaagaaatggccttctagaataaattttgccagaggagtccttattcttcacaggatatcagatctcaaagggattggcgagtggcttgcctaaggtccactgcagttttgcatcagtcttctctttctgggtgcgcagtggaggttcctgacccactgcgagggtcttgcccacacgctccatcagtgtttcctgagtgctcctgtggctggacactgtgctggggggctgcaaagatgacctggccaaggtccagtcctggagctgctcacaggcaagaggcaaaccaacaggtggaacgggggtcgctgaggcaagggcttgtctgggagtggcaggagccgcaagaagtgcaaccactctgcctggagaaaccaaggagggctttcccaaggaggtgaactttgagctttgctttaaagaacccttcctccaccccttgcccccaccactcctcaggagcagcaagcttgtgggcctggagctgtggccaggatgtctggttgcagggaggcggcaggggcgtctgcgagggggaggagaacagtgtaaggtggaggagagaggggaggggagcgagaaaagagggggaggaatggagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccccgggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgcgcagggatagaccaaggcttcccgcagaatcgctaaggagcgcctcctggcggcctggcccaaatcctcaactgccggcaacctgctggacctcagcactcccgcaggcatatggcaaaacatacacacacacacaccctgcacacacgcacgcactcacacgatgtctaagtccagagttgcacacacggggtcatactttcaacgcacacaccctcatgcactcgttgacacgttaaattcaacccggcacacacgtcctcaggatctaccatgtaccaggacatgtagccaattctggggacaggagaaatgaaacaagatactggtcctgtcctgagaggagctcagagtaaccaggaagggcaagacaaagaaagacaaacagacaaagagagcatgtactggaggcaggcaatactgcccccagaaagtgccacaggtctccaaaggggaagatgccctcacatcttgccaaggagatccgtgaaattgcatggagggagtgctgtttgagagagatcttcagaaatcaatgctgctgatgatgataatgatgactgcgatgatgttagataatatgtacctactttgtgccaacactgggctgagcactttatttgcatcacctcattcaatgctcactacaagccttgggaataggtgttgttgtctccatttcatagatgagaaaacattgagtcatttgctcaaggttacttagtaagtgatggagccaggatttgaactggcagagatgagggtaagaggttccaaggctgtgggaatagcatgcacaaatgcccaggcattctcagaaagattatctgttgggaaataatacgtgctaagcagagccctgtgcaagaggtggcacacgagcagcaaggaagacgggtgctagactgtgcaggccttgaaggtcagcacaaggactcgtatcagtttaacaaggccatggggagccattgcagggtgtgtatgcatgagaaaatctgccctttaggaagattaattggatggccacgtggaggctggatgagagctgagggagagacagttagaggttatggataaatccagaatctctaggtcctgaaccaaggcattagcagcagtcacagagtggagggtggggatgtaggcagcattgcaaagctacagcgtctggacttctccctggaattctccctcggcacccccatcccaatcttaactcaccaattccttgcatgatctgttatccagcttctacctccccagcccaactgaatgctgtgagaccactgctgggactcccttgttccctgccacagccccagcacccagaacagtgtctggcagaaagtaggtactcaaggaatatttgtagtatgagcaactgagtgaatgaatgaatgaataatgaggaatttgctgtctctagagttttcagttgaggtgattgggacaaggcatactagagaaaaagatgggtgtgtggggaaagccaggatgagactgatctttggacagacagaatttgagattatccatgtgacaacatccagcagagagttaaatgtgcaggtgtgggggaggggaggcagagagagggaggtatctgtggctaaagaagtgcactaaaccaataggggtggacgagattcccaagggagacagaggggcaggagaggcaggaggggagagtttgtttggagaccatcttcactttaaaggaaaggaaaggagtcagcaaagaagagagagaagacctatctgagaagtaggatgaagaccacaagagtgctgtgtcatggaattcaggaggagattccagaaagctggaaaaggtggggggagggagtcagcagcagcatgtgattcagcagagggatggaggaggatgacggccgtgaagaccctcttgaatctggcaatgggaaagcctctggcgactgattaccgcagtttcagggctcctgcagaggcagcagagctctggtctcacagagaggtagggcttgactgggaggtgaagatgtggagataccatgtggagatcacttcatcacaaagtgagaggggtgggattaagggaaacgcagaatttagggaaggagttagagaagggagggaataaaagcaacatatggagagggatggaagatgtgaggaagagggagtggtgaggtacaaagagagggaatccagggcacaggtagatgaattggcttcagccaggagagggcttcttcctcaggagctagaaggaggggaggttacaggagctcccactcactgacattaattgttttgattattacaaccatttactgagcacccagcatgtgcaaacacatcccatagagtatttctaaaatttcaaagtgccattataattctcattttatagagaagatcaagtatcaatgaggttaggtcaattactcactattgcacagcttaaaaagtggcagattcaagatctgagtcaggcatgcctaacctcagagctcagaccccttatactttcgcccgtgaagtggagggaaagtcacctgctgagaaggaagaggcagtagcattttgggccttaagaaaaggagaattggttgggagagtgtagacagagtgaacaggagactgcttaacagctcagaggtccatgctgggatcaggcagcaggatttttgggcagactcgggaatttcagataaagaatcccagcaggctgaagaagagctacttagagccacagggatgtaagcattgagaagactcagtggtgagtagaggtactttgcaaactggtggaggggtggcagtggtaaacaatgtctgatgaatgcatgctggcaagcagaggtggccggagaaggtgatagtttggtgatacagaaatggcatgttaagtttgaggggtgcccacagacatccaggaaagggtatccaggagaaggtaaatgtgtttttttacttatttattgcttattttcctacgcatgtgtgcatatacccccacactcacatacacacatacatacctcagaatgtaatctgcatgaaggcaaggctttgtctgtcctgtttcctataaatccccagtgcctaacacattgactggcatatagtaggtgctcaattaatacttgctggatgagtgaatatagaggtctaggtgtcatcagtgtcagtggtcattaaaacccctagaatggatgagttctcccagggaaagattagaaagtaaaaagaggcaggggctgaggtcagagttatggggaagagacaggaggaagaagaggagtcagaaaaggcaaaggaagagaagaaaagaggagaggagaggaaacagtaaggggaagcagggataggaaagaactgagtcacagaaccaagagagaaggaggtttgagggtacagtggggttgtcagcagttcaaatgctgcagactgcttcaacagaggcatgggagaaagggcctggaagatcatctgatccaggagagagacgtgtcagaatcacccagcaagttagggatgaggctgcaactaaagcccgggtgccctgcctaccaatttggaacatctcaaattagagccctgcatctcccactgccacctggtaattccttgagctctatgtaaacacagagtaggaacccaagagtttctgaaatcacttgattattaaattgttcatttcctgttcttagaaatgaagttttttcacaatgtattaaatcgaacgaaaacatcttgactgagctgagcaacctgcaaactcagaattcggggttaggagggtgggttctcttgcatttctgagaaagcatggaaagcctgttcctttttggcttgttccacaaatatgtagtcggcaacggctgacattttatgagttcctgcaacaccccaggcacttgaccggtatcattcattctccttcaaacgtccattcaagggcaaccttaatactcccccattttgcagggagcaaactgaagcttgcccagggacccccagccagtaagtatagctgcctggattttgaaccaggtgtgtctgatgccaaagcccctgggctgttttgtgttttgctttttttttttttttttcctacacatcatgactttctcttcccaaaacaacctatcagatgagatggtctgatcacgtagataagctcttgggccccatatcatgaaataatctcagtctaccgatatgacttctcatcttgagagaaatgaagaaaatctatcaaagaacaaccagtgaccctgaactcagccaggctgcaatatccagccttgaacccaacaaggttgcaacatctgccaccctttcccaggaaccctttttcttccttgcaaggctgtgtgggacaaaaggccttggggagcaggcctggcctcagcttaccatgaagctacttcacactttggatagctcacggatgtcccctctacacttgaaaagagatctgtgtctgttaaagaacagtggaactgaatggttaaaatacaaagaaaatctcaagttagagcactagggttcagcttctcagggatgtagggggaagatggtaaggaggccaagggggaaggctcttcctcccccaccacctccactggaagagttccacttttacatattttgcatattgagaatcccattaagattttatttggagaacccttctgaggcaaaaacataataaaaaatataataaaaactgaaagccggtgatttaggaagaggagtagggtgctaatgtctgccgagtgcctgcaaggcccgtgctaggtagtttaaaagccctaagcccccagaagattataatgtctccaacactcccacgtgaaattcaaaataaaaatcgatattaagctataaaacataaaaattacacgtacattacaataaaaataacgtattttccatttgtctaatttcaaaagtcaggatctgtttatccaagctggctgttctcatttgctcagctgcctccgattggctggggcagtaacaccggctggtcttttgatgggctgatccagtggcccaggctgggccccctccaatctccgccggagccggggaaaggtggcattgccatttctctcttagagaggaggaaactggggactcgagcaggttagggccttgctgaaggtcccatggcaaataaggaaatgacggtggcgttggaaaccagatctgcctgactccaagttccaggctctttccaatgctcctggcttcaatcaaatctgaacaatagggtcaagatgaaggctttaaaatagggaccaaaccgctttcaaaaagctatttggcagcacctacgtgtctgcccagtaaatcgctctcttccatctcctttctcctccagcagggcattgggtcttgacctcagagcgatgggtgcctggtgtctgaaccagggtgaggctgctgtctgtctagctcccccgccctgcctgtgcagaggcctctcccatctgactcccaattctcttctgcaggttgtcacatcttcccaagccaggccagccaggagcgctgcatgcaaattctgccgtgggctaaggcacgctaaccagagccggcggcatggacttcgtcatgaagcaggcccttggaggtgaggtccagcgcccctccgcgtgtcctcagccggtcccacccttgtgggaggtggcctcggcccacccggcccctctctccccagccctgacccctagctgaccccgccctctccttcccaccccttcctcgtaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggagcgggagaaggtccggcagcagatccgagataaggtcagctccgcccgcccgcccgtcctggggagggccacaagcgggtaaaaccggtccagctaaagcccctgctggggctcccctggatcccagctctcaccttcgccctagttctgagcctcactcttctcatcagcaaaacgggtatcacaaggtcacctccctcaagggatccttttggggattaaataagagaatgcgcgtagtaggtactccaagagggtggaccctacggtccaccattccgtactgcagatctttgggaccaaaaatgagtgcagttctgaatttgggaatgttcgaaaaataccacagtgtcctaagcactttgtgctgtcagctgtcactcccagcgggtctggggctgccaccctactccagacagtccagtgcatgtctgttagtgcgtgcaataaataaaggctagaagtagtcttccattggttcaagtcagattcgtcaccaaaatttggctcaaaatatatgggcaaacgccatgtgttcagatctttgggggtttcaacacagcaggaagttctgatgggcaggtgttaattttaaaggaaaccccacgtatggtctctcccactgaggaccaggcaccatcctacagggaagacacccttatccccactttactaatgacaggactgaggcttgggaggcactcctggccacctcagccagtgctgcatgatcatgagactcctgctgtctccttgcccaccccgcttcatgcgcgtctctgccctccccctccccagtatgggctgaagaagaaggaggagaaggaagcagaggagaaagcagccctggagcagccctgcgaggggagcctgacccggcccaagaaggccatccctgcgggctgcggggacgaggaggaggaggaagaggagagcatcctggacacggtgctcaaatacctgcccgggccgctgcaggacatgttcaagaagtaaccaggcctcctgccccagcctactccacctgttactacttctttttggttctttcttttctttttattaggttaagtctcaattctgaaggggaaaacctcagttggcctctgcccctcttccctggccaggggcttctccccctcagctctccctcacacctcccttcatcccagggtatccacctgcaccccactcccaagtagcttgaaaaagggaggacagtctttccccagcaggggtcaggggggcccctcaggaagcctaaggtcgtgctagtgtggtgacccccatacattcctccctgctccccactgccaggaggaccactgtccccagccagccaaagtaatgacacattccagccctgcccagcatgctgacctttggcctctaaccctcagtgggcccccaggtcagggcaggggcactgagtggcctggctctgaggaagggagtcaggggaagcctgtcccgggaaggcccaggctgagaggccctggctctggccaggctgggatctgggtgggaggctggggctcttcttcttccatctccttggtgacacccagcccaggggcacccccttccccagcccccacctggagagacatggcccctgccaagctggtcccttcaaatggatcctttgtggactttagctcatttgtggaggaaccccaggtagggacgccccttgttcctcacccccaccccacttaggtcctgggcccccactgccaggctgggcccagcttgctcagtcaaggggctgccaggcccccagaaaacacttggagccatcgggtagcgatggtctatgccatggggaacacctccattggtgtggccaagctgcccccattcctatccacccctctccccaccccgtcctgtccatgcgcttccagggccccacggtccccaggaggacgcttcctggccaaagccccaagcctttggtgagaagccaattcccacttgacagaaggcgtccatccattcatctcattggccaaggacaaactctcctctgggacgtctgggactggcatttgtcccccactcaaattatcaaagctttctgctcagtcagttgtgtggggatggtgagggaagaggggtcacatgagggaggaaactgtatccatgcatgcatgataatgcgtggcagagactgcaacagggattgtgtgttcagagatcatatgcatatgtgtagggctggagcgtgtgtgtgtcttgagattgtgtgtgttgcagtcatcatatctatgtgttacagattgtgtatgttagccttgtgtatgtgtgcttgattgaggtggtgtatttgggttgaaattgtgtcatatgtgtgtgctatccatctcgtgtttagaggctgtatatgttagcttgtgtaagaatgtgttttcaaaacagtgtgtgtattgggagtgatgggtatgtgttaggtatgtgatgggttgtagaagcgtgtgtttgagagaattcagagacatttgaaggctgctgtgtgcatgtttgggggtctgaaaagacagttgtgtgcatggatgtgtgcgtggggagaaagaacgtgggtaagatgtcccttcccagccctgagaccactggtcacagttggccacctccaacgggagaccttgtccttggcctagagtcctcccacccttggggggctcctgcctgaggtcctcagaatcccactgcaatggacccaggcagcgccccaggaagccatgctgggcccccgccagggcctatcccaaaagcaggggccagggagggggcgacttgcctgcccctgaagcccttgttcccattggccccagtttgcattctgcaggttttccattttagtgggttctgcttttatttcagagacagacatgtgtcttctctgtccgtttccaataggtaaagccatatcagttagactgcaatactttaaacacgagacaaaacaatccatatgtttagggaaccagaaaagtcccctggtctgtcccttctttggggagcagggcctcgacagctccagctcccttgacctaccttcctccccgcaccccgcccccaccttgtgcccctgtgtccagccccccagggggcctgtgtctgtgtctgtgcctgtgtctgtgatggggagccgcctcgcacccctgttgtctgcttgt

SEQ ID NO: 16552 - DNA, 9944 bp, Human
gatgaagcatatgcttcagggcaccagcaaaaccagaatgttaaaaaaaaaaaaaaacctttgccaaataatttaatatctcagcaaaaccactgaagtagccatcatgggaaaaaaatcagaactttgttggacttttttactgttattttggggttctgttatttttctttttatttctatataaggaagaggtggtagaacatcaaaatcttttcagtgcttagggcctccaaaaatcttaatacaactctgtgtacatcttaaattatcataagttttccttagttgttcagcaataagcattttatttcatgaaaattatagtacgtttacccgtactttatgtaatcatacaatttaagattcttcctctttacaatttatctctaagcaagaaaccataataaatgctagaaggcaatcctcataaattggactaataccagttctcttttatcagccaacagtgctaatatgtcctcacaccctctggctgtatgaaaagattacacagttcccagaataatcaaaagtaaattattatttatttcttactggtataaatggaatcttaaatgtttctatttgaaacgtctacatatatgtaagaaaaagagagttaatttcttgttttgtagttctcatttgattcacaattcaagtttagttacctaagaaaagaactctagtttttttctcaacaattacattaaagaaaacactgccagattcttcccagtttcaactttccctctacctaccaatctcttgctggatgattacccagatatttctggtgtgttttgttgctaatactcccagtgtacttcaagaagggtacagatactgcttgaggatccgcttgccaaaggccggttctaattagacttgtcattttttgcttggtttcattttgaccactgggtgcatcatgcaaccgtgttggatatttttaagagtataaaaatacagaaagcaatagttaattaatctcacatagctaaaagaggaagttaaaagtactggaaattggtgtcggatgattaaataaaggattaggagagagaccattctagacaccctccccaaccccacatccccaaaatccaagccacttctaagtagtgagagaacttcggcaaccaagaaatggctttgttagaaaacacttcacacgacttattttaaattttgctttaaatttaattgcttttctcctttttctctaataataggactatttcgcagtttccagtccttgattaattaaggcttcagagttcgttcttacatatgccatgtcttaagttttcataaaattcagtctacacaagacttgctttttgtgagcactgtgcttagtggcagtccggatttttccctccacccccgcggccacccctgcccaccgcgccgtcgggcatggatctggcaggtgcgaggccgaggcccagggctcagcgaaggacgccgagtttacagagcgcgcgcgccctagaggaggcagcagcagccgcaggcctggccgcccgaactttgcgagcctggcgggggagcacagaggcgggccgacctgccccgctagcgctgaggaacgactccctttatgccagctcgctgtccgccttcccgcagcgtacgctgcggagcctcaaagaccctgcggccctccacaaccgtcttaaataacaaacccctgtcctcgcccccgtaggaattggggcagctgggggttcgcgtcacagactcaagcccgccagcagaagggcaggccggacttcgcggggccgaaccccgctccagctggggacaggccgcctagccggcaggagggagccggcgcgagagacttgacgggaggaggtggagagcgggaggcgggaatgagggcgcgggaccgggcgggcggagcgtgcgagactgcgagcgcgagcgccagcagggcggagggcggggcgtgggcggcgcccggccttcccgctcccgcggcgctgcaactctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacggcgaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagcggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttggtattaagagaggtggggaaaacaagtcaataatgttgcctacgtgacccgggtttctagatttacagcttttaagctttcagggacataaaatttcactgtttttaaacctagttggttgccatattttatatctttaagtggatgcaacttctcaaaatgacgtactttgaacaaactcctcaaatccaataacatccttgatatcaagtggggtccagatttggtcttagtttttggaatgtttttgtgacggtggggattttaaagtagtcagtgtagggccgaggtttgtttgttttgttttgtttttaaagacagctctgtaaacacattattatgattattatttgaagtaaatacactgctattagtggttttacgtactttgcccccaataatagactttaacgttaattttcttgactactgatgagggtgtttttccttcaaatgcttcaagttttgacaaacgacctttcctcgtttggaatgggtggcctgggcaccgggacaggatgtacattttacagttaatgtaataccatccactcattcaggagtcgggaggaataaaaagttgaattttctaatcagagctcagctgcagtgtctttgtctctacggtcatgccgtggtgtgctctaattttcagtaattagatttacaggcaacaattgacacatgtccagctgccaagtattgtacctgataatttttttcctcttctgaatgttatcatgtaacttaggtgaaaggcttagaaacagaaaaatgacaaaatagtttaaaatagttgctttatcagagttctgatgatattcttatgagctattcttatttggaaatgcaacacttgaagctgtttttgaaaacccagtggggagagggtttttagagggctttgtttcggttacaagaattaaaaatttaagtgccaagagatatactattaacaaacaaagtccatacagtctgtacattttcagtcagaatacactggccttgcaaaaatttcagtattaaggaagtttatgcacagatactaaattatttatcttgttattgctgctacattaagtaatgattttttttcctttttctacctagtagttttgaacaggtttagtgatgatagcaaagtaacaaatttaatatattgaaaagtttccttttgaaaactcaaaagattatataaacttcacaaagaatgaactacttaacccatgttcatgataagattttacaggatttttgacgaacaggaagactgggaaattaataatattcttttaaaaagttttgacaaacatttttaatacaactttgcaatcttgtttatattaaacatacttatcaagatactaacacccacttattgtggcttagtccttgtacatataacgaaacacacacacagaaactggagtttcaaggcttattttcaatatgtataatcctgactctgaagttgtgtcataagtcaagaaataactttcttcaaaaccgtttccaatattgctattattttctgtgaaaaaaggtgaattttcttctacaattatgtttatttaactcaatttcaaaagccttttccaccttcctagtgtacatttttctatcaggttaatatcaaaggccttaatcgtatgtttgctttacgaagatccaaggtatctgtctcttatttttctcattccaggtccttaaatatgactaaatctttagagacagttgtggtcgtatcaatttttaataaccaaaaagtatgtttcattgaagttcttgaaatataaattatgtatcactgtttaccactgctccaaaggaagagctaaaaatcaacagttttatcaacaggggagcttaatatcttgtccatctatgtagtttgcatttacaaaatattactcattttaaatatattttgttatttaatgtgtgattagatttttttaaacaaacatttaaaaaagatagaacgactttgtattttccattagcatttaatttcataaacattgagtgtctattatacaagatatttattataaatttagattattatggatatacctagatataaataaaccagtgtaaattctgaaaatgtgtggcatgttaatgaaagtaatattttttcacaactaaattatatgtattttatatttgcatgctgttctacaagatactttataagagaccactgttagagtgaaatatattcaaacaatagtagataatctttgttatgtgaattatttgtatgttgatagcaagtgttaataccacattctgacttttaaaatgttggcagtttacaaatagctgttccttaaatgcttgataataactgaaaaaggaactaacacaggatcaccagttgattattaaatgagctcaaaccacaagacaaggctgtccgtgtcccaaaacacccattaaatatcttattttttcttcttttgctcatttgaaaatcaggaggcttgtcagaactttgagaaacagtatataatgtaatagggtgactatttcattattttcaagaacagttgtcctacaataatttcctactgtgatacaaggcatatcaggaacttagttttatataaattgatatcataagcaatttagaacactgtggcttatttaacaccttaataatcagtactgttttgtaacttaaaatgaaggattctaaacattgaatacacctagtagccaatattaaataacttgcaaataaaaaatatttttaagaaatgcttggaaatttggagctatatctatttggagggaacttgtaaaaattgatcatttaagaaaatatcaggcctggatttttaaaacatcatttttacactcactcatggagttggtttagagaaactcaacatccttatttgtttgcagtagctatttagaaaataaagtttaaccacatatgattttctagaattaataccacaggcacattttatgagcatgaacaatcaaacagaaggagactcttatttaaatcccaaattccatttctgttattttaataaattcgtgaaattacacaactcttcatggaacatagagaacagaattgttagcaaatgctatacatgttgcacaaattctatcttattgatcaatttatcctacttttgggcccatttaagacgttccatcatagaagctcaatttttagaagttgtcttctactttcacctactagcacttttctgcatttgaccccttcaagccccatcctatgggtcttccgcaagaactccatcaaaaataaatagttacataaatggaaggacaggcagatattttaaaatatctctgtagcatatgcacttgaaggattctaccatttctacttcttttccaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggccacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggcttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggacaacatttttctgtgattttccctcctttagaacccatacacaacttatcacttgctaaggagaactgtactaaaagttattgaatgtcttaagtctttacactagaaaaggtagaccaactggaaaactagacatactctcttgatgattcagttgttttcatcctttacccatgtcccgtccaccttggtgcctagtatttctgctttaaaacaaaataaggacaactttttttttttttgaagattaagcctgaaatttcagtgtgaatttcccttaatgtccaatcttccctttttctcgacattaagtcaaatagttgaaggacagagttcagaagtagcaatctgaaaacatattttagctctaaagttttaaaagaaaatgccaccttaaaaatgcttaccactaatggatttttaatcacaaaatgaagcaaatggttaaataatacacttcccaaaattatatcataaatacactaagtgtaatgtggactttttctccctgagtgtaagaaatgtaaaattacaaaatgtttaagcattaaagtgcaaatatcaatctttaggcaatgaaaaacagcgagacaaatgtataaattacatataaaggtcataactatttcagaatttgcagaataataaatgtagaaagttttaaaataataaatgagcaactcccacaaatggtacttaatttccacaaaactttttagtaaaagagtatacaatctttttaggagcacatttacctaaaaaaaattttttaatttttaaattttttttaaggaagtagaaatattaaatttccaagacaattttctagcatctactacttggtcattttaatttacacttttcaacaacagatttcaatacagttatcatttgcaaattcatacatactttattcatcatctaccacatgatcaaagatgttttatgtgaacgttccctcctacttcataagctctctgccctcactccaaaaagaataaaatgcctcaaggtttattgaaggacatggttctgatgcctgacctaacaaggattggaatggctgggtggcaggcaagtggttttcaataatttattttccatgatagtataaaagaatatagaaagaaaagattaatccttttaattttgcagtaaaatttacattccctaagtgcaaaaagacctcatcctctgacacctttaaccacaaattactaaataaatttatttttgatggcaacaaaattgaaacacttatttaagaaaaacagagattgaggtggttttgaagtaaaagtgtcatattttggattctaaaatggagtcaatatacaaaatatactactttgataagccgaatattttttaacagaacactaactgaaagtaatttttttaaaaaaccctcttacaagttacaactgtaaagatggacggtcatgattttaaaatccagtttaatggacttcacagcatccaacatgtctcggcatttactttatttaatagaataaaatttccctttagagatttcaaatataaaagcataggacattcataaagcaaaagaggagttacttctgcagttgctttgttctcgggtggtcggagcacaatagagggagaggacgctctatcttttcatcagtctaaaagttgttaggcattaaaacatcgccatattactctagctctgtgcgggaagtagctttgctaatctaagtattttagaaatgagttatgtggtcccctctaggaaatatgaaaagccattattcaatctcaaaaacctcaacaatattctgtaagcctcttgaacatgccgaaatgtataggatggatgaaacggtgctgctggggacctatttttcagcgacctgaggtggggagggaggggtctgaacttattcagatgcagagagtggggatgcaagtgctaattaatggagtgtccagagctccaggagacgacgctgttgtaaggatggaggatacaaagca

SEQ ID NO: 16553 - DNA, 94142 bp, Human
  misc_feature (1)...(94142): n = A,T,C or G
aatcactgcatttttagaaaagataaatccaatgatgctcgaccttgcctcttcctgcacatttctgacaggattagtgactatgcctccataatctataaacatgtgtactcttccacctaaaccttcatgagattttgctctagtgtaactcctgagtacattttttcttttttattagagacaaggtcttgctctgtcaccaggctagagtgcagaggcacaatcatagttcactgtaacctcaaactcaggagtcccagcaatccttttaactctgcctctcctgtagctaggactacagggatgttctaccacgccttgcttttttatgtgtgtgtggagacagagtcttgatatgttacacaggctggttgtaaatgcctggcctcaagcaatccttctgcctcagcctccttaatcactgggattacaggcccagcctttctgagcacatttgatttaacttccaagcacatgcagagcggccaccacctgtatagaagctgcgggctgaaacactgctttggagcagtctaaaaaaaaaactctctgactctcccaggtggcagtcctcaataagacttctgaagaaagctaacttgaattatttaaaagcctgatttactttagtttacatattttacagttccttcccattagaatgcaagctcccccaaggcaaggctttaaatttttgttgtcgttgtttagacagggtctcactgtgtcaaccaggctggagtgcagtgttgcaatcacggctcactgcagcctcgacctcctggactcaagcgttcctcctgcctcagcctcctgagtagctgggaccacatgcacgcatcaccaagcctggctaattttaaaaaagaattttgtacagacgggggtctcaccatgttgtccaggctggtaccaaattcccaggctcaagcaatcctcccgcttcggcctcccaaagtactaggattataggtgtgagctatcactatcacgcccagcctaaggcaagttttgttttgttcatggttgtattccttgcatttggaactcagaagaggcctcgaaaaccttgaagatacagtaactatcaacacatctccctgcttcacgtctttccccgctcattcgtatgtatgagctatgatctcttaccccatggtgtcagtatagtgcatcttactaatttcagctgctttttagctttcatttatgtttgtatttccgtcacattttacattgctaaccaaagaccactgctagcgggaaaaactgggaaaggagacttgaaggcagcagacgctgcagctgctcgataaaaattggccgaatttaacaggaggctggaggagctaaaaaacgttttcacacagaagagttagcacatccagactggtctttttagcactttcttagggcttgaggatgaaaccccaccactgtcgggccgactgtagggtagagaagagccaattagtatttgcggcgctcgggagcagcgtccatccggcgggtgtaggaaaatacttccggcgttctggttttttatgtgctgagtcacagccgaaggctcgccccgggtctgaggagtagggtacccaaactatgacacgaatgggaaaatttaaaactttggaattaattctctgcactcgtttctcagttttctcattaggggaatatttttctttgacacgcggagcactactcagtggtttccacaaaacacactcgtacgtcataaacgcgccgggggcccttctcccgtcgtcctccgcgccactctctccgcttcttctccctcgccccgcccactttgggtttcgaaatgttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccggtgagggaggaggcttgcaatggggaggcgaacagtgtgccggcttctctgtcggtgccgccgtcacttcttgtctccatgtctcccaatggagcaacagggcacactttccaccccaaatgcttccttgggtggaggtggcaagcgtgattagaggcttccctgtggtgtcagctgggcaagtgggagatcttgggttgtaagacgtcagaatgggagaagcttttcgagtcatttgaatacagtcgctaaagcaagaatgaaggtttctttgaggaacgcagcctgaatggtgagggagtcttggtattatgttaccaggaaaggttgacggagttggatactttaatttggaggacaggatatttaaggggcatattatcactatccaaaatatttgagggacacttaagtgataggtgaaactagtggacgaaagttaccagaggatggtgtggcttcagtaaagtaactttgcatcatatttggcctaagttgaagtgacttgtttccatgggtagttctccattaccaaaacggttgggcgacctcgtccaggaatatattagagagggcttaggtctcagttgggtgagttgtaaggtttcttctaaccttgaaattctctacttttggtttgtacaggagttctctaaacatttctaataattggtgattcagtccccacctgagtattttccttcagaggtagcttatttcatggagtatcatgactatgatgtatcttgcgtgtgtgtgtgtgcgtgtgtgttttaataagagtctgggtcttgcgatgttgcccaggctaatttcaaactcctgggcttagggaatcctcctgtcttggcctcccaaagtactgggattacaggcgtgagccactgtgccaggcctggactttgatgtattttaaatagagttcatattgtccaataacttcgttgaacaggttgaggaaattgagacccaaagagtttgcttcttgctctgaatcacacagctaaataataacagagctggtatgatgacccctactatctgacaccaaattcagtgtatcatttgctgatttcctttttttttttgaaacggagtcttgctgtgtcaccaggctggagtgcagtggcgcgatcttggctcactgcaacctccgcctcccgggttcaagcgattctcctgcctcagcctccccagtagctgggactacaggtgctcgccaccacgcccggctaattttttgtatttttagtggagacggggtttcaccatattggccaggatggtttcgatctcttgaccttgtgatccgcccgcctcttctcccaaagtgctggggttacaggcgtgagccaccccgcccagcccgtttgccgattttttacaaatttcttgcttatgtgaattgaaagctgaaggattctagttctaaatttgttataagcccctacagcgttagcgcaagaaacaaccttatagataatcttttccacttcccaccacacctctttgacagatgacacttagctccaagttcaggaccaacctaatttctcctttcacttcaagtctagatatattttctccaggctgccagagtcaagagatctttataaatgagctaaattttctttctcatcaaagatgtgattgtacaggttgagtatccctaatccaaaaatccagaatgctcggaaatccaaaactttatgagcgccaacatgacaccacaagtgaaaaattccacacttggcacctttgctttttgatggttggttcatgtacacaaactttgtttcatgcacaaaattattaaaaatattgtataaaattatcttcaggttatgtgtataaggtatatatgaaccataaatgaattttgtatttatactgcatcccatccccaagatacctcattacgtatacgcaaatattccaaaatccaaaaaaatccaaaatttgaaatacttttggtcccgagtgtttcggataaaggatactcaacctgtattggcaatgtataaatgagcaagttgaaaacttgataaaaggtgcttagtttttgccttccagatcaaatgttcaataatggtttcagggttttttccagcctatataaagttatataataactaatatttatggaatctacactgtgtttcagctactgttgtaactgttttagatgtgttatttcatttactgacctcatttttggtaaatttgtttgataaatacctgttaagtcctactgtgtgctaggcaccaagctagattaaatattttctgaaacttggtcaaatataatgtaataaataacatgttagtctgggtgaatatacaaaaatgattgagccagtacctgcctttagggagcttacaatagtagagagggacacagacacataaaaaaaaaaattagagactgttgtggtggctcatgcctgtaatcccagcacttggggggccgtgttgggaggatcacttgagcgcaggatttcgagaccagcctgggcaacatagtgagcccctgtctctacacacaaaaaattagccgggtgtggtggtgtgtgcctgtagtcccagctacttgggaagctgaggtaggaagattccttagcctgagaggttgaggctgcagtgagccatgatcgtgccactgcactccagcctgggtggcagtgagacactgtctcaaaaaacaaataaataaaactagggcactaaagttttatagaagccataacggaggtatgtcctagatatattgaggaatgaaatacattgataaattccaccgggggagaaaggaaagacttcaaagagtagataatgcttaagagttgttctttgaaaattgttgcgtttttgtctttatatggcttttgccaagtcattgtccttcttagtgtctcagcttattttaaaaacgaagggggttggttagaacagcagtgtttttcaataaccctcccctttcagaagagcagttcttccatattacctgttttatatactggagtttcaattagacttttgaagaaaagatgttattagtttaaaataaaggtggaaagcctcaggactaggtgatctttaaagacttatccaaattcaattctatgaatttttgtaaccagaaacacacttagacgcatctgcagcccacagagctgaattatccttccagattctgctgagatattccctctgtgaagtctttctaggcagaactaattcctccttccattgtatttcagtaggattttgtgcacgatccattacagtacatagcatcatattatatatcttttgaataagtaccagaggaggacccatttagaggaatattgtggtgaaataataccttgaaagatttaccagtctgcatttattaatagcctgcggaattttacttcagcatatgtgtaatttgtattccgcttttttgaaatgttgggcatatttccaggacacctattatgcttttttagggatctgtattaaatgcttaccaagtattgattcccttcccttctggaagggttaagggacttcaggttgggaattgatattcaaatttttattggtgttgagtggaaattctggttgggcaggattagtagtggtgtattctatttattttttatttttatttttatttttgaggcagggtctcactttgtaacccaggctggagtgcagtggcgccatcacggctcactgcagcctcgacctcccaggcttaggtgatccttccacctcaggctctccagtagctgggactacaggcacgtgccatcatgcccagctaagcttttgtagagatgagatttcgccattttgcctaggctggtctcaaactcctgacctcagatgatctgccctccttggcctcccatagtgctgggattacaggcacaggtgagccactgcacctggcctggctgtggtgcattctgaatagtaaattttaacaatgaagaacacttaacgttaggtattttggattgactaaaacaagtacagagcactttccatgtttaacctgctcgtaaaaagacctgtatttctatggagaaggaaagaacaaatgaaaaggtatgtaaacttctttttttttttttttaatgattaaaaaaaattttgagacaggatttcaattcatcgcccaggctggagtacagaggcaccatcacaacctgccccaccatgtccggctaattttttgtagaaatggaggtggtggtgggggcaggtgtctcaccaagttgcccaggctggtctcgaactcctgacctcaagagatctgcctgcctctgcctctcaaagtgctgggattacaggtgtgagctaccacgccctgtcgaaaaggcatataaacttctgaagggcaagtccttctaatttaaattttggtcagactgttacaagtgaggagatggttatcttaataaattttcaggctgggcgtgggggctcacgcctgtaatcccagcactttgggaggcggaggtgggtggatcatctgaggtcaggagttcaagaccagcctggccaacatggtgaaaccctgtcgctactaaaaataaaaaaattagccagttgtagtggcaggtgcttgtaatcccaactacttgggaggcagaggcaggggaatcgcttgaacttgggaggcagaggttgcagtgagctgaaattgtgctactgcattccagcctgggcaacagagcaagactctgtctcaaacataaataaataaataaataaataaataaataaataaataaaaattccatatattatagaaaataatgggtgggtgtgtgctgaataaggtacaggctatttctgaatattatgttgtttactattatatgctgtggaacaggaggaggatcacaattccagtgagtggaacagttgcattgagaacactaacatttgttggcttcctgaatagtttgctagtgaagtggctcacttctgagcagaagccttttgctcactttggcagcacgtatactgagcagaagccttatacaaatctgaggtatcagaagaaaactatacaccagaaaacaagagaacttttttttttgtattggatgggaagaacataggtttatttgttgatatttacaatgaaaactcctggaaccgtaatgcttcattcaatacatgagccagtaatttcatttgtgtgtgtttcatttcacacacacacagacacacaaatattgctaaaatgatcacaaaatctcacagctacaaaagaaatcattatgacttccatgtgtgtaaattccatgagattgacaattccttagtctgataacaaatgaacaagtgaatccaaatttctttttgttttgcactctcacttgtcttgtaaagtaaaggtaacctaggtattacttcacgagattcaaactcatttaacaaagtaagtgcttttaagattgaaatatgttaaatcttatgaatactagtataactttaataaacatatcttttgtctcttactattccttagactgatttccttattttgttttgttttgtgtttgagacagtctgggtctgtcacccaggctggagtgcagtggtgtgatctcaactcactgcagcctccacctcccaggttcaagccatcctccccaccttggcctcctaagtagctgggactacatgtgcacaccatcatgcccagctaatttttgtccttttttgtagagttgggtttcgctctgttgcccaggctagtctcaaactcctgagctcaatcagcccaccttggcctcccaaagtgctgggagtactggcatgagccactgcaccgggcctgactgatttctttaaagtgggctgatgggctagtaagaatagaaagagtgtatattgtttctaactgaagttgtgtgtgtgtgtgtatgtctgtgtgttttaggaaaataagatttagcattaaaaagctctctgttggccaggtgcagtagctcacacctgtaatcctagcactttgggcggccaaggcaggaagatcacctgcctctgtctcaaaaaaacaaaaccagaacaaaaaactctctgtttttctgactgggcgccgtggctcacgcctgtaatcccagcactttgggaggctgaggctggtggatcacgtgaggtcaggagttggagacctacctggccaacatggtgaaaccctgtctctactaaaatacaaaaattagctgggtgtggtggcggatgcctgtaatcccagatactggggaggctgaggcaggagaatcgcttgaacccgggaggcagaggttgcagtgagtcaagatcgcgcccactgcactctaggctgggcaacagaaccagactgtctccaaaaagaaaaccaaaaaacaaacaaaaacgccctgtttttaaagaactgaatgatggtaaaagctcttttgcttttaagaagcttatgatctgctgtaggagagtcagggagcagatactgaaactgaaatgcattaaatataataggtgctagaatagggatatgtaaagtatgactttttgttttgtcatttgtgtttctagcttgctgtctactggttatgtgacctttagcaagttaactaatgtctctaaggctaaggatcttcataaggacacagaagaagagcaacctataaacaattgaaattgaaaaggagcagttgggaagcaggtgatagtggcttttttttttttttttttttttttttttaatgaaccagtggaggagaattcttgaagcaaggagtgatgatagataaaactgagaggtcaagcagtactaggactgaatcccttttggagactcgagaaattattactggtgaaagcagtttcaaaggaatggtatggaggcagaaaccaggttgtagtgagttaaggatgaatggagagtgagaaattgattgactgagatggagtcttgctctgtcacccaggctggagtgcagtggtgtgatcttggctcactgcaacttccacttcccgagttcaagcaattctcgtgcctcagcctccaaagcagctggggttacaggcatgtgccgccatgcccagcttatttttgtatttttagtagagaggggatttcatcatcttggccaggctggttttgaactcctgacctcaggtgatccacctgtctcagcctcccaaagtgctgggattgcaggcctgaggcaccacgcccggccaagagtgagaaattttgaatgatgaggtacacattgtttggttttaaaggggaagggatgagaggagattttaggataaaaacagtgcattgtagcaagagagagtttttttcaagatgaataagaggtgagcatgtcttgcttgagaaaaaaagaatcagtagagaagttgaagatacagacagtaatagattactgtctgtattagtaataatactgtcagtattagtaattattaattactaattattaatactgtctgtattcataataataatagattcttagatagttgtgaggtgacaggattaatcttaagaacatacccagagaggctcattttagagagacgagaaaatatcttcacttaaagtgaaggaagtaacgagtatggatgcaggcagtgaaaacttgaaagggtgactttcccctcttatttgtaaagtagtcattgaaatgtacttaggtggtcctctggggaactctaagggaaatagtgggatgcataggggaagccttgagtgtgaaggtttgaaatagctaatgtagaaaatgggtgaagtgtatacgtggtaaatactaagaaaatttgtgggttcttgagcatgaaaatgataaaagtaaagcagtattttaagaataaagcagtagtttaaatctataggatgtggaagactggcttaagagtcagttataattgtgtcagttgtgttgacacaaatggtactagtctttctgtagctgatgtgttcccctcttcacttttctttttgctttccacttaattcactttaaatgtttgctaggctaaatgcccgtgagtacggagatcatgtctgttttattcactcaaggtccagtacattttaggttctcaaataatatttgtagaatgtatgaatgtatgagtgcttacatgccaggcattttcacagaactcatggggatattttgccagaaatttcttagattaaaattgtattctgaagctgggcacagtggcacatacttgtaatcccagctacttgggaggctgagatgggaggatggcttgagcccagtagttcaagaccagcctgggcaacaaaatgagatccctccatctcttaaaaaaatttttttaagtgtattttggccagttttaaagcaattgattttcagagaaaatgaatatggacaggttacagaagtgcaaatgatacaaatactacaaatgcgtatgctgatattgtatattttgtgtggaagcttgtgcttggcatagtaagcactcaaatgttagctattactgtttatatattggataaggccatgaataaagctggctttgtagcattttttgtagtagtaaaaagttggtacaactttattttccattggttgaataaagattaaattatgttacagttttacaatgaaaataatacatagctataaaaaaggataggtgattttatatgttgaaatagagagatcttctctgatttattgttgaatgaaaactagtggcaaaacaaaatgtataattccatttttaaaaggaaaaaacattactgttatatgtttacttaaattatagtttttcacgtattcatatatatgtacagaaacgattagggatggtattcagcaagctcatttctctggggaaaggaaggagagatttgacttttgttttatttattttttagtaattacaagaagataagtgttaaataacaataaagaagtattatgtggtcatcacagggaaggaactttagataaaaagaaaatttaagaattcctggctgggcgcgctggttcatgcctgtaatcccagcatcttaagtcaaggcaggaggatcgttggagatcatgagtttgaggccagcctgggtaacaaaacaagaccctacctctacaaaaaattaaaaaattagctgggcttggtggtgtgcaccaccaaagctggtgtggtcccagctacttggaaggctgaggtaggaggatggcttgagcacaagagtttgaggttgtagtgagccatgatcacaccggtacactccagtgtgggcaacagagtgagaccctatctcaaaaagagagaattctccataattattctaccctgcattaaccactggtaacattttaaataatttcaatgccttattttattttttgaggtggtggctcactccctctcaggatgcagtgcagtggtgtgatctcaggtcactgcaacctccacctcccaggctcaagtgatcctcccacttcagcctccttgagtagctgggacgacaggcacgcaccaccacacctggctaatttttgtagagatggggtttcctcatgctacccagcctggtctcgaattcctggatcctagagtcaagtgatcctcctgccttcatctcccaaagtgctggaattacgggtatgaaccactgtgcccagccagacagtactgttactacatgatagatttaagtgctattctatgaaaatacattactgaggaggtactaagcagtaattagagtataaatggattgtattctctcattttattccttctaacaaacttctcataatggcaggtaatgtccaaggccttctattttgttcttaacgttctatcttcatcttcatcttctgttgtgctattttgtgcttcttttcttggcacatgttttctttggtcatatttgccttttgaattcatgcatgagtatctcctctcttttctgttttctttcaatcgtcccttcccacatgtagttagtgactcttgtgtggccctctagcaatgttttttttccaagcgatttcatatttttgtagttattacttgtctttccacgctattatgttgaattttttgaagggagagaatttgtttctttgagtctttgcataccttctcttctgttagtaataaatgaatagtctgtactcctaagaccttatctctactctccagttgtgtactggatcccatctccttacaccttttatgttccactaattattccagcaattgttctccttccatcctgcatcatcagtttgtcttttactggatcatccccgggagcatacaaatatgctgtaattgtttccatcttcaggagagaaaatttctttattctttatccccttggagctatgtccttctagctattcagtttctctggtaactgtagcaaaacttgttgagttatctgtacttgcagtttgtaattcatctgtttccattattctgtaagctcactcagagtagacttctgccactattgttacactgaaatagctagttcaaggtcaccaatatctttacattagtcaattctcaagttatcttactcaacctatcagcatcatactgcatagttcaccattcttcttgaaatgctttgatcagttgactttcaggtcaccactgttcatagttctcttcctgcttattcacagatctcttcttatttccctgacttctaaattttggattatctagggctcaattttcagacttctcatctacccttactctgtatgttgtccggtctcatgactttaaatatcagcctgtataaaataaattttgttttcctacctccatgttttttcttactctttttttttatagcacttattgtcatttgacataaatttacttgtgcattgtctttctcttgcagtggaatgtttcatcacaagggcaaggaattagttttgtttactgcttatatcgccagtgcctagaatagtgcctgttttaaagtcttgcttccatttctgtcttcttccttttctcctttggcttgttacataaggatatacttttcagtctttttttttggttactttatttcttgctttttgtctggatcaaaacataatgtttaggctgggcacagtggctcatgatgcctgtaatcccagtgctttggtaggctgaggcaggagtattgcaggagcccaggagtttgaggttacagtaagctatgatcgcatcattgtgctgcagcctgagcgacagactgagactctgtctttgaatatatatggcatatatgtatatataaaacatacatatatatagaaacaaaaccttacagataacagctgaagccctctttatattgcctcttcccattaccttctctgccttcttttttcagtgttaaccactatctaaatttcatgtatataccgtactagttctatctatagttgtatactttttattaaacatactttttaaacagtatatatcattgtttttgcatgttttaaagcattatagaaatagaaaggtatcacattagatgtctcataatctttttttttttttggtttaacattgcttttgagatttatccatgtcaataagtgtaattctagttatttgtgttaaccaatgtttaatattttgttgatgaatacatcgttattatctattttcctattgtcatttggttacagttttctgttatattttgttttatgactatgccacaatttagcttttttctttttgtttttcatttaagttgtttctagcatttcagaggactgtatatggttccttgtgcacacgtttgagaatttatctagggcacatacctatgagtgaaatgatacctataagtgaaatgactgggcatactcatttttaacctcactagatattgccattagtactcttctaatgggttgtgcttttttacattgacaccaatagaacatgagagttcctgcttctttacgttcttacatttttagcagttattgatactgttagtttttttcttttcttttttttaaagataaggtctcactctgttatccaggctggagtgcagtggtgaaatcatagcttactgtaacctagaagtcctgggctcaaggggccctcctgcctcagcctctggagtggctgggactgccaccacgcccagctaattttaagaaatttttctttttttttttgagatggagtcttgctctgtcgcccaggctgtgcagtggcaaaatcttggctcactgcaacctctgcctcctgggttctagtaattcttctgcctcagcctcctgagtagctgaaactacaggtgcctgccaccatgcccagctaattttttttttttttgtatatttagtagagatggggtctcaccatgttggccaggatggtctcgttctcctgacctcctgatccgccctcttggcctcccaaagtgctgggaatacaggcgtgagctatcatgcttggtcgatattgttaggttttaaaaaaaattactatctgtggaaaattgtatttctcacttttttttaaaggttagtcaagtgaagcagtgggagtggagaaggcatcatttagttgtgaataccactgaattcagatcagcctatatttttctttcttaaaaaatctttttaggctgggcgcagtggcacatgcctgtaattccagcactttgggaagccaaggtgggcgaatcacctgaggtcaggagtgcaagaccagcctggccaacatggtgaaaccccatctctacaaaaatagtaaattagccaggcatgatcatgggtgcctgtaatcctggctactcgggaggctgaggtgggagtatcgcttgaacccggggaggcggaggttgcatgagccatgatcacgccattgcactctaacctgggtgacagagcgagactccgtctcaaaaaaaaaaaacaaaacgaaaaacttaaaaaatttgtatttccccttattactaataagatcagacattatttcatagtttgtagacatcaggatttctccttttataaattgcctgcttttctattgggttgttttttctttttataaatttgacttgtaaaaattcattttattttgaatgctaattttttgtcgattatatgagttgcaaatgtattctctaagtccatagcttatgtttgctccttgtttataaagtcaaacattgaatcagttattgatcttttatggtttgcactttttgtatcttattctaaaaattttattatagttttttacattaagaaatctaatttttttttttttttttaagaccaggtctcactccatcacccagggtggggtgcagtggcatgatctcagctcactgcaacctctgcctcccgggttcaagcgactcccacctcagcctcctgagtagctggaactacaggcatgcaccaccacgcctggctaatttttgtatttttagcagagacagggttttaccatgttggccaggctggtctcgaagtcctggcctcaagtgatctgccctccttgtcctcccaaagttctgggattataggtgtgagccaccatgcctggcaaaaatctaattttattactatttaaaaaaaaatatggataaccagttgtccagtcatacttttaaaaaagtataaatcccagagatcaccaaatattttctgtaaaagttctagctaataaatactttgggctttgtcagtcaggaggtgaaattgaggatattaagtaagtacttgtatatcaaaaaagaaaacaaatttctgcaaatttttggtgaaaatttttatgaagttcaaaatatagtatgttttttggtaatacagttctactagtaagaatgatggaattgtttttattgggataacattttgctttattgggatcaaaattaagtgttcatcagtcagttcatctgttaaatctgatttgtaatgagattttacataccttatctttgaaaatgtctttccacatagctaggtaccgccaatatattaatattgaaatactaatagcagtctatgagtacagatggtccctaatttatgttggttcaacttagggtttttccactttccatggtgcaaaaaagtgatatgcattcagtagaaaccgatctttgagtacccatatgatctttctgtttttcacttcagtgttgtatcagtaaattacatgagatattcaacacttcattataaaatagactttgtgttggatgattttccccaactgtaggctatgtaagcattctgagcatgtttgaggtaggctaggttaagctattgatgttcagtaggttaggttaaatgcattttcaatttacaatattttcaacttaagatgggtttttcaggacctaaccctgttgtaagtcgaggagcatctgtatatgactttaattgagcatattctttgcttggaaaacatttatataattatattagattcttctcatattttttccttttaacattattatagattaaatagatcaaacactatagatcagtcacttccaattaaattaggtgggatctcctcaattgcacagttaatggactttgaaatatggaagtttctttgtggttgcaacaaggtctggaaggcacttctgaaactatagtttgtgggggaatggaggtattacttcttgttttaactttttatagcacaggaagtatatgacgtagcttgccattacttgtgattcaaacatcattcttgattgaaatgacttaaatgctgttttgtcttgtaattttaggttgagttcattaaagaaacattattaaatctgcaccaaaagctaatttttttttttcttgagacagagtcgtgctctgtcacccaggctggagtacagcagtgcaatcttggcccactgcagcctctgcctcccgggttcaagtgatccttctgcttcagtctcccaagtagttgggactacagacgtacgccaccatgcccagctaatttttgtatttttagcagagacaaggttttgctgtgttgtctaggctggtcttgaacacctgatctcaagtgatccgcctgccttggcctcccaaagtgctgggattacaggtgtgagccaccatgcctggcctcattttgaacttctctgaagaaattctacagtgatgtgatactttgttttaaattttctactttttctggttattgcttgttttttttttttttttttttttttttttcctccacacagagtctcactctgtcatccaggctagtgtgcagtggcctgatttcagctcgctgcaaactctgcctcccaggttcaagcgattctcctgcctcagcctcccgagtagctgggattataggcacgtgccaccacacctggctaatttttgtatatttagtagagacagggttttgttgtccagctggtctcaaactcctggcctcatgtgatctgcttgccttggcctcccgaagtgctgggattacaggcatgagccactgctcctggccttttttttaagacagggcctcctcagtctgttccctaggctggagtgcagtgtcatgatcatggctcactgcagccttaacctcctggctcaggtgatcctcccacctcagcctcctgagtagctggcaccacaagtgtgtgttaccacctcgggctaattttaaaaattatttgcagagatgaggtctccttttgttgcccaagctgatcttgaactcctgggctcaagcaatcctcccacctcagcctcccaaaattctgggattacaagcatgagccaccacactcagcctctttttttttttcttttttagagagatgatctcactgtgtcacccaggctgtactgcagtggtgccatcatagctcactgcagcatcgaacttctaggctcaagtgatcctcctgcctgtgccgcccaaagtgttggaattacaggcatgagccactgcttctagatggatgtcttttattggcgggggggaaagccctatatacgtatatatgtattttttactaattctaaaactgctaacccaagcaggacaaaatttaattgaataccaagaaaataaccatgccagattttcatgctaaatcagctaatactaacattgtttagatacgcaatttgaatgaactccatggtccaaagtcaaattacctatgataactcattctaataaacagttctatgcatctaaattggagagacaaaattggcatttaggaggatattaagtccaatgttatccatggactcatggagagctttgacccacctggcccttcctgagtcgtcgaagtttccattactaaaagctctgcagtcagtgactcatcatagatgagactaagtaatcccaattgcatataaatgtgtgcgtgtgtgtggcgaatgttctaaatgcgaaaatggtttatgaccaatgtttggtttgtcaaacccataatcaatcctgagaagataataaaaacttcaggtatatttctgccctggtgggccatttaaacatttatagaggtattttcttcacttgtcattttcagtgtatgttttctggtggtacagaatctttctcatgtagccaggcacagtggctcaccacttgtaatcctagcactttgggaagccaaggggggcggattgcctgggctcaggagttcaggaccagcctgggcaacatggtgaaaccacgtctctactaaaataaaaaataataataataataataaaaagccaggcctcatggcatgcacctgtagtcccagctacttgggaagctgaggcacaagaattgcttgaacctgggaggcagaggttgcagtgagccaagattgtgccactgcactccagcctgggcaacagagcaagactttgtctcaaaaaaaaaaaaaaaaagaagaagagatttgattatctctgtggcagagtgagaccctgtctcaaaaaaaaaaaaaaaaaaaagtaataccacttgggcagccgggtgcagtggctcacgcctgtaatcctcatactttggaaggccaaggtgggtggatcacctgaggtcaggagtttgagaccagcctggccaacgtggtgaaaccccatctctgctaaaaatacaaaaattaactgggcatggtgatgcccgcctataatcccagctactcgggaggctgaggcaggagaatcacttcaccatgggaggcggaggttgcagtgagccaagctcgtgccactgtattccagcttgggtgacagatcgagactctgtctcaaaaaaaaaaaaaaaagaagtaataccacttggaacatctttgtgcatataatttttcatactctggacaacttaattgggaaatattaacaaaagtaaaataggtctaattaataaagatgtttttaaggctgatagtgtcccacactatctctcttgtaatattctagctactatattataaaggtggtggtaagaagagaaaggaaggttcttgtaggtagcacttctctgttccttattattctagacacgtaagtttatactgtgaataaacatattttcggttttgatttaaagtcacccccagaaaagtaatagtaattgcaacaggaagaccaattggaagaaagcttttactttctactggggatgaaaaagtagatagaagtaaactctcccggtgaccaaggtgtatgaaatgccattttaagctagctgtagtggccagaaggcactgggagagtcgagtaagagaaagaggtggcagtctctataatgagctagctgcagcagcaatgaacacagaggcagctatgagtgtgaatgatagacataagtctgtatacaactgtagttaaactgtctccagataagaaagttctagagcaactatcctatatttttgaagaaaaaacaattctatctggggaagttttattcttcagaaagaaaaacttacggaatgggaaaatcaaccctatctaaatcaaccctgactagtcaacccaagtcaactctgagtatctctgaggtgaaagatgaagcatgctgatgggtgtcaaatccaatcttgtatgaataaaataagcatcggggaagcatagatgtcatcttctaaggcaaacattctgaggatctggcagcataaatccatcagttaatttataatataattggacaccactatggccaaagtaaaagacacggccaaatctggatcaccttacaattttcaagatgctttcaagatcccccttgtcctgttatggctgagggaagcagtgatgggagtaggcaccatagtctgtaacccctccccttctgtctcggtacagacaaagcagataagctggggctctggtaatcttacacagtttacttcatgccaatttttatgctccatgagatccaggtaaactgagaatgctgtgcatctcctacatctaactacatcatttctaaatacttagaaatattttaagttttaatacttagaagtattttaagttaccgtaaagactttgaaactgtgacacaggtaccctcccctctgatgtttttcctagtcatcctgggtctcaggtagccacatggcacccaagatgggtatgaagggcaggtcctgtctgagtcctgaatttacgcacagctgtagacctcatgacagaagacagaaatgggaagacattgcctggaggacggaaccctcccaaaatagccaggaggcaaagctagggcaggggaaaaggggatatattgggcttgattctgccttgcagctggtggcctaggcattgagaatgtgtcctcatgcctcactgtgggcatacatccagacctctgactccagaggctcaaaaccaaaaacaagcaagcaagtatcaaattatatttaactgataattttgaagccatttctattttagtaacaatttacaactacctttatttactaaatattacatacaagtaacacatatagacacagacacaaagacagaagcagatattatagcttacataaaggattgtcatttgctggcttttgaatagtttttcttttccccattcagactatcattcttccattacctgtttcattgccctaaggagttgttagctaggcaaccttaaatttgcatttctaatgggacaactcttaggtgaaataaggtagaaaatttatatctcaaaagcacaacctaagactttaggcgtacatattgtaccctcatttgctcaaaccaaggaaaaaatgatgtgagtaaaaaatttcagttaagatgtccagaaaagcaccttaaacaaaggtttgacttgttacataaatttaaaactatggtaaaagtttctaatatacacaggcagacacccttacaaatggagatttcctttatagatgtaaatttcttttacagaagagtttcaggatagccagttaaatgccaggaaggtatattttagttgggtaggtggtttatttgacttagctactgtttcttggctaaaattactgagttcagggtagatggagcccattgaggaatagggcaaagaaaacagtactctgtgcttggactcagactggatagatctaaaaaagaagcaagtctgctttacccactggtttacattttatcaacattttatccaggatatcgttattttcactcttgaggcaggatagtatttatgccaaaagtttagcagatttaattattcttgtgaattattcacctgagctttttatttgccttttttttttttttttttaaagacagggtttccctctgtgtaatcacaaaggcacagtcacagctgatttgcagcctttacctcctgggctcaagtgaatttcccacctcagcctcctgagtagctggaactacaggtgtacaccaccacatccagctgatttttaattttttgtagagaggagatctcactatgttgcataggcttgtcttgaactgctgtgctcaagcgatcttcctgctttgatctcccaacgtgttgggattacaggcatgagccaccacacctggccctatttgccttttatgaagtcttttaataaagcaataaaaatattgaaatgtttttagaagcttctgcacatcaataggcatccttgaagactaattcaggacccctcatttttaagtgctgtgttgttcattaggaacggtccattgtaattttaagttacaaagattttgccatttctgtaagtagttatttcttctgaggcctaatatttatacattctaccttatagctagaaggtagaatacggtgttcttcagatactaaggatccaatatttccctagaatcctggatttggtcctcagatccccttcatcaatttagttaatgatttttccctacctaagggtacaagaaaaagaatgtagaacacaaaaatctctgcaaatttctgaagtctgcacccactgtaatattaccatttctgctagtttctgcctgatcctggacatctgcagcctcttaactgaatccaagtcagttaattatcagatccaatccaatcatggatccagtccagtttctgttgtgacttccaaacccagttcggatcagaagtttgctcaaactcggttccaaacagaaatctgtcgagcttcagaatctcagcgagaacttaccacgatatcagttgcttccagaaagcaatggacatcgtgagtctgaggggtaccttgcttggtcactccatgctcctgggcatgacatctgttgaaaaccttagacatattaaatttaacagagtttaactgagcaaagaatgattcacaaattgggtagcccaggaaccagaataggttcagagaggctctggtgcagtcccatgattgaagatttatggacacaaaaaggaaagtgatgtacagaaaacagagatgaggtacagaaacagccagatttgttacagttcgggcatttggagtatttgaacatagtttgaacagttggctgcctttgattgactgaaactcggtaattagcacaaaagtaggttacgatctgtttatacatctagttaagtttcagttcactgtgtacagagaaacctttaggccaaacttaaaatatgtaaggaggtggctttaggttagacttaatttaacagatgttatatatattggttttcatccactgttcctgtcttgtaactcccatagcccttgttaaagtctttttgttacaatgttgggtgtgtcaggtctcatgtgtctagacttaatttaacaaatgttacatatattggttttcatccattgttcctggcttgtaactcccatagcccttgttaaagtctttttgttacaatgttgggtgtgtcaggtctcatgggcaggcctcaggaaacagaatttctcagactttctcctatccatctctcatctgccccaagacaagaccctataatcttccctgcctttctgattgggagttataagaccctcctcagagggcgtcccaccctatccttggaggaaggaatgctgatattttgaaatttccataaaaacccaggaggactaggttccagaagcttcaggatggctcaacacgtggaggttcttggagggtggcctgcacaggaagggcatagaagccctgtgccccttcccccatacctcactctgtgcatctctttatctgtaatatcctttacaataaaccagtaaatgtaagtgtttcccaaagttctgtgagccctccagcaaattaatcaaacccaaagaggaggtcgtgggaaccccaacttgaaagccggtaagtcagaagttccagaggtctggacttgaaactggtatgtttgtttgttggcagggcagtcttggggactgagccctcatcctgggggatctgatgctatttccaggtagtgttggagctgatttggaggacacccagttggtgtccactgaagaattaattgcacggatttggtcacagaagactttggttgctgaccattgtagtagtatgagagaaaaagaaaaaccgtttgagagtttttcctagaaatgaaatacctagaaatgaaattactgaatgaaaagtattcagagtttacattaaaaataaaaatggctgtatttccctacaagaatgtgataccatttgagattcatcagaaatgtgtgagaataatctgtccacttatcagcactggatagcaattgtttttattttttgtttagttaatttgttggatgaaaaatatttcattaagttgattgtcttttatttctagtgagattgcgcatcattttatttgacatcttgtgttcttgtaatgtgtgtagtatatattattattatcattattatttttttttgacacagagtctccatctgtcacccatgctggagtgccatggcgcaatcttggctcactgcaacctcttcctccctggctcaagtgatcctccagcctcagacacctgagtagctgggattacaggggtgcgtcaccatacctagctacttttttttgtattttttgtagagacagggttttgccatgttggccaggctgtatagcacatatttttaagcttattttttaatagggtttttttctcttaatgatttgaaggaactcttacatgttgttagtttttcctcccagtatgcaatttgctgtttgattttgtttatgatattgttttataaaaacttaaaattagtatacagtgaactcttttcattttttttttctttataagggcttggattttttatcttgtttggtacaaattttcttcacccaaatattataccaatttttttttcttaaataaaaacattctttccttttagctctgttatagaactgaacttgggtctgctcgcctggcacaataaggacataaccacactgaggttttgcagcagtagaaaggaaggcatttattttcaggatgctacgcaaagaggaccaggtagctaatgcttaaatcctgacctccccgatgatttgcaggtaagggtttttaaaggcagtggtaaatttctggatagcagaagttacagacaaaatcataaaccatacatggagggttacacactgattttggcctaaaaggttgggatatcttgaagcagtggtgtataggtcataggtacagtagaagattttctgatttgcagttggttaaggaggcaaagctttttctaaaaatttgagatcagcagaaaagaatgttagcactggctcatgggtataaccttctccaggcccctcagaaagaaatttagaacaaagaaggggagtcagagttcagtccccagttcctctctatatgaggttgctgtgctggcagatccttttggtgtgggcacaggtttctgaaaaacaactggagacatgttaaggtattatctttagtttttatagggaagcaaacattcttgtgactcttaacttccttggctatttttgttgttgttagagatggggtctcgctatgttgcccagactggtcttgaactcctggcctcaagtgatcctcccaccttggcctcccaaagagttgggattacaggtgtcagccaccatgctgggccagcttggctgttgttactgttacctgcttgtttatcaagttgcacatttatttttcagggctagctaggtgcctgaagtttcctttgaaataactgaagattttccttttttctatgcttggggtccctgcgtcatctcaattccccatcttttgtcacccatcaatcttgtggggtactggggtgcagactgctctgcctacttcctgttgaattggggcaaagattgaggactaggatatgaggatattaagtttcttttctttatttttttgagatggcatcttgctctgtcgcccaggctggagtgcagtggcatgatctcggctcactgtaacctctgcctcctgggttcaagcgattcttctgcctcagcctcctgagtagctgggactacaggtgtgcacctctacgcctggctattttttgtatttttagtagagacagagtttcctcatattagccaggctggtctcaaactcctgacctcgtgatccacccgcctcggcctcccaaagtgctgggattacaggtgtgagccaccgcccctggctgaggatagtaagttcctagcacggaattcaaggtatccatgagtcccaggcatggcaccatggtgctgaactgtcattatttgtattagtcactgctttattacattttaacacacatttggttatgatataaagcacaagaaaaattagcaagattgatatgcataactttagcaatccagaaaacatggattttattccatgaggaatccaagaaaagaaagaagaaaaccagtccttagggacagtcagggagatctgttgtaaccaagtgacttgttctctaatttattttagatgagtttctacctcagcagattcatttatataagtattgcatgtgggatttgcaaccatacacactcctccctgcttggctaagatgtaatctaaggctatcctattatctaagacacctgagccaatgaattaattcttttctgctagacagctattgctgctgaagtttccttagcaagaattcctaaagagagagatttctaatcatgtgctcataggatgccactccccaccaaggtaacaaagtccatccaaagaaataacccgcatccatctttttagtacctgggcaagaatagatttgtggatcccaaagtgagtatgtggacttgtttacttttaatgagttaatttacttgcagctaagatacgggatttctgacatgtttagagagcagacttctaaggagggagcagggctcttgctcctctcaagaggcaaaatcaagtaagccttttatatagaggcagagtctcattatttctggcaaatttgtttgaagcttcaagtgaagggacttccaaaataaaggaattcttttatataatatatatatatatatttttttttggagacagtctccctctgtcacccaggctggagtgccatgtcttggctcactgcaacctccgcctcccaggttcaagcgattctcctgcctcagccttccgagtagctgagattacaggcacacgccaccacatctggctaatttttttgtatttttagtagagacagggtttcaccatgttggtcaggctggtctcgaactcctgacaccatgatctacccgcctcggcctcccaaagtgctgggattataggcatgagccaccgtgcctggccaggaattcttttatgtaatattctgaaaggggccctcagattatgatgattgaaggaacttgagtatcattgttctattagctgggtcagatgatatatctataggttacctgtctttgtcaacgtctcagaaattctaattataaaattgcccttttaatttgggaggatgaaagtccacaaggaagcataacaaaaaggcaattatatttatagttcagtgtgatcacctgaagtaattaagactccagggcagcacacagaatttgctaagccagtagtagacagagaaaataagaaaagtggccgggcatggaggctcacataaaaaactataaaaaactatatataaaactattaaaaaaactataaatatataaaactattaaaaactatatagtttaaactatataaaaaaatataaactagtttaaaactacataaactatatagttttaaactatatagtttaaaactacatgaactatatagtttaaaactacatagtttaaaactatatagtttaaaactacatagtttaaaactatatagtttaaaactacataaactatatagtttaaaactacataaactatatagtttaaaactacataaactatatagtttaaactagtttaaaactatatataaactagtttaaaactatatagtttatatagtttaaaactatataaactatatagtttaaaactatataaactatatagttttaaactatataaactatagttttaaactatataaactatatagttttaaactatataaactatatagttttaaactatataaactatatagttttaaactatataaactagtttaaaactatatataaactatatagtttaaaactataaactatatagtttaaaactatatataaactatatagtttaaaactatgaaactatatagtttaaaactatatatataaactatagtttaaaactatataaatatagttttaaggcctcatatacatgttatatataatgtatatatagttatagttatataattttatatatatagttatatatacatacacaaatatggcctaaatattagttttaattagacttttgagtatagagttcttaaaaaaatatcctttcaaatctcttactatcagatttttagctgggacaaacagttgatatttctggcttttgaactcttttcaccccaaagatattctcccccatgaaactaagaagcgttagccagggttatgacttcaacaaggacacatgaggtctcgaaagaggtggaaagcagttttcacaagattcagagctgccccaaagacagcttaaagagaggaaaatttcgtcagccataaatggagtacagaccacatttctgtttggccatattctctagagcctcagtttctcagctgaccattcacacacacaacgtgtaccaaaaagcataccaaaaaacctgtaggctgcccccctcacagatggaggacaggaaatcaaaagctgcccatagaaggaaaaaggaacgataaatggcaaaagtcacacaaatattaaaccaaaaaatgatgtgttccttggctgggaattcaacccaggcagcctcagtgctttaccactgctgttcctggaggggatctaaagcaggcagttttgagcttgcaaaggattttaaccttgttttaggtgagatatttgttctttaatttagtcaagtgaattctcaaggctagtcatgacactattaagtgtcctttgtaaaatttgtttagaaaataacttttttttgtaaaagcaattgtttagagagatgcctgagattattttaaaatttaggggtccagtttaaaggttccccttttcaggcttttttctggagtcttaaaaaatactgtggccaagcactactgcaattaaaaaaaaatcattttttttttttccttgggcccaaatctaaaaatggcccaattctgcagaatacaccctaatgggctacaaaggaaatagaacttgtgtttctcaaatgaaacaaaaccctggacaaggcattaaaggtttgtcgcaaaacctaggtgacaaacctttaatgccttggccaggtgttaagtattaaatagattttcaagcaagtaaatcacaatcaaattgtgatttttcaaggtttcagtcttcagctctgggatatctcccaccaagtgcattctgatgaagtagagcccaataccttgctgaagcaaggctggatttcctgctgaaaggaaaaatactatggggctatcacacatcaaccccccacttaccaaaagacatcttctcaggtgatttatttctaatgctgtgaaagtagaagcaccacaggccaacggtgtctgattgcctgccaaatacacggatctgtccctgaataaaataattcaggcagctgctggattgggcccaagggtggctgcggccagggacttatgtggtacagatgaggcacccactccagacttttgtcccattttggttgccggtgtttagagaaccaaaccggagttggctcacccagtccaataaggccagatatccacaccaagattttgcagtggtagaaaggaaggcatggtgtttatttacagggtgtcaagcaaggaggaccaggtgactaacccttaaattctgacctcccctatgatttgcaggtaacagtttttaaaggcaggggtaaatttcaggatagcagacgagttcagtacccagttcctccttatctgaggtctgtgtgcccgcagatccttttgctgggagttcaggtttctgaaaaacaactgaagtgacagatgttgagatgttatctttagtttctgtagggaagcaaacgttctcatgactctgacttccttggctattttaaagttactattacttgcttattaagttgcatgtttactttccaaggctagctaggtgccagaaatttcccttgaaagaacttaatattttcttgtatttctatgcttaggggcccacaggcccttaaaaggtgtccctgttctgtttcagctctaagtaatctggaatttatatatgttgaaggtaaggtannnnnnnnnnnnnnnnnnnntgtttgagcatcatttgttgagttgtggtagtaaatggcattgtaacagtattatatacactgctctgtttttagaaactcttggctttcattgatctgttggtgttcctgttagtacttcagcttcatttcagtgcccttaaaagtctgtatttttatttatttatttatttatttttttttttgagatagagtctcgctctgttgcccgggctggagtgcagtggtgtaatcttggctcactgcaacctccgcctcctgggttcaagtgattcttgtgcctcagcctccagagtagctgggattacaggcacgcaccaccaacctggctaatttttgtatttttagtagcgaagggtttcgccatgttgggcaggctgatcatgaactcctgggctcaagtgatctgcctgccttagcctcccaaagtgctgggattagaggcgtgggccactacacccagcctaaagtctgtatttttatacctggtaaggcagttccttccccttgttcttcctttccttttctttctttttttttgtttttgagacagagtctcgctctgtcgccccggctggagtgcaatggcgcgatctcggctcactgcaagctccgcctccctggttcacaccattctcctgcctcagcctcccgggtagctgggactacaggtgccagccaccatgcccggctaattttttgtatttttagtagagacggggtttcaccgtgttagccaggatggtcttgatttcctgacctcgtgatccatccacctccaccttccaaagtgccgggattacaggcgtgagccaccgtgcccggccatctttttcaaaatgttcttggcatttttgtgtgttttggtccacatgaattttagaatcagtatgtcaagttccacaaaaaaatcttgttgggttttttttgttttgttttgtttttttgagaaggagtcttgccctgtcgcccaagttgtagtgcagtggcgggatctcggctcactgcaagctccgcctcccgagttcacgccattctcctgtctcagtcattctcctgcctcagcctcccgtatagctgggactacaggcgctcaccaccatgcctggctatttttatttttatttttttgtatttttagtagagacggggtttcactgtgttagccaggatggtctggatctccagaccttgtgatccgcccgtctcggcctcccaaagtgctaggattacaggcgtgagccaccgcatccggcccttgttggggttttttatgggaattgccttgaatttatagattaatttgggggaagaattggtatctttataatattggatgttcccacccagtaatatagtatgactgtttagtgaggtctttcatttcacctgtaaagttttcctaatgttggctgtttagtagtattgaaaagaatgtgttctagtgtcatgctacttagagtcggtctttgctaagccacaataaggttgggcaaataacagaccttttttgtgcttcagtttcctcatccataaaatgggaataactcatcaggattattgtgaagattaactgggttaagacatgtaagttaatacattaaaaatgtgagctattgttattaggtatatttatgcattttatagtttatattgctttggccaaagggattttaaaaaaatcttactttgatgtataggaaagctactgatttttgtttatagttctttgattttggctactttgctgaattctatttattaataatagtttttgggttttgtttttggtaattctcttgttctaggtaataatatgttttgcagtgatttgttttagctttcgatatttgtaccttattattattattattattttttgagacggagtctcgctctgtcattcaggctagagtgccgtggcgctatctcggctcactgcaagctccgcctcccgggttcacgccattctcctgccccagcctcctgagtagctgggactacaggcgcctgccaccacgcctgtctaattttctttttttgtatttttagtagagacggggtttcactgtgttagccaggatggtcttgatattctgaccttgtgatccgcccgccttggcctctcaaagtgctgggattacaggcgtgggccaccgcgccccaccgtaattattttttatttatatacattttgcatcttttttcatttattaggacctccaatataatattgaatagtagtgacgataaaggacattttgttcatgactgtctttaaaatggatttgatgttgatttatagacgtgatcctccataaagctaagggctttatgtgtaggttcttaatttgctaaggagtgagttgtgtatttttacaaaatcatttttattgtacaaatcataaatgaatattttttattacaaaatgagaggtgacagcgtgctggcagccctcacagccctcgcttgctcttggcgcctcctcggcctcggtgcccactctggctgtgcttgaggggctcttcaggccgccgctgcactgtgggagcccgttcctgggatggcggaggctggagccggctccctcagcctgcggggaggtgtggagggagaggcacgggcgggaaccggggttgcacgaggggcttgtgagccagctagagttccaggtgggcgtgggcttggcgggcccgcactcagagtggccgctggcccctggcagtgaggggcttagcacccaggccagcagctgcggagggtgcgtcaggtcacccagcagtgccagcccactggcgctgcgctcgatttctcgccgggccttagctgactccccgcagggcagggctcgggacctgcagcccgccgtgcctgagcctcccaccccgccgtggtctcctgcactccccgagcctccccaacgagcgccgccccctgctccacggcgcccagtcccatccatcgcccaagggctgaggagtgcgggcgcaaggcaggggattggcaggcagttccacctgctggcccggtgctggatccactgggtgaagccagctgggatcctgagtctagtggggactcggagaacctttatgtctagctggggggattgtggatacaccagtcagcactctgtgcctagctcgaggttaatgaacacaccaatcagcaccctgtgtctagctcagggtttgtgaattcaccaatcagcactctgtgtctagctcaaggtttgtaaatgcaccaatctgcactctgtgtctagctgatctggtggggacttggagaacctttatgtctagctaaaggattgtgaatgcaccaatcggcactctgtgtctatctcaaggtttgtgaatgcaccaatcagcactctgtgtctagctcagggtttgtaaatgcaccaatcagcactctgtatctagctaatctagtggggaggtggagaacttttgtgtctagctcaggaattgtaaacacaccaatcagcatcctgtcaaaatggaccaatcagctctctgtagaacagaccaatcggctctctgtaaaatggaccaatcagcaggatgtgggtggggccagataagaataaaagcaggctgcaggctcctggggtgataacccacttgggtcgagttccatcgctgttggcgataaatcttgttggtgttcactttttgggttctcactacctttatgagctataacactcaccctgaaggtctgcagcttcactcctgaagccagcgagagtacgaacccacaggcaggaagaaactctgaacacatccgaacattggaaagaacaaactccaaacaagccgcttttaagaactgtaacactcaccgcggggctccgcggcttcattcttgaagtcagtgagaccaagaacccaacaattccagacacaaaaagagtgaaaatgttttaagaattataaagtgtcggctgtgcacggtggctcatgtctgtaattcctgcactttgggagaccgaggcgggtggatcacttgaggtcaggaatttgagaccagcctggccaacatggtgaaaaccccgtctctattaaaaataaaaaaattaaccaggtgcggtggtgcacgcctgtggtcccagctacccgggagcttaaggcaggagaatcactttgaacctgggaagtggaggttgcagtgagccgagacggcaccactgcactccaacctgggcgtcagagtgaggcttggtctcaaaaaaaaaaaaattataaagtgtaaaatatctttgtatctctagtttttctcctttccccagatatatacattaccattccatttgatttgtgtacttttagttctgttgttgtaactttatatgcatttaatggatacatgttgtacacatagctttcttttttttttaaattaggtgttagattttgtctcattttgtttcattaagtagatattaagtacctactatgtatcaggtcccctccaggcgttaacattcttttgtttattcaatatctgtttattaaatgtttggtatatatatgcctggtgttgtcccaggatatagctgtgaaggaaagaaaagctctgtcctcagagataacattctaatggtgcaggcagaaaataaaatcaagtaatgataaatggtgcgaagaaggttaaagtaggataaaagagaatagaaatgggcgaaagagctattttaggtagtgtggtcagagaaggcatttctgaaaacgggacatttcttttcttttcttttcttttttttgtgacggagtctcgctctgtcgcccaggctggagtgctgtggtgcaatcctggctcactgcaacctccgcctcccgggttcgagtgattctcctgcttcagcttcctgagtagctgggactacaggcgtatgccaccacacaagctaatatttgtattcttaatagagtcgggttttcgccattgttggccaggctggtctttaactcccgacctcaagtgatctgcccgccttggccttccgaagtgctgggattacgggtgtgagccactgcggccgggccaaaaggagacatttcatgaaagacttgaaagaggtagagcagtcgggcacatactttatctgggtcaagggcccctaaggccaacagaacagcaagcacaaaggccctggactgagagtctgttggcagtgtttaggaaacaacaataaagtcatttgtttagagcaaacagaatgaaggaagagtagtgggaaagaaggttggagaggtaaatgagaacgagatcatgttgagcattgtataggccatggtaaggattttggattttaagtatgatgggaagccaatgatgaattttgaaaagggaaatggccttgtattaatttgctaaggctgccataacaaaatatcaaagacagagtagcttaaataacagctctggggtctagaagttcaagatcaagctgtcagcctatttggtttccttccttccttccttccttccttccttccttccttccttgcttccttccttctttcctccctnnnnnnnnnnnnnnnnnnnnctcccccctccctccgtccctcccttccggaattcctttcttcctgagtcttgctctgtcgcccaggctggagtgcagtggcgccatctcggctcactgcagccttcgcctcccgggttcaagcaattctgcctcagcctcccgagtagctgagacagactacaggcacgcgccgccatgcctggctaatttttttgtatttttagtagagacggggtttcaccatgttggccaggatggtcttgatatcctgacctcatgatccgtcctcttcggccctattcggtttcttctgaggcctttctggcttgcggttggccttctccttggtatctcctcacatggtcttttctctgtgtgcacacatatctggtgtaccatcgtgtttccaaatttcttcattttataaggataccattcagattggattcagacctactttagaggcctgatgtttagcttaattacctctttaaaggccctgtctctaaatacaatcacatcctgaggtagtagggtttaaggattcaacataggattttggggggaacacatttcagcccatagcagggctcatttgctttacttagcctgctgagaattgacttgaggtgtgttggggcgtcgggggatggtggtggtggaggcgagtatagccagggtattgaggttagaatggaaacagagagttaggaggagattagacacgatgacaacatgctctaaggaaatagctgtagagttgatgagaagttatcagaattgtgatttattttgaaagtagaatgcataggattattttgatagtagatttttagattttttctgttctgtttatgaaaaatttaagctggaaaaaaaatgcaccttacaaagaccaagtaaagttccccttccctggctttttttttttttcccccaacctgagttgatatctgatacagatattgggactacctcaaactgcttctctatgattctgcatctctgagattcatcttagaatttatttctggacagattgttcatattcttggaaaatagctcttggattttaacttgtcctgctgttgggttgtgtaagggaggaaaataatttttttcaaccctcataagttattatttggaatggtcccctgtaacaaaagaaaaacaaatataagtttgttaacatgtataattcataaatacatgggagatactcagaatgagttggcttttaattcctgcttatatagtatcttcaacaaatgtttagcaaagtgtcaagacaaagaaaaaggactttgagtctgtaggggcagcaacttgtagaaaggcaaataatggcaggcaaagcataattagtaaacttgttaatgtggattcctttggtgtcgtatccagaccaatacaggtgtaaagttgtatttggtggttaacttgtgttcttccacggtaaacaggggttgggtttttttttttttttttaaccttttttgtctttggagtaaatttatgtcttgcttttaggcaagtggatagcagagagctttcctgcatctgctttttaattgccttcagttcaacaatccttatgccaaggaggcatatttagaggtggcatattgctgtctacttctggtggtcttgaacattttaatccctctgtatccttacatgttgccctgccctcccaccccaacaagtagttagcttttttttttttttttttttttgagacaggtttttgctctgttgcccaggctggagtgcagtggcatgaacgtggctcacggcaacttccatgtcccgggcttaagccatcctcccacctcagcctctggagtagctgggaccatagatacaccatgcctagctaatttttgtatttttttttgtagagatggggttttgccatgttacccaggctgatcttgaactcctggactccagcaatctacctgcctcggcttcccaaagtgcggggattataggcgcaagccactgtgccctgccctgttttgcattttgtgtttatcattcttttgcttaaaaaaagttggatatatatgtatacctaaataatatactgtttacttttgcttgttttttggcattatgtgaatggtactcatatagtatttttttgtgatttgcttttttcactcatgtttttaagattaaccactgtcgtagtttgttgctgaattctgtatttccctgtgttacaatattccactgtgaagaaaattttcattatatgaatataccacagtttttttattctgctgtcagtagacttggattgcttccagtttacataattgagcttattgccctgaggctctctttgctcttatttattgatctgaagcttagactttttctagggtttcctgggaagaaccaatatcttactacatgtttataggtctgtggttttctccattaatctgatcaaatttgcatgtcttctaatgatttctaaaaatttgtaatctgctaacagtgtcctttcctgttttctgtctgtcatgattttattttcaaaaaccaaaaaaaaaaaaaccaaacattttttctatcacttaaatgtgattattttttattatttatttattaatttttgggacagggtctcatttttcacccagactggagtaaagtggcccgatctgggctcgctgcagcctggacctcctgggctcaaatcatcctcccaacctcagcctcctaagtagatgggactacaggcgcatgccaccatgccaggctaattttttgtattttttgtagaaatgaggtttcgctacgttgcctgctggtcttgaactcctgagctccaaatgtgattattttatatggaaagtagataaatcccagtgttcagtcttccatcttaggccaaaggttctcttccttgtctttctttgcatgttattcttagtttttgcttgactttttaagtgtaccttgtcttagacgccttccctgactgcttgtttcttacattctgtatttatctctgtcattctgtattatactggctcatctcattattagacagtgaatgcctgatggtgaggaattttgttttatcctttttatccttaatgcagcatgatatctgatatgtaaagggtgctaaataaatgtttattgaataaatacatgaaaaaattagtataaatggggctgaatgcgatggcttatgcctgtagtcccagcactttgtggggccaagatgggtggattgcttgagcccaggagttcaagaccagcttgggtaacatggcaaaaccctgtctctaaaaaaatacaaaaattagccaggtatggtggcctgtgcctgtgatcccagctactctggagactgaggtgggaggattgcctgagcccaggtggtcgaggctgcagtgagctgagatcgtgccactgcactctagcctacacaacagagtgagaccttgtctcaaagaaaaaggaaaaaaaaaattagtgtaaatgggagtggtctgtaatagatacctagtcatcaaactggcacagtagttttgcagataagaatcaggagcttgagatggtggcacatgcctgtaatcccagccactcaggaggctgaggtgagctgcttgagcccaagagtttaaaatcagcctgggcagtaaagcaaactctgtctcaaaaaaagcagaataatcttcctgcggggctaccagtctgtgggggatttcattttcatagagatataaccactttttagttcataaaggcagctttggagactgatatgtcaaacattttatagaaaagaaaatcagcagtttaattttgtgtgattttgctttaatattaagctgacatgactgttctgtatattgagggatacaatttatcttagcctaagtcttctggtatgatagaatgtttaaatacttacaaactgagaaataggggaggctgagtggtgagttgcatatctttagctactaaaatgtgttttttgaataggtaaatatatttatgtagttcaaaatttaaaaatacaaacagcgtatattatgaagtgttcttaccttcatttccctccagctgttcaaaaactgattagcttttggggttccctctccagagcaaccaattttattagtttacaaatagttgtgtgtgtgtgtgtttgtacttttacttggattctttttttaaaattctgctaagctgattacttgtattggtgtaaagaacagctgaatcaaaatgtgtgattttttttttctccccccagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacaggtgcgagtcatgtctgttttcttctaatttgggaattctttgggtaacttctaaactcaagctttattttttaatggcaaaaaggaagtatatagttatcttttggtcttcagtaaaggtctattctgtatcaggattacattttgaaaacattttcctccaattataaaagtagtaaatgctcattatataaactaatggaatataaagaaaacaaaaatataaaaatcacccatagctatatctctcagaggtaatcaacactcagaggtatttgaatttatgtgtatttgtatacattatatgttttaaaaacaaatactggtagatgaggagctgcagaattcttagcctggattagagaaataagagtatgttatccttggtgagactggaaaaagaagaagaaaagaatggggctagtgtgaaatctttacatgggcctagggctctaagagttattgtatgggtggcttctatatagataattagataattgagtttgatttagcactttatatgggaacgcaaaggtctggacaaataagtactttggaagagttgaaatagaaactgggcagttaagcttatttaatatgtaacaaccatcagtggatagataaataagtcttgatagggagaatttcttaatatcttttgaagaatacctccattttcatagtagggagtacccagaggataattttcggagccagtacagtggaattgaccagcaaaagttagttaaagctagtttcttgaatattgataatatattcaacatggtacagtctacatacaaagaggccgagatgggcagatcacttgagtccaggagttctgagactagcctaggtaatgtggtgaaaccctgtctctctaaaacattaaaaaaaattagctgggtgtggtggcacatgcctgtggttccagctacttgacaggctgaagatgggaggatcacctgagcccagggaggttaaggttgcagtgagctttgattacaccactgcactccaccctggccaacagagtgagactttgtctcaaaaaaaaaaaaaaaaaagaaaaagaaaaaaagtggtcacccttaaaggtgggaagagttgaggtataagtagtagatatgatttaatagttattcttcttggaaaaaattattttttaaaaagaaagattgtaccagttttttactaagttgttggattgagtaatatttttaagaagctttttcctgtttactactcagattattagtgatcctgtttttgggtagcatgatagaccaagtattaaatagttttaacttggaaggctgtagagatgaacatcaaaacactgggggaaaaaaaggtatatatatgtcacttgatagtctgtatgctaaggtctctatgaacagattggaaattaatagattcacttttaacttaaaatagatctcataattccaaatagagcattaataggaagaaattataaaagtcacaaaaaaaaagaacactgacagtcaggaaacctgggttctacttctggctctgttcctttctttctgcgtgattttaggtgttttcattttctttcttttttttctcagttttaaaacaagaatataaaattctgaggcctattttagctctaagccagaccatgttataacttcttaactgaatacttcttatctatactttttttctatatctttccatctatctgtaagtagcttttcccatgatctgacttgtttatatttcctattaactgacaaagcatttaaaaacagttaaaaattgtctcgacaggcattttaaatgtcaagacattataaaatactttagatttatacagcaattgtgaacacctttgacaaatgaacatgtctgttcagcctttttggtacccctttttattttgcttaggtagatcaaattctaagttgatcttttctagcagcagggtcagagtctagtgatcgtttttaaaatggcttagatgctacctttcttttctgagaactcagtgtgatataatccttataagatattgacagctaattttatggattatcctaccgggacagtggaacctaagtagtttgaagacgagaaattgttttgattcagaagcaatgggttcactagtgaaaggaaagatcccacgatcgtaagtggtaaatgtttatatttgttgaataactctctgaaaaaaggaaataaagtagattagccttggtaagaggtggcttaagagtggttttatgatctaagttttatttgaaaaatgtgtgaaacttgtttaaggtaaatgtgagaattaataaaggaattgagaagaaagatatttgatcgttttttgaataacatttacctaattaagaagttaactacttttctgaggcatcttttttatccctctccgttttcctcctcccaaaagaagttgttcttgattttaaaagtttgataaattaacaaggttgaaatttgaatatgatatacattgaattaagatttgttcagggctttcttaattcagttctcaagtatgaatttctcaggtctgaattttttaggtagaaaattctcaagtatgaatttcttttctagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggttaggcacctattaaaacatcacagaacaggttagattgtggtttgaagaactggatattccccaatgttttaactgagtttatgtgcctaagtcttcaaaatggggtttatagtatcaagtgaggctgtttggttcttctgaaaacacactcattttctgacacatggctagactttatgccaggtacatgctatttttgaaaagctcttttttaagaggtaactgtttattaaaacaatctgtttcaccaaatatgttagccctgtaaaattgacatttacaaaagtttgaagaaaacaaatttgggaaagttaataattcgcctttctatcttcaaggattcaaattgaccgttttttctcctttttttgtcttttaacttactgtaattatgccccaatagttcgggtgcagtggctcacgcctataatcccagcactttgagaggctgaggtgggaggattgttttgagtccaggagtttgagaccagcctgggcctcatagcaagacccctggtcttaaaaaaaaaaaaaaaaaaaagtcccaatcattttaagtgcagtttgggtgtaccttcttggccatcaattttgttaaaaactctgattttcccaaagtattgggagaatatatactgataagtaatatatgctgtatatcttcaattagaagtgaagaactaaaaagcctctttaaaatttagttatactttttaatagctaccgattttatctttttttatcacttactatttttgttagatgttttcctaaaatgttatcttattctatcttaacaaaattttctaagttacatgttgacaggtttcacatctagtaactgagtcactcaacacaaagcttttaattgcttagagatcttcagagatatctatctagatatgttacttccgcagatttccaaaatctagtaattcagggaaaaaacttggttcagaattatgaaatgctgacatgaaatgatatttgggtgggctgtccagtccctcttccctttttttctgtctgtttctgctttttttccttaggtctgcacctgttcagcatttggcaggatggcaagcggaggagcagcagggtgaaactgacacagttctggtgagtttcactttgctgctcctcctgattctcagggaaagaattttgttactcctattggaaaacatccatctccaaatgaatccttaagataagatgcgaatattattcctttagggttgactcaactatttgtatgtgttctaattactccagtctgcagcggctctttgtgttggagttgggagtttcgctgatccagatgacctgccggggctggcacactttttggagcacagtaagaatttgtaaaatatcattcctggtgtgtttttttcccccctccaaacttatatgaattgatatcaaagattagcaagtgatttgacagaagtatgatatatttagcaagagaaaaggctaagaaaaaatccttgatttatgaatatcgtgggggaaacaatctgagtgtacttatattgagagttagaatgaaaccacacagaaaacttttaaactgtagatgtcactattgttgagctatgttaaggccaacggatcaggagatgattgccattttctaggaaatgaccagtcctggggagggcagtcccttccagggttagcaaggcccccagccaaacatcagaaatacaggaattccctgggtgaggtggctcacgcctgtaatcccagcactctgggaggctgaggtgggtggatcacttgaagtcaggagttcgagaccagcctggccaacatggtgaaaccccatctctactaaaaatacaaaaattagttgggcgtggtggcatacacctgtagtcccagctacttgggaatctgaggcaagagaatcatttgaacctgggaggtagaggttgcagtgagctgaggctgtgccactgtactccagcttgggtgatagagcaagactgtctcaaaaaaaaaaaaaaaaaaaacaagaaacaaaaaaaacctagaaattcaaaaggcatgattaatataaaaacaaaacaatagaagcttttcatttaatttggaatgtacctaaataaaacttacacggggccgggcgcggtggctcactcctgtaatcccagcactttgggaagccaaggcaggtggatcacctgaggtcaggagttcgagaccagcctggccaacatggtgaaactccatctctacaaaaacacaaaaattagccgggcatggtggcgcacacctagagttccagctgctctggaggctgaggcaggagaatcacttgaatccaagaggcggaggttgcagtgagccgagatcacgccattgcactccaacctgggtgacggagcgagactccagctcaaaaacaaacaaacaaacaaaaaaactctatgtggatgttatatagttacaaatatttatttttattttacaaatatttattttaaattactctttttttaatggtctggttttctaaagtatttgagggtatacttcttactttgtgaatttttatagtagccattaatctgcatatgtttgtgcttaaattttaatctccttaaatttaattgaagagattaagttgtaacagcagtagcagttaatctgcatatatgtttgtgaatttgtttgaattttaatctaattaataaaaggtgaattttaatctatttagacttaaatatatttgtgatctctttataagttatatgttcgtcttatctttctttaaagatgaaattttttttttttagtataaaagtaacatgagcataatagaaagttacaaaatcaaatgtaatgaagaaagtattatttagggtcaggtgtggtggctcacgcctgtaatcccagcactttgggaggccgaggtgggcagatcacttgaggtcaggagttggagaccagcctgggcaacctggtgaaaccccatctctactaaaaatacaaaaaattagccaggcatggtggcaagtgcctgtaatccagctacttgggaggctgagacacttgaacccaggaggttcaagaatcacttgaacccaggaggcagagtttgcagtgagccaagattgcaccactgtgctccatcctgggcaacagagtgagactctgtctcaaagaaaaaaaaaagaattcagacataaccatttgatgtgttggtctattttctttcagtttttctatgcatataagaaagttcatgtgtgataaaaatattttctatatctttgtgttgtgtgactttgtgttctttccatttagtggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgataggtaactaactctaaatatactttaattttaatgatctaatggcactttgcaaatgtaaatagagtgttcttgtacagtagaattgtcacaatactttacttggaccagtcatggtgactcatgcctgtaactcaagtactttgggaggctgaggtagaaggctcgcttaaagccaggagtttgagaccagcttgggcaaaatagtaagaacctgtctctacaaaaataagtaaataaaaaattagccaagcatgttggtgagtgcctgtagtccttggtactcaggaggctgaggtggaaggattgcttgggtccaggaattcgaggctgtagtgagctacagtcacaccactgcactccagcctgggtgacagagtttgtttgagaccctgtctcaaacaaaactttatttggagaaaaaagctgttaaactgttaaatacactttgactcttgttctattatatatagtctttgtattaaagattaaaataaaagtcaacaccttttgggttttattaattttattaattatgtattctctgttgactcattatgactttttttttttttttttaagagatatggtcttgccatggtgcctaggctggagtgctgtggtgcaattggccatcaattgcatgaatgcatggctcagtgcaacctcagcctcccaggctgaatgtgccaccgctcccagctaatttttaaatttttttgtagaattgggagtctctctgtattgcccaggctggtttcaaactcctggcctcaagtgatcctcctgcctcagcctctcaaagtgctgggattataggtgtgagccactttgcccagccacttaaaaaacagaatttagtagaaaatatggagaaacagagaagcaaaaaagggataagattgcctccaactttataatctagagataaccaccattaatgttttggtatagacccatctatattttttaaagtataccgatcatattgttcatacccttttataattgttaattttaagcaagatatatcattttaacttacataatttataaaacatgatttttagtgattgtatgttatttacattgtatagaagtaccataaggtgtttaatcagttacatatgattggacagttgagttgtttccagttttctaatactgtgatgattatcctgatctctgtgaatatccttaattatttctattaagttctaagcagtgaaattgctgagtatatttgcaaatatatttttaagactttttttttctttaagcttttgaaattcattgcaaaattgttttccagaaagtttgtcagtacaatagtagaagtttgagattacagggttgcagaccaaagtctaccccggaaaaaagtagaaaagtagaaaaaagttatacctaattctagatatatgcaagattgaaatgtaaaagaaaaaagaaacctcacgtttgtctagtataatgtaagctccttcagagcaggaatttttatctattttttgttgatacatctgcaaatcaataatttggtagatactcagatttgttaaatgaattaatgcagttcctttatagcaaaaattaccataaaatcaaaagataaatgaccaaaaaaaattttttttaaacatgatagagatctaatattttttttaaaaattggcctggtgtggtggctcacacctgtaatcccaacactttggggggccgaggtgggcggataacttgaggccaggagttcgagaccagcctggccaacacggtgaaaccctgtctctactaaaaacacaaaaattagctgggcttggtagcatgtgcgtgtaatttcagctacttgggaggctgagacaggagaattgcttgaacctaggaggcggaggttgcagtgagctgagatcatgccatagcactccagcctgagtgacagagtgggactctgtctcaaaaacaaaataaaataaaaaagataaaataaaaagaaattatctcttttcttaagagattaatttgatctggaaaaatcctttggacatattcctataaattggaagcatatgccactatttatttattttttttttggagacagtctcactctgttgcccaggctggagtgcagtgatgtgatctcggctgactgcagcctcatgcctataattccagcactttgggaggccaaggtgtgtggatcacttgagcccaggaattcgagaccagcctggccaacatggtgaaaccccatctctactaaaaatacaaaaattagctgggtgtggtggcgcaggcctgtaatcccagctgcttgggaggctgaggcacgagaattgcttgaacctgggagacggaggttgcagtgagctgagatcgcaccactgtactccagcctgggtgatggaccgagaccctgtctcaaaaaaaaaaaaaagaaagataaatcaatgaaggcaatgcaaatgatgcctgagatgatctttcctataaatttagacaggatcagcaataccttcagaggagactttaaccatacaactttgaagaaaactgcatctttactcttgttacagagttctcagctcttaagttttacagaatccaaacaggtctttgtatgtgtgaagaaatcttaagcagaagacaagttgaatttttacaactttatatttagctttgtccatatacaaagaaggaaaaataactgattttattgggaaaaaggataggcaaatggtatgtatgatatgaatacattctggccatctcagagatgatgaaatttggtataaaatgtagttaagaaatttgttttgtttccttttaaagagttgttctaaatatgttttgtacaaggactgcttcagcatctaagaatatcaccttacacatttatttttatttaaaaagaaagccacccaataagaaagccactgcattaataggataaattaatgagaatatcaaatcataaatttatgccataagtagagcattatagggtgcaaatactataataaatgctataatattatacttctacaatgtataaggaaaagcctttatacgtgtgtaatatgctcttatataacatggattaagtacctgtttttaataggttagcaaaatctgattccctcacacaggccacattgtttataagtatcttttaaataaacagctgaggaaatgactaaatttttactccagttaagtaagtgagcatggaagccgtctttaccatggtggcgtcttctattttcagtaaatttgaactttattttatcagtatttcatggtaagagtgacaaatatcaaagcttaggatgtccacttctaacaggagaccctccccattataagcgggaatacaaaatcttcactttcaggttgtgaaaaaggatgaggcgtcctgagtagttatagcctagattccaagtgcctgagtattctggggaaccccaagtcttgattgtagcttcatgggcagaactggtagtgttcccaggagcctgggagaagcaaacataaggcatctcaaaaggaagatgccttccttctaggccctaaattgttacaaatattttttcaagtaaaataaccaacattcagtcaaaaataagcaggtactcaggaaaataatacaacatgattgagaacagataacacaaacagattctgagacatctcaagtactggcatagttacacacaatttctaaaataattatactttctattttttaagaaataaaggccagacgcagtggctcatgcctgtaatctcagcactttgggaggccgaggcgggtggatcacgaggtcaggagtttgaaaccagcctggctaatatggtgaaaccccatatctactaaaaatacaaaaattagccgggtccggtggcgggtgcctgtagccccagctacttgggaggctgaggcaggagaatcgcttgaacgtgggaggcagagcttgcagtgagccgagatagtgccactgcactctagcctgggtgacagagcgagactctgtcacaaaaaaaaaaaaaaaaagaaataaaagacaaatttgaatatacttgcaaggaataagaaactgtcaaatatgacctaggaaatttgtaaaatgaaaagatacatcttgaactgaactatgataaaaaaaattgaaaatgtcatggacaagtttaagagtaaatagagttgaagatagaattagtaagccagaagataagacagaaggaattaacccaagtatagcataaagaacatatataacccaaatatagcatatagcacaaaattaaaaatacaaagaatatgaagcatagaggatagaatgaaaacatcccatgtattttacttgtagttgtagaaggaggagagagaaaattgaagtagagacaacagttgaagggttgatcactggaaaattttcagaacctgttgtaagacatcaaatcagaggttaaagtctaataacttccaaaaggatacattagaagaaatatggaaaatttttgccagataaagagaaaattttcttcaaaggaagatgagttacacttacagatgactactcaacttcgtgctctgaaggaaaataactaccaactaataactagaatcataaattgtacactaaataaaaatatcttttaagaatgttagtaggctgggcatggtgactcatgcctataatcccagcactttggaaggccaaggcaggtggatcacttgagcccagcagctggagaccagtctgggtaacatggtgagggaaaaaaattagcagggcatgatggtacatgcctgtagcctcagctacttgggatgctgaggtgggaggatcacctgagcctggggagttcaaggctccagtgagccgtgatgtgccactacacactccagtctgggtgacagaattaaataaaattagtttcattatttaagtcaacagaaattatccaacccatcattaatcataccaagtactgaaaagaaaaaaaatgccccaatatatctagcaggtagttaagttaaaagttaccttattgcaagcaaaagttaaaagttttttaaagaagcctgagcaatatagggagaccctgtctctataaaaaatttaaagatttaaaaaaaaatggtagtgcacatctctagtctcagctacttcggaggttgaggcaggaggattgcttgaacccggcagtttgaggccgcagtgagcagtgattgtgccactgcattctagcctgagtgatagagtgagacactatatccaaaaaaaaaaaaaaaaaagtttactaaacattttaggaaattaattttttaaatcattctattttgctggaaaaacaccaatacaccaatctttgaataatttttaacaatttaattgcattgctattatgtatttatataagtggtaatttgtatatgtaatttgatacatcacagtttatataattaaaaattaatttaaaaagcagatgaaattataagattaacttaaataccaagtctttaaaattctaatttaacttttaactgaaacgtttttagtcatctgtaaacttgcattgaactaaaaaagtaagctttatatactctataaaaacatggatatacataacattacataaatagactatctgtgatattacaattttacaaaggaatgaataggagaacatttccgaaaaggctcctaagggttgaaaatggaaataaaaagggttgataaacattgggttagaaataggtatataggtaataaaactataaagaaaaggagagaaattactgctatacattcaggatatttcttgaggtaagggtaggagctgggtgcttctagagtgttgactatggtctgtttcttcacctgggtgggccactcaggtgtagtttatatgttcatgttttgttaacttttctgtatgattgttattaaatatatttcacaatgaaaaagttaaagtaacatgtagatattagtttaaaatatagaaatgcagattatttagattttatatacttaggattgtgaattaaatctccaacttagtaagtttcttaattaaaataatagatgttgattgatgaaagtgaacaaaaacggaaatgccagttttgttttttgttcagatgggcgcagttcttcatccacccactaatgatcagagatgcaattgaccgtgaagttgaagctgttgatagtggtaagaggagtactttatgtgtaactacagttttttccttcatgaaaccagttacttattacatttatccttctttatctctagaccattttatctttatattttaaaggactaaattgaaatatgtgttatgtttgttcctgaagtcattaaacatctaattcagtgtagatttgaagtaaatgaaaaggatggtggattttagttttttcatcctttgtttttcgaaggttttaccataggggctaatcttttgagattcaaagattgaagactataaaggaaaagaatgtgcttatatagggtgaggcttcattatagatctgtgctataaatattccttaattacatagtaccaataaatatcaccattgtatattatccctgcttgatttatttaagtattagaagcatttaatactagacttgaggggacttccagttcatataggttaggcttggcttatagccactgcaagtctctgtatttgttccactttttgtagtatttccctccttggtttgatgcagtgtctagttctaataatgatgtaaagcatttactaggctgagtaaactacagatggctagagtgatctatctggaagtcaacagacccctgtttaacttacagaagtgtctagctgtggcattcagtttatttgtaaaaaaggatggaatggttaagctcctcctagctgtagtagctccttggaaatcaaggatttattttctttatttttttacttgcctaccacagtgtctgttttaccttaaacccagttaaatacctgttgaatggatgaaaaaacaaaacaactaaggataactaaaagcacttttcatattttgagactcaagaactgttatctgtgtcttaaatgctttctagtatgtttttctttatacagtttctagagtgggttgacaccagtgtttaaacaagcagacctttaattagattttacaattttaagccagaatatattttattatgctttgaaaaattatgctgaaagaaatatatatgtatatacacacacagtatggagttttggtttatgctgaactaaagtaaaaattctgttgtgcttttgttcatgatctgcctgcttcggcctcccagagtgctgggattacaggtgtgagccactgcgcccggctgagaaattatttttaataattgactttttattttaatgatggtttatactcacataaacatatataattgcctgcatagtatgtcttagtgattgagatgaaaggcatgtccaatgcctttttaaatcttaattatgtgtcaaagtgcagtctctatttttatttacttacttcttcatttttaatgtttgtttcctttccaaatatggtctctaagtgttcagatatttatactctatttttatcagttgcaaggggtcttaaatcacttttcgtagatatgtttacatgtctgctatattacctgttattgcagaaacatggtggcttaaaataaaacatttattttcttacagttttggaggaatggaatcaggtacgttagataacttcctcaaggttgttgagcttagtgtcagaactgcagttctagcggtttttagtccatttgggctgccataatggaatcccacagaccgggtggcttataaaccacagaattgtttcttacagttttggaggctgagaagtccaagatcaaagaactggcagatttggtgtctggtgacagcctgctctctggttcatagaaaactgccttcactctttgtcctcatacagcagaaggggcaagggagcactctgaggtctcttttacaagggactaatccattcatgagggctctgccctcattacctaatcatttctcattggcccctacctccaaataccatcacattggggattaagtttcaacatagaaattttgggtggggggacacaaacattcagtctttagcggtagctaaaggtatttctgacttcaaagtggattgttcttagccatcatactttattaccaacatagttggttttggaagaaatttaaacaatatatatgaccaaattcccagataaaaggattaatattttattagcattttcatcagtaaaatcttgtacatagcatcctagagctgaaactttcagattattaactaccttgtgtttcatttgaaaaataagagtaagactctggtaagctgaattgatttacccaaaattacaggtcatattaagtcatagagccaggcctggatcattgagtttcccacttcagtcttataacacgtgattcatgaagttaattttgttaattccttgctttctgttctgtaagtttgaatttccatataataaaggagatactgaattttgttttattatgtgtttatttaaaattgacagaatatcaacttgcaaggccttctgatgcaaacagaaaggaaatgttgtttggaagccttgctagacctggccatcctatgggaaaatttttttggggtaagatactaaatacatcatcttatttcatattttctagttaagatttagaataagaaaagttgataaagaattgaaaattataaagctagagtccctaggtaccttttaccttttaggatagctagttagcctttcaaacgcgaagttgttaaatatgcctctatttggttctctaacagtgaatatagcaagagtaacacctaacattttgtgaatgctttttaagtgccagatactgtgctaacactacatgaattatttcatttgatcattatcacaatgttcagagataggtaccattatcatctccatttaaagataaacaggtttaggccaggcgtggtggttcacacctgtaatcccaatgctttgggaggctgaggtgggagaatcacttgagaccagttcaaaaccagccttggcaacatagtgagaccccatctctattttaaatttcagtcaagttatctcatttgtttaaatcacacagatagtaagtggtggatgtgagatttgaacatctgtttatctgattataaagtctgtgctctacctcagcctgacatttccatttgtcaacagagttagcaatagtttctgtaagagtttttgaactgcgacttaattttgttcatctagtaaactgtttaactggtgtctgtttttcataatggcattttcttagtgggaggatttagttacagcctcatattaatcctgttgactatagagtaaaatttaggatgagatgatctgaattattctttaaagggtgttttgtttccctgtatatttctgtacagttatatacattttatagggcattcttgcttcatgtgttttatttttaagaattagatagccgggcgcggtggctcacgcctgtaatcccagcactttgggaggccgaggcgggtggatcatgaggtcaggagtttgagaccagcctggccaagatggtgaaaccccgtctctactgaaaatacaaaaattagctgggtgtggtggctcatgcctgtagtcccagctacttgggatgctgaggcaggagaatcgcttgaacccaggaggtggaggttgccatgagctaagatcgtgctattgcactccagcctgggcgacaagagcgaaactccgtctttaaaaaaaaaaaaaaaaaaagaattaggcaaaaatattattaaaataattagaaagaacctggattgaatactgctagactaattattaagcaaggaagcttagggagttattgtctgtttttttaaggttttcccagagattaattccttggatattaaaatatacttcagaattgtttcttatgcatttttgtcttattaatattaatacattattgcacactggttcaatattcttgagtcccttgggttatttcattaatcatgtatggtagcaaaatatgcattgatgatgtagaagacttttaacaaagttaacttagttatatctataatttttttcattcttttataggaaatgctgagacgctcaagcatgagccaagaaagaataatattgatacacatgctagattgagagaattctggatgcgttactactcttctcattacatgactttagtggttcaatccaaaggtaactattaattatggctcttagagttaccttgaagtagcgctttcttaggatttgtttgcctgtatcagtgttgtagtgtactattaattactttagtgcttgaccttaatacaaagtaaaggaaatcagaacttggagatgtcacgtagctagtggcaaagctcagggaaacacaagatgatgagattctcaggcaaatttttttctcttacagaaataggtcttatctgtaagataagatatgtaggctggtctgtgaatgtactaatattctaataggtcatgaattgatcttttaagccaccttcagctgcaattgtatctgtggttttacatttactctatatcgattacaaactcttacagggcaaagtgttggtttgttcattcttacataaggtcctgtaaaaatggcatgattaattgagattgacatggtgacaatttaagaattatcttaaatataaaatactgatgaatacctctatggcagaactatcttaaatgtaaagactgatgaatatctctattttccttcttttatcattgtcttcagtaactcacattcactttttctcattaaggaaatcatggaagctttcttttgttttctttacatttcaacctacttgtttttcaaagttagtaaattgctaaattattccttttaacataccttatagtttgcacatttctatttgaaatgctaatcctctcaccctaatgtgattcccctttttataaagttttgctttttacattgtcaaaattaagatcaaatctgacttggctcttagatgtaaaacattttcgcatttatgatcaaaatgagttcactaaagttgacttgaaggtaaagtttcgtggtatggtagattcttctgttcaaattgcttttaggttccttttacatttgctaaattaggcaattccatatttggtattccccaagttaattcacaatttttgattattgtgtttgcaaataattccatgtgtttttcttgaactagttattctgtttcttttgtattctcttcctctatgatggcagatataagagcttattaatgcttatttcaaaattttaaaacaagtcctagagtttttgttttttagcaagacagggttttgctctgtcattcaggctacagtgcagtggcacaatcatagctcattgtaacctcaaatgcctgggctcaggtgatcctcctgcctctgcctctgagatagctgggattacaggccccagccactgtgcctaggctagagttttgatgaaaactatgtacaatgtagatttcataggatttagatttttagcattaattataccatttaagagtcaaacatctatataaataatataaattcagaaatgattagtctgaatcccaggttttatataatggggttctctattgagaattagtgaaattcatgtgcctggtagaactaacaaatactcttcaatgatggtcactcagataaagcaaaaagtttcctttttcgtttagatctgttttttactataaatttccaaagaatttcttactaaatataagaagtgaatcaaaggaaaacataaatcatatatatgtatgatatatatatatataaagcctaaaaagaagacctatgagttaaaacctcagcaagtgtacattaatgtaaaacaagtggaatataaaagtactgatgagatggcaaaaaggagaggttaatgtaatatgggttagtacggaaaaaccttccaagaggatgtaagttttagaatgggcgtaggatggttggcataatcttatctcttggtccttcacactagcctaatgctaaagatatatttttttgttaaacttgtgtgccttttctgactttaccagggagaaataaaggggtctcacaaaattctgtgtgtcgtaaggttttcttttctactgttatttttcctgttcatccattactggttcaggagtggcaagtaatggccaaattaaaatatccctttgttttttagctaaagatctctgagaaatctaattgcatttctaccttgaataatgtcattgcattttcctgtctcttccctgccctcccctctcaagaaacactggatactttggaaaagtgggtgactgaaatcttctctcagataccaaacaagtaagatatttattttcatacatcatacaccttcagagttaaagagaccattatcttgtatgagtcccaaaggttttttgcttttttatttttacacaggtgatagaattaagacctaaacaaacttaatgactgtcaagatcacacagcttttgagtgggtaaactaagatgacaagccaagtttccatagttcaaaatttacaggcttgtaaatgtatatagtaagcaataattctgaaaaatttatgcctccttttacatttatttagagcttttctgtgatacgaaagaaaatactatatgagaggcagaagaatatgcacacttacatcccccgtattgggacaaattgtgttctgaaaatttgttttttttaagtcagttgtttggatattgcactggttttccccataaaagaagtaatcttttagatgatggctgactttccatactgcctgaaaaacttacttcatatagtcaaaccagatgttcttttataagaaattgtatgtcgagtttcagttcaggatgatttaaacattttttctccacctcaaattcatcaaaatagtacaaatatttaaaagatacattactgctacctttttgttacaaagtttacaaaaaatttaattctgaagcaatgaaatctttcttcctgtacttagtagtttgcattttaacaaaattaatgaaaacagatattttttcttgcatcagatgggtaacctgtggattttcccaattagtcttctaatacataattagaaaccagcataaaatgttagaataacttataatgacaactgattggttattattaatttggctttatatgaatttccattgataattagcagtgctttttggtatgtaaaggtaatcaagagcatgacaaatttgtggggctgttttttctgattagaagtcttgagtgtgaactatggaaatatcaaatgtgaaactttaataaaatcagaggtgtgtttaatagaggaattcattaggttctgtcaatccctgatgagcattaaaaaaaatctcatatattattcactaataactttggttccttaattagacaggttaaaaattctttgaggcatttaatactaatttgcatcaactgtgttttggaagaaatattaaagttacaatatcttcaaccagagtagaagcccctaggagggaccaagtcttttaaataccacagtgcctaatatagtgctttatacctaatattcacttcatgtataatcgttgattttaaaaaagtattatctctagtttgtttctttctggaatggctttgtctaggaggagaactgaaattaaatgaggctgatagagtcagtaaatattggggtgagagggggtcctttaaattcattctctatctcttgagttgtaaagacttttgagttattgggctgaggctaagaacagattgtgtaactgaagattttgtggctgtgttgccatctatttgttcatgcctggaatgctttccaagaaggagtatgtagaatagattataaatatctctcagttagatatccctaaagatattgcttataaaggcttttgccagttaaatttgtatgtatttgttttattttcagtgggttacccagaccaaactttggccatttaacggatccatttgacacaccagcatttaacaaactttatagaggtttgtgaaccaaaagtttaaaactgtttgaaataatgttagcacattctctataacctaattgaagctgccaattttcattgaaaatgagaacacaacagaaaatacagctgggttggaaaggaagtagatgggcaatggagatctaattaataatagatagcagaccactgactagctgcagatcgattgattctggtgccctgctgctacttcagtctatttcatgctttctccttgttttacctttcttcccttttgttctctgttttgttaaattttcattcatgtttcattttatttatattctgctcttttgcctttaaatgaataaaaatagatgagagggaaaacactttggcaatcgtttccttttaaattcattgtgaaagtaatatttgctaaataaaaatataaaatgtcaagaaatgggagataaatcacccttaaatcttaccatgaagagaagtcatttgtatcggatttcttttttttttttttggagacagagtctcgctctgttgcccaggctggagtacaatggcatgatctcagctcactgcttcgcctcccaggttcaagcgattctcctgcctcagcctgctgagtggcagtgattacaggcactcaccactatgcccagctgatttttgtgtttttagtagagacagggtttcaccacattggccaggctggtctcgaactcctggcctcaagtgatccgcctgccttcgcctcccacagtgttgggattacaggcatgagccaccacgcccggcctccagatttctttctgattttctaataggtatattttcttaacaaagtcgagattataaagtatatatataattctgtctcctgctttgtttcatttaatagtatacctgtaataactacataatgagttgtgtgattacattataatttacttaacaatttgcctacagtgaatattgcagaaacattcttaattcaccatctctctttattctatcacggcagatttttttttctgtttttactaattgccttaggtattccctccttcttcaccccgttaccagtctcttttgctttcccctaatcagtgactgttttgttacacgcttctgctgctggctccattctgttaatattaaactaactctttccagagacaacttactttttattgtattctttctggttttaggtttcctcttcatagaataatagcattgagaagaatcctagagatactttaacccaactcactcattttactatgagtaaacagattcaaaaagatttaaatgcaagtgattttctcaggtcatgtaagcacatatagcaagatagtggtaggactgaatttcagccatgggtctcctgactcctagttttgtatcctttcttgcaagaagagatccatacacagcagcatttcatatcctcatagttcttttatccctgctttctctacctctgaaaccaaataaaaaagaaatttacaaaaattgcattattcgagttggaaaattggcaagttgaaacaataactgcattgtacttaacctttccttgtttattggaggataaatatattgaattttaaacattcttgtagtaaaagtcatagagaaacacttacatctgttcttctggaaaatatttttgtttagttgttccaatcagaaaaattcatgctctgaccatcacatgggcacttcctcctcaacagcaacattacaggtaagagtttaagggaaaatttacttcattagaaccaagtgagagtaatttttaaagcatgctaaatggtttaagtttgggggttctgaatttataaacatagcaatacggtaacctggaacttgattactccgggagctttcaagccttgctatgtattttactattttttggatataaaaactagagctttctcagttatagtggcctttcttaagtctttgaaattaagtgtttagtgtgaatgctaacttttgtaatttgtttcgatcttgtcaaaaataaagttaaataatttgggcctggcagactggccaacatagcgaaaccctgtctcgactaaaaatatcaaaaaactagccaaggcgtggtggcacacacctgtaatcccagctactcaggtggctgaggcacgagaattgtttgaagctgagaggtggaggttgcagtgagttgatattgcgccactgcactccagcctgggttgacaaagcaagactctgtctcaaaataataataatttggattggtaatatgactagggtacataaatcccaaggatttactcctctgaattagggcaggtttatgcagattgggaaaggagttctacttgtctgtatagttatcttatatgagcagtgtagcatgggccagagaattatttaagttaaggatcagtcaatgcctacaaatgcttttccagttagaaataaatgctaatcaactgataaaaatttaacttttttgggagggggggtggggctcaagcagtccactcaccttggcctcccaaagtgctgggattacagacatgagccactgtgcccagccaaattcatattttaaacaaggttgtatgggctttaaggattgcctaacatagttgaaaatcatatcttgacattcaagaatttactgaatttaactgtgtaacctaattaaattttctcatatatacagaaatatacagaaaactcaatttttttctgtatgtctttgtggtaggaatactttaacaaaattacagtagaggccagggggaaagacagtttgaacagcatgtgcacaattactcggactattacattattagtatgtgataaagcatttttatacttgttattgcattttcatgaaaactctgtgagtaagtagttgggcaagtgaagagaaaaagaagaatacggttaagtatcttgctcaaggtcatgatttacttaaaggaaaaactaaaactagaaccaagattttctgaccctctgaacaacacatttcattttaccacagaacccaatgtggtaccaaaagcttttacagacagtaattcatacctatattaggttctagactgataaggaatctacatttcatattgggtgaagcaaaaagatttatcatgagagcagataagtttggtgtccaagagaaaaagtagtgcccttaaattttgggatgattgtactcttcagtaatctcaaatgaaagagttaattttactatattttctgtttttatcttcctgctactaaattaattataatttcatgtttagtggacatatgtgagaataagtttgtgattatattttcaattattgtagccttagaggtaagattttctggtgtatttataccttttgtttttttcttctgaccattaaatttttttaaaagggtgaagccacttcattatatatcctggctggttggacatgaaggcaaaggcagcattctttctttccttaggaaaaagcaagtattcaattaataagtattttcagtatagcaatctctgaaaaatagtagacaataagtattatataatgcattcttttactttagctgccaggaagcctagaataaaatttaatgcttaattatagttattttaataacttacattattttaatggccatattatatttgtgtatttccttgtaagccaccttttagcccattgttggaagttatttgtacacaaaattttaaaaaatcataaatgaaattaatagattccagaattacataaaagaattagctctaatcaagaatttatatttgactgaatggtaaagaaatcaattatttaaatgccatggatctccaggctttcctaacccccaaggctagactttaatgaaaacttcattgggtaggtaaatcatagttaataggtgggactgcaaatggtatatgcagccatgttagcagaatgtttcctaagcattaaagcacctgtttaagtcacctatagccaaataatagaaatacaattttagaatcaagactaatatattaaagtaattccttgtttgatttttctataaatgaatagtatgagaatggaaggatagatgagacatttaaataagtatttttaagacactttcgtgtactagaacattcaaagaaaactaagaggggagagttaactataaaataataaactaatgatattgggttcatatgtaccttacacaatatatgttatatgctttgagctgtgcacaacctttctaccttactgagctttattagaatttcagactctattctggtgtcctctctttttaatttttcagaattaatctagtcagggaaaggtatagtctcattatttctttcttagacaacctatgtaggttagctgacagcctcaaagaactcacttgacattcaatgtaagtatgttttagaagtgtcttaaggcttctcctaggagacaggttcaaaaatggtgaggccaggcgcggtggctcacgcctgtaattccagcacttgggaggccgaggtggaggattgcttgagcccaggagttcgagaccagactgggcaacattgtaagaccctgtctttattaaaaaaaaaaaaaaaagaaaagaaaaggtaagcaaaatgctttccagcagccatcatttgaatattttgtgctgttctcttcaaaaggaatggttttggcttaataaaactgttaatgttttattatggtgccatatctattcgtatttgcattaaacaaagactgttatttccttctggtgattcctaaatgtaccacaattccttgggaggctttgtgcttttaaaatttgcacttttagatttactgttggaaagtatatgtttacattcaaaggctgagatttccacattttacatagaaagcctctatattttgttaatttgaatgtctgtagactgtcaatccaggaacattgattgggttaattttttccccacctgtagatgctgggctcttgcactgtttggtggaaatggtgagacaggatttgagcaaaattctacttattcagtgttcagcatttctattacattgactgatgagggttatgaacatttttatgaggtaaataattcaaattcagttgttttttccttttacgtagatatcactttatgcaaaagactaattggatgttttgttttcaggttgcttacactgtctttcagtatttaaaaatgctgcagaagctaggcccagaaaaaaggtaataaacacttcctggaatgaggccaggagccagtcctggtatatttgaggcttcaggctgccggtagacatgctttagtcttgccttgatggtttttcaggcattttctgctctatttcctttattgactccatatccttatccctctacatgtgattgtatactaaggctttacacatatgtgggcagtccctttattttcacgcttctcttttattgttgatgcttctattgagaattttttaaacttttattctaggttcaggggtatatgtgcaggtttgttatgtaggtaaacttgtgtcacggtggtttgttgtacagattattttgtcacccaggtactaagcctactacccaatagttaccttttctgatcctctccctcctcccgcccttctccctcaagtaggcagaaattttaatgtatcttctaattatagttttctccttcacagaatttttgaagagattcggaaaattgaggataatgaatttcattaccaagaacaggtactggaagtcaaattctttttgcatgttatctgtgactgagttgaagctggtgtagacattgttcctctttttgaaagtgtcggtggagttttaattctgtcattctgtgtcatgtgagtctccaggtggccttgaagctatctgaaaattaactattgggtttttgagtatttatattgagtaagataaggcagtgagaggattaagcagatgacacagatgatgttgtgtggtaatcatttatctacatagtcatccatctatcccttcaataaacattcatggagacttgttatggtatttaatattttgggaattcaaatattgtgaagacattctataaggtaatttatatttaccatgtataatgttagaaacattgtgctttggaattcaggggaaggagagcattttccttgattgaaataggctcacaggctgggcactgtggctcatgcctgtaatccaagcattttgggaggtcgagcaggcaggttgcttgagcccaggcatctagtaaaggactgggcagtgtggtgttttgggaagcgtatgggatatgttatgaggtcagagttctgatgtccgctctgcctgtcgtttactcactgtgtgaccttaggcaagccatctagccatctagtcaggaaaaatccgactatgtttcctcattgtaaaacatgggactggaaccacttggtatctgaaggacctgtcagttttaagagtctgtgtatctgggtgctcggtaaatacttgaattgactacgttcctctggaaaaatatttccatttcatgtatcagtgaacaagtggtcattctttcagttttaaattaaaataatatttttattaatataacttcttatcgcaagacttttatctgacagtcacattttaatttttttaaaattttaattagagacagggtcttgctgtgttgcccaggcttacctcaaactgggctcaagttatcctcccgcattggcctcccaaagtggtaggatcacaggcatgagccaccatgcccagtcaacacattttgatttttttttttttttttttttttgagacagagtcttgctctgtcatctgggcaggagtgcggtggcatgatcttggctcactgcaacctccgcctcccaggttcaagctattctcctgcctcagcctcccaaatagctggaactacaggcatgagccactgtgcccggcccaacacattttgatttctacattgatttgattcatgcttacaaatagtgtttagacgatagtgctgtagtgataggttgcctgtctttattgctcacataatcatgtggggcacttgactggtaaacaggcattcatagtccagtgtggtaattgctctcatgaagaggctgtgatatgactagaacctaatgggttatagggctcagagtgatgcatgaagggtatgagtttaagctccctaagggagtagctatggctatattttcttagaattttttttttttggagatagggtcttgctttgttgcccatgctggagtatggtggcacgatctcagctcactgcagcttcaacctcctgggctcaagcatccctcccacctcagctccccaaggagctgacactacaggcgtgtactgccacacctggcttatttttgcattttttgtaaagacagggtttcgccatgttgcccaggctggtctcaagtaatctaaccacctctgtctcccaaatgctgggattacaggcgtgagccactatgtccagcctactgagcatcagattcttaagctgcaattatatctcgttgtatctgttcagaagcttttggttttattgttaataagaaagggagaaagtatttgtatgttgtggtaaatcaaatataataatggagaagttctggtgtgaaataatttacctctttacagacagatccagttgagtatgtggaaaacatgtgtgagaacatgcagctgtacccattgcaggacattctcactggagatcagcttctttttgaatacaagccagaagtaaggaggtttatacgtctaaaacttacttttaggggaagaggagggtgagaaagtacgaagatgtatttaagaaccatgggaacgaagaaaacttagttatatttagtcaggatttttgtttgtttaaacagaagtatcaacagttttgtgaataatttctcatggttcttttacataattaagttttaatataaggagaaaatcaaactcagtacttgttaggtcctattttaataattttcaaatgttgaaacatctactgcaatagatgaagtgattcctaagaattatgtggtttccctgtgaaaaatacgtagttgtttagcttaccttttaattcagttggagagtcaggacaattaaatttttaatcattttgaaaatatttattaaaaaaatgtaaggttcccgaattagaaacatatgacttagggataatgttacatgccaatacattgtcggtcagggtcattccttcactagtggagaataagtcattttgtttcatacaggctagcgcgcgtcaaccagaggtgacttttgccttccaggggatatttatcactgtccggagacattttggttgtcacaactcagggtggggcgtggggtgctcctgggatccagtgggtggaagccagggatgctgctcaatgtcctataatgcagaaggcaggatcctaccatagttatttgacacaagatgttcatagtgctgagattaagaaattatagggcattccttgagatattttagcatagacgttcctaaactattaattttaaagaggacagggaaaggtaaaggaggaaggaacaaccacacattcttgccatgtcactaggatggttgtgcctggtagtggctggttgtgtttttttctgaaccaccatttgttgttttatacttaaataaatggtgtttaagtagtagttagggctccaaaccaagccacaaaattctgtttagtccttattgtagctggaggattactgaaggaggccctatcttggcagtgttttactgattcctggatatgaagtgatacaaaacatagctgttaggagcatagtccttggtagcatgtacaaatttagttagaactccacttttgccacttctagctgtattattctgtacaagttacataatctttaacctgagcaaattacttaaccatcacccaaagctgactgttattttgtgtaaataagtatatcttaggattgtttttaggaataaatgaaataatgtatgttaaatacttcctggctcacagtagaagcttagtagtaaaggatagctatttttactgctaatgctgttaatatgtaggatttaagataaacactgtttaaagcattatcaagaatatacttgatatttgtcaactatacctcaataaagtaggaaaaaagtttttgaaacactgttgagactttgtaaattagggtgttcatgaactgtaggtatttttatgagcatagatcttggaggtgcctaacaatgtgatttttgcctttttaacagagatgtattaggttaaaattgtgtgtatctctttcccctcttcccactttactaggtcattggtgaagccttgaatcagctagttcctcaaaaagcaaatcttgttttactgtctggtgctaatgagggaaaatgtgacctcaaggagaaatggtttggaactcaatatagtatagaaggtaaaatattttaacaattgtcttacatttaggtatatttaacttacctggaaatgtttattctttaataatttaatggttctagagggggaaaaagtataattttttaaaaagttcactttgaaatgaaaattacttatactactgcacaggaagttattttctgctatgtttatatttactaactagtgaaaaaattctgttatcttggtattttgggggcagagttttgacttagttttagaagaatgcttctcaaatgtagtgtgcatttttgtcacttggagatcttactaaaatgcagattctgagtcagagggtctgggtagggcctgagattctgcatttctcttttttcttttcttttttttttttgagacagagttttgctcttgttgctcaggctggagtgcagtggtgcgatcttggctcactgcaacttcttttgccccctgggttcaagcaattctcctgtccctgcttcccaagtagctgggattacaggcatatgccaccatgcccggctaattttgtatttttagtagaaatctgtctggggtttcaccatgttggtcagtctggtcttgaactcctgatcttaggtgatccacccacctcagcctcccaacgtgttgagcttacaggtgtgagccaccgtgcctggccagattctgcatttctgacaatctcccaggtgatgccagtgctgctaggaccacactttgagtagcacgattctagaatgcctggatatgtgtcagtcacagtattcctgagaaaggataattgatttgtaagccagttgataactagtttattattaagagaatgttgaacattgcattgtttattgggtcagtttatttttctcctttacagatattgaaaactcttgggctgaactgtggaatagtaatttcgaattaaatccagatcttcatcttccagctgaaaacaagtacataggtcagtaaaatagcaatttttatacataatccatccatgtgctaataggcacctgtatagcacattatattttacaaagtatcgtaggaatttatatttgagattcccagtaacattctgaggttggcattagtattttcttacttttccaaatgagaaaactgggggtcaaaaaagcaaagtgactggtacaagactattcagttggtgaataagaaaccaggatttaaacacagatcttgggactctgaagtttatgctttatcttgtatagagtagctgatcctttcataccaatctccttagggattgccattatcttgccagatttttctattgcttttcaaactgcaggtggcagcccattagaaggttgtgaagtcaatgtaatagattgtaaggtcagtgtaatgagccatgaaagcattaaaaaatcagttagaatagaaaatagcaaagtgtttcattgcatgtagaaataatgttattttaagaacttttgtttcagatatctgcctgtctactagcttgcagtggaaaacatatttctaagtgagttgcagaaaaaaatcattgaaagctaccaatcctaggtccaaggttttagagttgcttataactgtaatttactcagaacactgtatttccaagccattcattacatgtctaagtatatacccaaaataattgaaaacaggtactcaaacaaatacatggaccttcatgttcacagagcactgttcacaatactcaaaagatggaaacagcccaaatgtccatcagtggatgaatgtataaacaaattgtgatgtatacatactttacaatattactcataaaaagtgtagtactgatacatactataatggggaagaaccttgcaaacatcatgctaagtgaaagaagctagacacaaaaggtcacagataagtccatgtatacgaaatattcagaatagataaatccagagacagaacatagattgatgattgctaggggctgaggtgagtgggtaatgaggagcagtctcttaaggagtagggggtttccttttggggtgatgaaaatgatttggaactagctagaagtggtagttgcacaacatcgtgaatgtattaatgcttctgaattgttcactttaaaatagctaagtttatgttatgtgaatctccctttcattagggaaaaaaagccttttaaaaaagtattggccaggtgccatggctcatacctgtaatcccagcactttgggaggccaaggcaggcacatcacctgaggtcaggagtttgagaccagcctgaggaacatggagaaaccccatctctccagaaaaatacaaaattagccaggcgtggtggcgcatgcctgtaatcccagctatttgggaggctaaggcaggagaatcacttgaacccaggaggccgaggttgcagtgagttgagatcgcaccattgcactccagcctgggcaacaagagtgaaactccatcacacacgccaaaaaaaaaaaaaaaaaaagtattaattatctatattagacacttcagtttcatatcttgaactgtaaataatctaaacaacccagttagcttattattttggttttctgagttagggttttactctgttgcccaggttggagtgcagtggcatgatcatggctcactgcagccttgacctgctgaactcaagcagtcctcctgtgtcagcctcttgagtagctgggattacaggtgcgcaccacaatgcccagctaatttttaatttgtttctagagatgtggtctctctatgttgcccaggctggtctcaaactcctggcttcaagtgatcctcctgcttcagccttctaaagtgttgggattacaggcatgagccaccatgcctaccaaatccagctcttttacctaaatatagcaagtactcaaattttaaaaattagctatttttcatctatgtgataatgaaactgttgttttaattaaccaaaaggacaagtttgactttgagcagaactattttgtaacttttcaaatgtatagcataaggttggtaaaaggcattctcatgaattaatggattgtttaataaattggtttatgaaactatcctgactaaaggctcctctctcagttaaaattgtctgtaagaaagggaatgaagcagaatgtgtagcaaccagaatcagttcttgggaaattccagatctttagaatttatttactttaagaccaacatagttttccctttggtattggtctaatttaatgtattccaacatttgaatttggcttatttttgccacagagaaaagttacttagacttctgaagccaataacagattactggggctcctgctgaaatacttgagtgaattattattatcttcttttattagccacggactttacgttgaaggctttcgattgcccggaaacagaatacccagttaaaattgtgaatactccacaaggttgcctgtggtataagaaagacaacaaattcaaaatccccaaaggtaaaatgttgccctcctgttacttccctgctgaattccagtgttctctttagatgctctgtttcacatgtgattatctacttgctattttgatcttcctttgtggaggaggctggggctgggtgcctctatcagccaccttgatgccctctcaccctccctaaaaggagtaaaataagtaaaacaaatatttctccactttgctgtaacttgcttcccctgtgtatatcacctacttctctttccttttccccttccgtttgaagactttttctaggcttatctaccagatttatactgtcctcctatgctgtcacagaaatccttatggacactccagtgtccaggaaatgaaaatttaaggctagaatgaaatcgtttttagatttttttctttcagttaaatgaaagcagagccaggtatttggccatcttaaggaactcgtgtgatttgaacattgttgtttttaaaaagagataagaatacacaaaggaattattcatagacagatagcctagtccagcattacaaatgtgaaagccccaccaactgcctccttctaccatttttttttcagcataaaggaagcatagtatagagttaagtagactctaaagtccttatctttaatgttgtggccctaagtgtgctgctttttaccgttctgttcttgaacatggcataaggaacttattgaagccacatggaatcataggctgggtgctcttgtatgtcatttaacccatatccccaacctcaaaacacaactatattgtagctctgtgggattattgagtttattgggaagttattttcataattttttttgaatagcttatgagtttctaaaaatctcctcaaattcagtttccttggaaagcctctgctgtaaatttgtgtgaatgctggagttgttctcttaatgttcttagcatctgtcctctaaaaatttttcctgactgaagctattaataagagtatttataggcctctctaagtatctgcccttatgtctggtcttcccatagattaaagagtgccttttggaactctttatttggaatggtaaatactgctttttaaagacccttaagaataaagatgtaatgaggatttaaggattagtagtttacttcagaatttaaaaaatatatatattaggggaaaataacagatgtataaaatatctgaggcccctaaccttttttatctatggtcttttttcttttagcatatatacgtttccatctaatttcaccgttgatacagaaatctgcagcaaagtaagcaattgtctttttttctggaaaatacattttttagttattgaaaaactattttgtttcattctaaatcattctgtcattttctctatccatatttgagctatgttgctgatttatgtatttttttctgtactccaaacaagttatttgtattattaccaaacattaaaatggaactgtggctgctccattaccagcacccattggtaaaacatgctgatagtgtagactagagcaattagttcccagttactggatggggaaaagtccttaaagatcagtttgggtgagtgcccagtctataatgagactgatggatctgttgattctgtatttatagactaccaaggaatgtgattgttcctgttcttagcaaatcccttatatatttatgtagatagctttcattgtgggtggtcggagaccctaaagtgtatctgaacataggagatatttgggaaatgtgtctgaatataggagatacttgggaaatgtgtctgaatgtagttgatatttcggaaatgtgtctgaatataggagatacttgggaaatgtgtctgaacgtagttgatacttcggaaatgtgtctgaacctaggagatacttgggaaatgtgtctgaacataggagatacttgggaaatgtgtctgaacgtaggagatacttgggaaatgtgtctgaacctaggagatacttgggaaatgtgtctgaatgtagcagatacttgggaaatgtatctgaacttaggagatacttgggaaatgtgtctgaacctaggagatacttgggaaatgtatctgaacataggagatatttgggaaatgtatctgaacgtaggagatacttgggaaatgtgtctgaacgtagcggatacttgggaaatgtgtctgaacctaggagatacttgggaaatgtgtctgaacatagcagatacttgggaaatgtgtctgaacgtaggagatacttgggaaatgtatctgaacgtaggagatacttgggaaatgtgtctgaacatagcagatacttgggaaatgtgtctgaacgtaggagatacttgggaaatgtatctgaacgtaggagatacttgggaaatgtgtctgaacgtagcggatacttgggaaatgtgtctgaacctaggagatacttgggaaatgtgtctgaacgtaggagatacttgggaaatgttggtgcatttcttctttcttttcctacgtaactgtaaaatccaaacttaaaatgacaagcagcactagaatttgttaatattcactctaaaaaatgcattcccaaactcatatttttaattagtcagaatgcctagacttggagggtagacagagccttcaggccagtgctgctgatgcctattccatttacctcattgtacaatataaatattatcattttgcatgtgtacatgacatgaaaaagattgggaaacactgctgaaggtaggaattctgtaatacacctctgaaactgaatcctgagtaagctgtattaccttttacattctggagtagagaatttatactttctaaaaatgaagctgcttactctaaattgaagcaaatctatttcatgtgtctttcttaccaattaaagatgccatttgcattttgtacttcttagtgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctgtaagtacaagtactctgttttccttatagagagcattaaaataccatatttatttagaggtttgtgcatgggatgctgtatagagaaataaatgtttattaatgtggattatcttgaatattcttggctgatgacagctattctaactgtgactgactatccataagaacaacatatgtttcattaattactggcagtgcatgggattatagcccatgctttaggattgatttcacttccctttgctgtcagtttctccacaaccaacactggcatttaggattggttctagctaaattttttaccatacaggaataaccttttttttttttttttgagacagatactcactccatcacccagactggaatgcagtggtgtgatcttggttcactgcaacctccgcctcccgggttcaatcagttctcatgcctcagcctgctgagtagctgggactacaggcacgcaccaccacacccagctaatttttgtatttttagtagagatggggtttctccgtgttggccaggctgatctcgaactcctgacctcaagtgatctgcctgcctcagcctctgaaagtgctgggattataggcgtgagccaccatgccggctgtggaataacaaatttgactggtgttttgcctgaaatagagtagaactcaaatgcttgtgcccttacttcctcatcttatgctcctcattgtttcaagtatgtgtgtcttgtttcccttctaagtttatgaacctttccgaagcagggtctgtatcatgtcagttattaatctcttagtgagaaatatgttccagtattgcttcatcaaaaacttcataagaggaggaaaaaataatgggttgttagctaagagagttagattactgaataccaggtaaagcaatataatatactcaataataaattttatatctaggtttcttgggtagaatatatattatattaagatttagggaaatagggttatacaagaaaaattttagaggaaaggacctgccagaaagacctgtgctaggtgttaatagccttcatctgggcaaaaacccaagagaagagtatagctctcacctttttatgccttttcccttctccatctccccatggaacaaagattggtctcagaaggagacgccatcagtaaagaactatcagcggacattacattaactgataaaatgatgatcactgacatcagcaacaagccaagaataattttactttgtcagcctctgaggcctaaatataatgtagcttaagtttcaagcagattaaagcctaattcagtggttgtcatttggaaaatatgttttagaattacctggagagcttattaaaaatacaaaccatggaaaagtatttgatattcttgaatttgtgagacttagccttaatattaaaacctaatatagaacatatatatatgtatgtatgtatgtatagaaaactagagatcaattttatctgtagaatatagatgtaaactttctaaaaattaaatccagtttagcaaaaagaataattcaagtaccaggaatgctagggttgtggaatattaggaaattgatgatcataagtcaccacaacacaagtcaaaggagagccactgtatgaatatagtgataaatgctgataaatcatttgataaatttgagttggcattcctaatacataggaatggaaggaaattaattaagtataaaaacctcagcctggcgcggtggctcacgcctgtaatcccagtgctttgagaggctgaggcgggcggatcacgaggtcaggagatcgagatcatcctggctaacacagtgaaaccccgtctctactaaagatacaaaaaatttgccaggcgtggtggcaggcgcctgtagtctcagctactcgggaggctgaggcaggagaatggtgtgaccctgggaggcggagcttgaagtgagccgagatcgcgccactgcattccagcctgggcaatagagcgaagactccatctcaaaaaaaaaatcaaaaaacctcaagtaaagaactatcagcggacattacattaactgataaaatgatgaacactgacatcagcaacaagccaagaataatccacaatcatctctattattctgttattgttttagaggttctggctattagagtaagatgaaaaaataaaaacttttttggaaaaaatatttttccttgcagatgatatgattgtattcttagaaaacctcatataccactaaaattaaaaaaaaaattaggtgtgatatggctggtcaaaagactagtatatcagaatcaatggctttttctcccccatagtaccagtaatcacttagaaatggaagccaggcacagtgggatgtgccggtggtcccaactcctccggagtatgaggcaggagaaatacttgagtttgaggatacttagctatgatcgtgtcactagcctgtgcgatatagcgaggctctgtctcttaaaaaaagaaagaaacaaatggatggaaacaatcttacatttatttacaatattgagaaaaaaagccaataaaatggctaagaataaacaggaaaagtataggatctatctgaagacaaactacaaatcttattgagaacacccatgaaatgataaaaaaggaagaattgttccaaatttgacaattatttagaattttggacccttaagattctttgaggctaggaggctgaggcaggaggatcacttgaggccacgagtttgagaccagcctggcaacataagaagaccttgtctgtacaaaagcaaaaaaattagccgggcatggtggcccctgtctgtagtcccagctactcaggaggctgaggtgggagtatggctagagcctaggcattcgaggttataatgaattacagtcgatagtaccactgcactccagcctgggtgaccagtgatatcctgtctccaggtaacacccaaacaaacaaacgaacaaattgagttgttagtaattttcttatgtccccccacaatgcctagttccatgctgggtacctggtaaaaaccaaagagaaacatttccctccctaatacctagtggatttccatgcttcttaaaatgcttccttctttttcttttagctactgtttcagctcattattgactacttagctgagttcaattccacaccagctgtctttacaatgataactgagcagttgaagaagacctactttaacatcctcatcaagcccgagactttggccaagtgggtataaatgagatgagcttatattttgaggacctgaaagtattactctccctagtgggtgggtgtgggggttaaggctatagttgcagtgctaattttcatccgtgtttgaatcgtgctctagtttaggagacccgtgcatagcgttacggtatttctaaacccagcttatgtagctagctgtgaatgggactgaaagcagcttactgtagagactaaaagtaaggaagggtgttttcaccaatcattatacctgaatgttaaagaagtgctagttttaggccgggcatggtagcttatatctgtaatcccagcactttgagaagctgaggtgggaggatcacaagcctagaagttcaagactagcctgggcaatatagcaagacttcatctctacaaaaaattaaaaaattagctgggtgtggtggcacatgcctgtagtcccagctacttggcagactgaggtgggaggattgcttgagcccaggaggttgaggctgcagtgaaccatgatcatgccaccgcacaccaacctgcatgacagagatagaccctgtctcatagaaaaacaaacaaaaaacaaaccagaagaagtatttactggtgattttagtatgttggtgattagtagctgagttaaattgctaaacatgtcacttatctagcaatcttaactatccagaattcagccaagcttccagaagagagcagaaaggcagctacacagtctgtatgctaatacttaaaccctctgctcacaggcaacccccttgggccttcattcagagcctgttcttactactttagtccagggctaattgtagcctgtaggatacttttgcgtgaatcagaaaaaagtatccttctgaggtaccctctattagcaggtagagcctttgtgggagggagagaaaagtcctctgaacagacctacccctttgtgcacatgactggctagcccctacttgacagttttgccctgggcatctataaatagtgaacagcgtaaaggttctgcttttgacacagctgtaatgaacccatcagtttccagaattagaaagaaggggttaggaatcagtcatgtaataactgatattctgatcacagaaagttacaaaaactaataactagatatatgttagaaaggacatggacacagggagggaacatcacacaccagggcctgttggggggtgggggtgctgggggagggatagtgttaggagaaatacctaatgtaaatgacgaattgatgggtgcagcaaaactaacatggtacatgtatacctatgtaacaaacctgcacattgtgcacatgtaccctagaatttaaagtataataataaaaaaaggagagttatctgcaaccattgatacagtgaatagccctgccaataactcatgaatactactttatttatttataaaaatacattattaaacacaaccttctattttattaaaattcaactcctgaaatttactttataaaagaataataataaacctgtttgttgaagatttttgtgctagatctaagaactgttatataaattcattaattcaattctatccaaaacggttacctctcacgaatacttcccctgttttacaaatgaagaaattgaatcatagatgttagtagatttgtcaaattcaaacagcttatttggggtggggttgtggaaatgggggatgaagttaatctgattctggaccagagccgttacctgtattatattgtcactgcagtaatagatatcccaaatgatggcttctagtaattaatgaaatattagtgagatttcaaaccaaaatagtaataattttaaatcagtgtacaactaagtaaacttgactcatctggcagctttacttttatgtgaaatattttaccctgcaactgagacaggtaagtgcatttttgtactgctaagtaaatttgtttaaagtttgtgtatgtggttttcagtacttttttggttaatctgatactgttttcccatcttacattgtgataaaaatggtctctctttagaaacacatcctttatagaactttgaccaaacatttctttattctgaagattcatttctaataacaaaactttgagtgttttttttctgccctctgtacagagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagtgagtgtgagatgctctgtaggccaggtctgaatgcagttgtgaactctggaattgccatagttctttcctaaaggggaagctgtagttttggcaggccagcattatcatattctgtttagaagggaacctgacccctctgatgctgggcagctttcttcttaagatgaagactgctgggctgggaatgatggctcacgcctgtaatttcagcattttgggaggccaaggcagaagcattacttaaggtcaggatttcgagaccagtccaggcaacacagtgagaactcatccctacaaaaaataaaaaattagccaggcatggtggcacatgcctatagtctccgctacttgggaggctgaggtggaaggatcatttgagcccaggagtttggggctacagcatgctatgattgcaccacagtattccagcctgggcaacagagtaagaccctgtctcaaaagaaaagaaataaagaaagagagagagaaaaatagattgctggtaatagactaggattttgagtgaaatgggtttggcgtatctatactgtttgttacctttgttgaagattgtatgtggaaaccatgaacagtttagtatagaggctaaaatgggaggaaggaaatggtgagggatgtgtgtgcatacatacggatacatacatagatacatacatacatagccagaactagtatgtcaagcctgtttgtgaagctaaggtgctgggctttatcctgtagaaatggagaaccattaaaggatttaagaagatttgtggttaagaaatatccagagagacaagttatgaagctgttttaaagtacagatatgattccactcataggagttatctaaagtagtcaaattcatagaagcagaaaatataatggtggtttccagtagttggggagaagagggaagagacaagttattttatgggtacagaattttggttttgcaagatgaaaaagttctgaaaatctaatctactgcacaacagtgtgaatatagttaacattattgaactgtaccccttttttttctgagacagagtctcgctctgtcacccaggctggagtccagtggcgtgatcttggcccaactgcaacctccacctcttcggttcacgccattctcctgcctcagcctcccaagtagctgggactacaggcacctgccacctcacccagctaattttttgtatttttagcagagatgggatttcaccgtgttggccaggatggtctcgatctcctgacctcgtgatctgcccacctcggcctcccaaagtgctgggattacaggtgtgagccaccgtgcctggccctgaactgcacacttttaaaaatggttgagattggccaggcgcggtggctcacgcctgtaatcccagcactttgggaggccgaggtgggcggatcacaaggtcaagagatcgagaccaacctggccaacatggtgaaaccccgtctctgctaaaaatacaaaaattagccgggcttggtggcacatgcctgtagttccagctactcgggaggctgaggcaggagaattgcttgaatccgggaggcggaggttgcactaaactgagactgtgccactgcactccagcctgggcgacagagtgagactcctcgtctaaaaaaaaaaaagttgagattataaactttatattattttatcaaaataaaaagctggagtgaaggctgtgcaaggcggcccacgcctgtaatcccagcactttgggaggctgaggcaggcagattgcttgaggccagggattcaagaccagcctggccaacatggtgaaaacctgtctctattaaaaatgcaaaacttagccaggtgtggtggtgggcatcttgtaatcccagcttcttgggaggctgaggcagaagaatcacttgagcctgggaggcagaggttgcagtgagccgagatcacgccactgcactccagcctgggtgacagagtgagagtctgtctcaaaaaaaaaaaagagttgggagtgaaaaatattgaagcctgatgttaggccaaataaatgaaaaataattgcttaaggctggacatggtggcttatgcctgtcatcccagtactttgggaggctaaggtggcagaatcgcttgagctcagtagtttgagaccagcctgggcaacatagtgagacaccacttccaaaaaaattaaaaaaaattagctgggtgtagcaatgcacacctgtaatctcagctacttgggggctgaggtgggaggattgcttgagcccaggaagtggaggctgcagtgagctgaggtcatgccactgccctccagcctgggcaataaagcaagaccctggtgtttttttttgtttgtttaaagaagtgcttaagaaatagaagatgatggaaattcactcagtgggagtgagagagaaggcagtctagaatgatgcccagatttctttcttgaagcagtgggttggtggaacaggaacagtagtaagagtgggagcatatgaggagtttgttctgatacgtatttagttggaaatgtctgtggggccttgtacctgactaaggccttttcctcagtcagatgcttgttcaagattctctccctgaactgttttgttattaaccatcctcctccatgccttcccagtttctcagggctggccctttgattggaatatataaatggccactcttgaaattgtggctgctatcctcccctttctctctatcttcattctgcaaccccagaaccagccttagtttctgtcttggccaccaaaagaatcttaagtctcagtccacaaagggaagagaagaaataggctgcctgtttttccgagcaccgttgaagtaccaggcaagggcttttgatacagagtccttagtaccatgaatttcctccagtagaaatcactttagagaagagctaatccctccatttatcccttattttatagataagaaaacagaattcttaagaagggaagaggatgtattcactcagtattaaatgttattttctttgctttatccaggttctatgtcaatgggcccaggattctgaaacatagtccatgttgtcataaaggccacagcctagttgggtaaaccaacactgaacaattaagtttgatccagttgggaaactgtattatgggtaaacagattgccaagagagccagaacagttaagagctgcttagtgttccacaaacacaatcaatcttgaatcagtcaatgaataacttgccagcatttaggtcaccaactatatctgctttcctaaagctatgcagggctccccaagcaattggaacattgatattagctgattctgggtgaaatgaatgtctagagagcttaatgtagttattctcttttgcctcttaggaatctatggatttcctgaaatatgttgttgagtaagtatttgaattttctctttggggttatgtgttcttaccagcgagagggcatggagccacaattcagttaattgttactaaacacccaattgaaatactacttgtagtagatttttttgaggctggtgtacaaggcaattgaaaagttagaaggcctagcttcttatagtttttgggtgcctcagtgacccatactgattctcttgcagcaaactaaacttcaagcctctggagcaggagatgcctgtgcagttccaggtggtagagctgcccagtggccaccatctatgcaaagtgaaagctctgaacaagggtgatgccaactctgaagtcactgtgtactaccaggtcagttgggtgtactaaagactggcggaaggcccagtgcctggggatcagggaccccgtgaccttcaaggcccttttatagttacttctgtagtttcatgcttggggccatttgtcctcttgaagcaactacatttaaaaattgctcctgttggtaaaatggatcctttttcaatcacagtgaggtattgcttcattaatcacctaagtactaatctagagggccagaaaccgaggtgtgggtggaaatccctacatgtgcccctgatagaactcccaagtagcagaaggacatttgttaaggggcagttttgaaaagaagacagaagtaaacatagccaaacaattaagacacagcaaagagaacgactactagagtcataaatgtttaaagcacctgagaggaaggatttatcacctctgttttagggtgacaactccatgatccagagccccttacttcttgaggtcgtaccagctgggtctcagattattccttttgtcttcagattctgtgttctttccacaccattctactggggtgtgtggtgcttaaaggaaggaagcacgtggcagtaatcacagttagctctagcctatagcctgctttaacctgtggttggtcccactcgcttctagaaccacggggatcttccttaaaccttgcctgtctagtctgattactgactccccaaattctggggctcctgtagccgctgctgttatcttgggttccctgcatcaggaattcacttctttgtcaggtcttgtgaagatccctgactgggctttgggtgggatggactgattatcatttctttgtcttgtatctctgcccctgggcctcagccttattctgacattatcctggtctggctgtcaggagcaaattcacttgcccgatgtcacggtcatctcttgttagtgaagttgtgtcttgtcctagtcttcttaatgagtactttgattcaggagcaacagcacttttggagctaggttgataatatttttgtccttccgtagaggccctgcttctctctggagcctctgtggctgtagcattccaacctgcagcctcttctaggttatgactaccaggtcccaaactccacaaatggtacagcctagcctttcttaacctagtctacattttcagtgcctctgactgcttacaaccccggtacaggagtactcattttcggcaggatttcacattgtaagactatgtttatagaaatgctttccatcagtcacctcttagcactagcttctaatacaaactgttcccttttggaaaccatatcctttctcagagagcattggttttgttgtggtctgtttagagggaaacagaaaatctcaatgctgactaatcaggtcttgcaagggcacataggcattagcctcttcctctggtgagtgggaagcaaatgagtctgtgtgagaggaacctgcaagatcctgactctgggaggcactagcaacatccttgtttattggcctcctgtcctttcattctgaatgcattattttgccagtcttgggcagctagcatgtggtcccaaagcgtggcttctttctctgaagtatttttcttatcaactggttttggtccttttatgtggcactggttcttgttgtgtggcactattcattttctctcctcttgaggaatagatccagatacatttcaggatccccaaacatttcctgctgtcttccttagggctttgagttgcaagtacttaattttagaatgtgtcctctgacaggatctggcaggtcagggattattaatctcacctttgtttgcacctgcaattctatgctagtgccgggagtacaaatggtcaagcatgactcctgtcctcatagaccttcagtctggtgggaaagcagatatgtaaacaacatcaaagtatgattaactctcttgggggagagcgattggtggtgatacctaagtggttgcctagaatagctggattatttaaaagccctgtaaaccactggatattcagttggcctgacaaccttctcttttcagtcaggtaccaggagtctaagagaatatacgcttatggagctgcttgtggtaagtgcataaaggagatgctgaggttttcagcagcccctgacccactatgaggcccggccttttctgcctgggttagggacatggggtagtcagagatctgtgatttgaaggtgagatggtcatttactgttctcacccagtataagcctgggccaattaggaaaaaggcactaagggaggctggacttgggaggtatgtgaaacactctggggagagaaatggaggtttctctgctgggaggagttgggctgatgggcagtatgttgaattacagatgcacatggaagaaccttgttttgacttccttcgaaccaagcagacccttgggtaagtcagctggcagggccactgagctcaaataagggcctagggcttactttgcaggctgttcatcagatatccctactgagcagcctgttagagcttccttccatctcatagggtgatatttagtcatccaaacttttggaatttgtatctttgactgtaatcaggttttcagtttggtcaagtttcaagataagaaaaaaggctagtttgtggtccccaattcaggagaggtatggacaccttaacatttttgggtcctgtttcaggacttccagttccaataaggatgggcagaaacttttcccactcctatctagtgcctccaaggccagggcccagatgatcacctgagctcatataacttttctctctggcttgtaggtaccatgtctaccctacctgtaggaacacatccgggattctaggattttctgtcactgtggggactcaggcaaccaaatacaagtgagtgagtgagtgaatagatgagtgtaacctattatggacatggagagtaggggctacatgtgtttccttaaaccttgggcaaccctgaccaagcaggtttgctctatttagtcagtggaagctgggaagatgggggttgttatagatggtctgttccaggactgatcaatagttccagtggccctttcagacttgattcaagtcctgtggtcattgtgtggggcttgccagtgtttcttctcttcaggcagacctgaggacaagaagggaaaggatgcctgatctgacaggcattgctgaaacctgttagttttcagctttggaatggtcatacatggttgtgactgcttcattatgaggataccaggaaactgggctggaggtggggtgagggggagggttctttctctttctgtcctcaaagtcaggtggaatactgaggcctgggaaaacactttagctttttttcctggatatatgtcttagtcttaattccttcttttgccttctgcctgagatcgggtttctgatgacttaattgaagatgttttgttttagttctgattgaagatgttttgtttcagttctgaagttgttgataagaagatagaagagtttctttctagctttgaggagaagattgagaacctcactgaagaggcattcaacacccaggtgactgtgccagcctggtcttttggcctttggcccacacaagcccccagatacaaatcttaacagggcttcgccggccagtttttgagctttgcagccccaccttcctcttacaatagtgtctccctagcttcatccgtgcctcttatactggcatgtccatcacaagccgggctggacagggcccagtgtgttctgtgggaagtggtatgttgcctcacctgagcatctttctttttggtgggaacaggtcacagctctcatcaagctgaaggagtgtgaggatacccaccttggggaggaggtggataggaactggaatgaagtggttacacagcagtacctctttgaccgccttgcccacgaggtaacatggttttcagagtaagacagctcaaactggtcaaggttcctgattctacaggcatcacaggtctgtgcacaccagcattgtgtggaagagaaactcgaaacactagtcctggcctgattactcgctcacttcctgagttttcagactggcctctctagcaccttaggtggccacgtgagctgggtgctaatccttaccacaccaccaccaatttcaatcagagcagctctatttttatgctatatattgaggtctacaagattttgtggagaaaaagagttttgccgtttaaagaaaattgaggactctttgtctttacggagttcattattccaagtgcatgtgttttgacaacttctattccaaagtagtaaaacctatgaaaaagatctggatcttgtactccagtgtgactttggttaatacatagcccctacatggtgaattaccataggacatcattgctctgtgatgtaaagaggttatttagtaagaggcttcatcttaacacattttagttttcttaatagaagcaaggtagatttcctcaagccgtggtatgcagctaccatgtaattgggaggtgacactaaggggatgtgggtgttgggctcagtgtatggtatttagctgtaattatagcatctgctaacctctcttgccattgtagatgattggtataaaatgtgaaggcatgccagagagcttcatcatcgttttggtctggaaggttaggggtaacctgagaataggaagaataaaatgaggtcttcagatgctaagcaggtccagggacatctgcctgggggttaggtttaagagctatctttcttcttgaatttctttcctatcttcccttcccttgtaagattgaagcactgaagtcattctcaaaatcagacctggtcaactggttcaaggcccatagagggccaggaagtaaaatgctcagcgttcatgtgagtatgtttaactaactccatccattctagggttgtcatttactgagtgagtttgggtggttatcatcagaactcttaaacccctaaatctggtcagcatatttttcacttttgtctttgtcctctttcaggttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaatgtgtttgtttgtattttatggagttagttatactactgccttagggcttccattgaagttttgcactggcatcatagcatttgatttactttttatcctttgttgagactaataaacccagggttactgtaggagctggcaaaggaaaattagcagaatgggccaagcgagaccagaaagcctgcagcagcactttgagaagccctggcctgtgtcctctcagactgagaatctacttcttgaaaggccttacgtaaccagtatattgaataactaactaaatgctaggtactaatacctgtttttttaatgtatttttaaataaaaaagatgatagatagatagatagatatagttctgtatttcccttcagaatgagccatctgctgctgtggcattcattttattctatctatctatctatttttgttcactgtggggtggggatctataaatacacactcttcccaaaccctctaaggcaataaaacatttttggataaaatgttggtaggcagccctacatgtgcaatatgagttaagtgaagattctggggaattgcctggcaggggctaaagacagaacatacaatctgacagaggaaaagaatggatcctccattatttcaagtgtctttctttgaaaagctagctcttgtattcaaggttgccaaataattggcttccaagtttaaccataaaagataataaaagatgcacatttttaaaaaaaaggttggaaaaattactttatgaagccttaagcactaagaataattaattaaactgtaatccaggattagatacaatttaataatagttcaattccaaaataaaagttattgtaggtaagaccatgaaatttcctaacacttgattttaatacattgcgctaattttctaaaacaactcagaggaacccatatttacagtaggcagaatatttatgaaaaaaatctggcatcaggtatatttatatatatgtatgtgtgtgtatacgtatgtgtgtgtatatatatgtgtgtgtgtgtgtgtatcccgagattatatgaactaagaaacaagttgtgtatcttaacagcagtactagagcgcagagtttcagacttggatttataaatgctttcaacgtgtggtgtttggaaaaggagaagacatcatctgattttcaaaacctgaagtttttctcaggactgaagtcaaaatcgtaactgccacagagggaaaagggaagcttttccccttaattgttcatctgcgtcagaaagtccagtatccctgagataggaaccactgtaattagaagattggaatgaacaggtttctcccaaaggaagattgtttgttgctgaattatgcctactgccctgatcatcaggtataaactttgcatcttccaacctaatgcttggcagcaccaagacgtttcagtaatggttcatcataaacccagcattctccatcttcatgaaataactgtaagacaaagaggaagaatttagttacatatttgctttgtacttctgtaatatacttactatttcatatctgctccccaccccgccattagactgaaatgagtttcaagtagggaccagcgatcatcttgtttataaacagtgtttggcacatcacttcttcaacattcactgaaataaattaggaggaacagcacttaggagggtggggcaggcaagcttacccttgtctcccactgaatttccttctccttcctttctcgggcttctgctctttgtctttcttcaagcctgtgctttgcttcagttgctgcatcaatgtctctgatttttaagttgaaagtgacatccttccaaaggctaaaacaaagaggtaagaggagctgccaatgttgagaatgaaagcctgcagccatcctgaatatagtataatacaagtcaaatggctttaagtgctgtaggtcacagactaaatctccttacgctggcaccagggcactgga

SEQ ID NO: 16554 - DNA, 168105 bp, Human
  misc_feature (1)...(168105): n = A,T,C or G
aaagcgatttgctccatgattttcagatttcataatttgtgtagctacaagtttaggcacttttgtatatgtcatctcattcatcctcacaacaaccctaagggcatacaactagtgaatgggagagccaggaatggaacctggatattcctaatgtctgagtcctatttatttcactatactatgctgctttgtctatcagttgtataaccctgggcaaatcacttagcctctgtgaccctgcattacctcatttgtaaagtgagtatgacgattacttccttttagagttgtgaagctcaaatgtgctaatataaagtagaaaacaccggtagaaacaccggttgtggttatggctgataagtgtaccaaagtgaagtaatgtaaaacagtatctcttattctctcttcagttaaagagattagcagcaaaaaagaagccaaggaagatgctcttgaataagtggttactcaccagacctatatggcttgctcttgttagctggcctttgccagaaggagtctgagtagaattaggagttccttgggaaatttctggaatggtttgcttgtggaggcaatagtctaaaaacttaggtggggctaactccatcctgggtcttgttcagttgtccctcctaccacggggactgctatgataatggtaatgggtgtaggcctgatagagttgtggtttgttgtaatgggaagccatcgtgactaagaaattaagaccaattcgggcaaatacatttattgaggcctctgtggtaggctaaactatgagggagataaagcagtgagtcagccccttgtcctcaaggattttacagtgcagtgaggtggagacaaaccctcaactaacgcttacagataaggcagagtataaaaacggtcacatcagaacaacttagaggtggggtgtggagttcctagaaggcttcttgaagtaggtggtatatactctgagactttgaagatgaatttcaagtaactgggtattccaactgaaggttggcagcatcagaaggtgtaggatgtgttatgtttaatataggcaggaacgaaggcctttactgagcatgcactgtaatgctagggtctgacgatatagaaatatattgaaaacagttcttgccattgaggagctcttaatctagagggatagataggtgtaaactgtcattagggtgatgacttcacaaggtagagaagaaaggttataaaggagagtgtgtaactctgacataaggaagagaaaaagatactttgcaaaggaggtgaaacttgaattatgtcctgagaaagaaggaggagtttgctaagtggatgatgggagaagctaggagtgctacaggcaccagcgttcccttgttaaacaatctaaatgtgacaggcaccaggcaaatacatttttgcttcccctttccaaatggattttggctgtgggagggaatgacttaatgtcttcttttccaatatactagcagatggttaaatatttacagttagacttggattctaattcagctatataattagctgtatgaccttagtaagacacttatttgtgtttcagttccttcattcatacaattcaaaaaataagagtctagtacagagcctggcatatataaagtgccattattattttctatcattatctcatttagtctttgtaagtaactgggcctctagttacaatttcccccatttttcagaagcaggagctcagcgtaggtaggtggcctgtctgaagttcacaggtcaatctgcagtcgcctccgcagcccgtccgctttaattttatgtccgcgccgggttttccaaggcggccccgggggcaggctctggtccggtggccgagactccggcgccagggtttgggcggcgccgcggccggctccggcgggcgggcaggcgggcggggccagtcggggcggggcgggcgtggggagggaagttgtggaagttaggggagacgcccgaccgcccgccccggcctcgcctgcggccgctccctccgcctcctccccgccccgagccccagtcagcccgtcttccttcccctcccttgcatgatggaaacaccatggctgcggcggcccagctctctctgacacaggtaacgccacacgcccgtccgccgggcttggccggccggtgccccctcccccaccgccctcagcttcgccgacttcttggcttgtgggccaagcaggcagcttcttggcttgtgggccgggcggccggtgtgtgtgagggaaagcgggtgcgactgcgggagggcgccctccggagccggagcccccctgcggccgccgcgacctcgcccagggtcgtcgggcgcctcctgccccgccccgcgcggccctcgccgccctccgcgccgctgccgagtggactgtgacccggccgcgctctgccggtgccgggccggctcccgcggggcagctttcacctacccaggaagtttcctcccacagggccgcacgcatcccaggtgagctcctgttgagctcgcgcgggccggccgcacccccgggccgcacgaggctcgcccgccaggccggctgcgcgccgcccccagtaggagttgccttccagagccggacgcgcaggccccccaagccagtctttcctctccagacctgcctttctcccagggtccgacggaagccctcccttcccagagtttaatgtagttagcctcgcctccaaagaagtctcatcctactcaactacccactctgccggccccttcctccgttcagcctctcccccctcctgatcaggtttccttctgggtcagacccccaatgcagccttttgccacccacgtctgcttccacttcaacttcccctcggggggctcacgcctgatcgctgtccaggtggatccctttaacgggtgtggtggctccgccagtcttggtgccaggaacggcctcccggggagcacttttcttggggggaatcctcagcaaaacctgttctcgagcttccctcttgcctcgttgcttcctgtcaaagtccagtccttgtgcttctcagaaaacctctaaacatcactcacactgggaacctggtccctccctctctgtaaagaagccaattacaatgtaaacatggtgtccgggatgataaggtgacagacacctgccagttccttcctgctcctgtgacccaaactctcccccgcgtctcctcagacggttctctccagagctggtggcgcgtgcttcccgattggggcccatcccgtcttccttgcctgcattgtggtatctcactgccatcttgtactccttggcctagattcgtcggtgcttctaaggctttagcgctgggatagggcaaacatttcggcagtggagttttctgtgtttaaaatcaagaggctttggggtgctttgcctagcactgtaggatagagagaaaaaaatgttttctcagaaaccaggagtcacgtacatgcttcatgtaaaataactaacccgtgtttgcaggaattctaagtgtcataaggaaagtctatttcccagtttttttgatggtggtggtggttgtcctgttctgacaagcagagaaccctttaacatggaatgtggtggtttagtcttggttatgtatgtttggaagggtcctcccaaaactcaaatttgaacaactacagcactgacttttaggtattcactttctgtgagtctagttagtgacttgcattaaacaagatccctgttggcaggctgttgttttctggctctgttggccaattctggcaggagttttcccttgaagattttgtgctcttaaagacttccgtaaaattgcttctcagttgtgtgcatactttattctctccctgggtaataccatgtttttagcttctatttacatcattcatctctggagaattgcttcaagctctgtcagttttatagccatttaaaaaatttacatatgttcttgggttatatatttaggtattaatgtgtacacagtaagtacggaatcagtagtagctattatccttcagtgcctcacatatgagataatatacattggtggttaatttttattgataattcaaataagtaaattcagaatattctgattttaaaacatgaagaggcaataagagggattacgaaggcacacgaaaaaataacatttccagttgctagtataccctaatgtgcctccttgttacttcaaaactttgcagatttgtggtttttaaatttaatttaatttttttataactgcctgagcccaatacactaagataacaatgcagcctggtttcacattcattactgacccgtttgtcatcctctgttccccccaccctgcccactctcccagcacacacatttagacataggcatactcaagtgagagctcattcagggcagggacatcttttaatccatctttctcccatggtacctatctggaagaaagtaattaataactgttgtaggaatgactgaaagctctaaagggttctataacagttatggagattaaacatgctcaagttaatttctgcttctgttcatatgttgatgattttcattcagcaaatatttttatagtacctattatgtactagacattgtactgggattatcgtgtttataatttcttgcctttaccaattaagcaaaactgagtttggggaaaaaatgtgaaaaatgttttagcttatgccttccttcctttttccaagcttgccaaccaacccttcaactccccagccaccaaaataaattatctaaattattatagtctagcttctagagatgatagaatgctagagtaccaaaatgttagttccagttctgctttggccacagctaactgtatgggtttgggttaaatatccaggcctcagttttcttaactttaaaagagactcaacaaacatttgctgagcattcagtatgtgctaggaattactctaggtactgaggatatatatactcatgaacaaaaatagttaacaattctttgaccttggagacaaaacctggaacttatttctgctagaggagtttgaattagctgatctaaggacctttccaacttttaagatcctgttttatagacagtgttctatgatttatagacctagtggactttctctgggttctttagtgctttacagccttaaatgttttctaattcagttgtctttactaggtgttctgtttacttcttgtcaatgagaagtaaaacctgagggagaaagatcttgatttttgcttctgttggtagattagaaaaaaagcatgtaatacttaaaaaaaaaaagtttccaatagtcagttttactccctaacgcccatatccctaataataataatactgttaacttccctttgggaattactatatgccaggaattttactacacttagaatctaacgatatgttttacaaattagagaagctagtaagtaagctagtaagtggtgaatctacgatttgaaccaaggtctgtaggacttcaaaagctatttcactgttcttctctatgtactagatgcttggcctatccaacgctcccttacattttttgttcttttttttcggcatatgccattgtcttaagtagtaagcctcttgaggatataagccatggtttttgcctctgaatctctagtgcctttgataatatcttggatgatacaattgtgtgttcaaagttagtgctattgatgataaaggttttattttactgagataggatttgaatatttaaaatagtcttttagcaattcagctttatactggttttcttgctttagtttagcaagaatttttttttttttttgttttgttttgagacaggatcacactctgtcacccatgttggagtacagtggcatgatcaggctcactgcatcctcaaccttgtgggctcaagggatcctcccatttcagcctcctgagtagctgggactacaagtgtgcatcgccatgcccagctaatttttaaaatttttttgtagagacagggactcactcactatgttgtcagattcttttttttttttaaagtaataaaaaagcccttaagtagggacttaattttaaaaatcctagtatataaatggtataacaacagttctaatgctttttttgttaaattacaagagtgatataactgtattacagaaaacttggaaattagaggaaaacatctcccataatttcacagtttgtagtgtttattttcagtttcattttttaaacaagtacgcagtacaagtgctaataaacatatcatcttagtagtctggtttaacaattatgacagtaaatacaggttagtttgaaaatgacaacatgttctcagaagcagaaaagtgatattgttctcaacatgacagatatttgagttcctacaatgggaaaggcacattaatgatgtttttctttattgcctataattatggttcgatatactcaggaaatctcttgagagagatatctaacccttctcaaagatggcttgaaatgttcagcacttgggagaggttgtcatagttaaaattaattaggaacaagttcatccaatagcaagtctctcaggaataatctaagagtgcattcctttgttttcactctatttgcagacagaatgctagtaacagactaacgtgtaatagaaaaagattgagtatcattagcaacgaatcatagttcagaatctctgcaatctctaatagtgtgattttaaaggcctaatctaagatattttacttgttctttagggaattacaaaaagcactttatatacttgtttgtgagtttggggcttaataaaattgggagcagaaaagataactattgggtactgggcttaatacctatgacacaagtccactgatgtaataaaccttcacatgtacccttgaacctaaaataaaagtttttaaaaaaaaaatcagtactctggaaaccaaaaccaagtaaatggcctgagagagatctggttagttggagaactggtagaaataataaacgaaaagttactccaggcagagttcattaggcaaattcatatgctggagtttcatttttaaagcagttgaatcaacaaggtatgccttcattaattatatttattaggtgtttttaataatctgaggaatcttgtaaattgaatgctgtattacagtaaagtgaactttttttatttagacaaatgatctaacccagttaagcatgcgtagaagaaagcctggaagaaaaaaaacactaaaattttatagtagcatggttgtagtttttatctaccttgttttcaacagtgagaatgtattccttctgtaatcaactgatttagcttttctctatggcatttttgagaatttattcatttaaattgaatacacaataactacgtgtaaagtaaagctttgtgttctaagattgtgtctacacttagttttcatcctaaacatttagagaaattgattagaggaatgataataattatattaattgatttggacaattcagttagaggactaatttataattttttgtgctgctttataacttaacaaagcgtaacctatgaactaagctattattatcatcatttcaaattggaggatactgaggctcagaatttgggacttaggttttatagttagtaaattaaaaaaccaatataaattcatggttaaaaaaattcatacaatgctagtgaagtcttctttctgctttaggccctcatttgctttcccagaggcagccattcttgccagtttcttgtgtgaatttccagtaatagtctgtgtatatgcgaataaatatatatgtatactgtatatgtatattcttttgtgtaagctgtttattgtttcacagtttgttgttatattatttttagcttaactgatttaggagattgctctataacatcacatatagatctcccttattgttttcaaaacctcagggtatttctatatgtgaacttactgttatttattttactggccacctaatgctggacatttattttgttttcaatcttttgttacaactatgctgcagtggatactcttttacatgtttttgtgcacatgtgtgagcatatggattaatttctagtaggtgtaatttttgggccagaggatacttttaatctgcatagatactgctaatttggggtaggcatagtggctcaggcctataattccagtgctttgggaggctgaggcggaaggattgattgaagccaagagttcaaggcctgggtaacatagtgaaatccatctgggacaaaaaaaaaattttttttaattagctgggcatggtggtgtgtgcccgtagtcctagcaggctacaggtgagctatgattagcaggttacagtgagctataattgcaccactgcactccagcctaggtgacagagctaagaccctgtctccaaaaaaaaaaaaaaaaaaaaaagatattgctcatttacattcagaaacactgtagcagcacacatgtttgagagtgtcatttcctccacagcttgatcaacatgtatattattgtcagtccagtaatcagaaagatttcaaacaatttcattgttttagtttgttatttctttatgggtaaggctgaacttatttttttttcctttgaaaccatttgtatttctttttttataaactgctttagtcttttacctgttctcttgatgggctgtttgtcttctttctcactgatttgtaagaactcttcttatatttaggaaatttgcccttctttgcaaaatcctttgcaaaatttttttctctgaatttttttttgtttttggcattttttgattatgtagaaatatttgttttatatgtttaatttgtcagtcttttctcttagagcttctgcaaaatctagatttttaaacttcaggagcagaggcagactaatataactgcaagagcacacctgttctgcccctgagtagttctgtgatcttgggcaaattacttaacctcttaagtgcactcatttgcatattagaaataaactactgagacttcttgggtattattgagacctcttaagcatgttgtgattacaaaatgaactggtgacttattttctttagctactcctgtagtttcccaatttgttaaaagctggccttgtaccctgcctcatatactctgctttcctatcacataaatgtgaacttctgaatattttgtgcaaaagtaggatagaaatgaggtagaagaaactcatttttgtgatataaataaggctttcaaatgaatcagaggtgcaattaaaaaataaaagttgggctctttttaaaacttgtttttatgtggtaaaaatatacaaagaaaagtaagcctcacttcctccctcctttaaactggggattattacaatgggaatataacagtaccaggagtttttcatctgaaataatcaaactgcttattccttactaaatctgcaataagaatacaaatttgaccaagaatgctaggataagaacatattttttggaggaagacgtttatattacagtactttatagttttttagatcatggtttctcagccttggcactttgagattttgggctggagaatttcttgttgtgggaggctgttctgtgcattgtagggtgttttgcagcatccttatccattagacgtaacaccttcaccagttgcagcaatcagaaatatctccagacactgacaaatatttcctagaggattaaattgcctctggtttagaatcactggtttatttatttatttttattttaaagttttagtacttttgagagagagtctcgctctgtcgtccaggctggagtgcagtggtgtgatcttggctcactgcaacctccacccctgggttcaagcaattctcgtgcctcagcctcccgagtagctgggattacaggcgtgcatcaccacgcctggctaattttttttgtatttttagtacagatggatttcaccatgttttccaggctggtctctatctcccgacctcaagtgatcctcctgccttggcctcccaaagtattgagattatagtgtgagccactgcgcccggccaaatcactggtttagatatatacttatttatttattattattttttgaggcggaggtctggctctgtcgctcaggctggagtgcagtggtgtgatctcggctcactgtaacctctgcctcccgagttcaaatgattctcctgcctcagcctcccaagtagctgggattataggcgcccaccgccacacctggctaatttttgtgtttttagtagagacggggtttcaccatgttggccaggctggtctcgaactcctgacctcaggtgatcctccctcctcagcctcccaaattgcttgggattacaggcgtgagccatcgtgcccggcctagatacatactttctgtggtccattaggacatacaagatatactttctaggggtgaggacaggggaaagagtttatcttcatatttttattcttaagcctgccatgagccatgattgactccttgtgcataaatattgagcttaaaaaacttaaatgagaaggcaacctgaaattgtgaacttaattttatgtgtgatttctgtgccttttttagtgtgatctcctccctcttccggctccactgtagtttggaaacttagtgtggtcttcttttagttgtggaacagttctatctagtgggctaagtatcaatacagagatcctggaaggaaaacattcttatgccactgttgagaaggaagaggactgatgcttctagaacacctaataaatactaaatacttttagatgatctacatacattatttcacttaatcttcatagcctttctacaagtaggcattaatcttctgtattacttgctcacggttgtattttaagtgggagagttgagacttgaacccaggcacatctgttctccaagtacatttgctatgctgcttcctatagtcattgatgatatttcagtcaaattttgggataagaatgaacattcatgtgatcttacattcctctattgttatgtaaaagaaattatccagtggtgtgtgtgtgcgtgtgtttgtgtgtattggggaggaggtcaatagtgggataataacaataatacttactgagcacacttacgtgtcatgtgctattttcaataatctttacaacctgatgaacctttcagtattctttacaacttggtaatccttatatccctgttttacaaaaacaaaacaaaataaaaaactgggacacagaggtgaagtaatttgttcaaggtcaaactgctgctaagtggtagagccagaattgtaacccagtagtctaagcaactcggatattgattgaatgagtctgcatttttaagggcaaaatggctctgacagagcttattgtggtaccattccttggttatagctgaacatatgttgtaggctactacatcttcctatgtgaaaatcaacttatcattgcatacaccacatctctagaaagtgattgttgcacgaagttatagtggaaagtttttgtagacatagtagaaggtagtttttcattttgcaacctccagatttattgctcatgaaaatctaagcttgtctaggttagtgtacatcataccaatatttacttttaagctaatattctctcagacatggttatttggacttggagtttctacagtattgtattgctaaagataaaatgtatcagagactccctataaaatagacttttattgactaaaacctggaaccattagctgtaatgatttctgatcctcagatgaacatttttgagaactagcataaaataatgagagagatcttgggctctgaagttagaatgtcttaggtaaattgatagattttagttatatgagccattaatttttatgaaatgttgcacttaattagaattttgatggatcatttatactaaggattattgataacttcattccatcttttgttctgtaggtacaacatagatatagcattatgcatatataaaaaatatgaaattatatgcattaaaggtgcttccagtattgatggttgatcctctgtttcagaaaacatttactagatgcctcctgtgtgtcactactctagtaagccttggacatacagaataagaccatgacatttgctctgaagtagcttttggttttttagggagataaacactgactttcttgtgtgacaagtactgtgataaaggatgatagaagtaaggcaagggggtgccatgagagaatactgtgattatgatgaaacttttggtggtaatatagtttttaattatttaatggttttataggatccagggttgttactgtagaggatatttaaactgtacttgaaaggataacataaatctataggaacatttgattcaagttaaattgtattttggtgcatagagttcatattgtgggatataacatcaattttcttatgagattccttgttttatcttttttttgtaataaaggaagaatttttaactttgaccatagagcataggaaggggactcaaggatagacttcaaaagatctgtgatctactccaaaacagtaggtaaaatattttatatatatattttaacagagtgtcaagattctcatcccagggacactgagagaagttttacgtagtgggaagaacactggatatagtacaagacaaacctggattgaattgtagctctgccatttgtgacatctctgagtgatcatggcaaattacttaaaccctttcatttgcttatgtatgatgtatacacattgttgagatataggagacatttgataaatagaattgcttgtattattattaatacttacctgcagaatttatatgtatttgtttaaattttctctttctttctttctttctttctttctttctttctttctttctctctttctctttctctctttctctctttctctctttctctctctctctttctctctttctctctttctttctctctctctctctctctctctttctctctttcttttcttttcttttcttttcttttcttttcttttcttttctctttttgtgactgagtcttgctctgttgccaggctggagtgcaatggtgcgatctcagctcactgcaacctccacctctcgggttcaagcaattctcctgcctcagcctcctgagtagctgggactacaggtgcacaccaccatgcccagccaatttttgtattttgtatttttagtagagagggctttcaccatgttggccaggatggtctcgatcttctgacctcgtgatccacctgcctcggcctcccaaagtgctggaaatacaggcgtgagccaccgcgttgggcctaaatgttttttcatttccagtattcttcactcactaaagaaaacttggaacatgcatgtcgaaaagtagaagatagatcaccatccacaccattctttaaattttagtcttttacatcgtttcttttttttccaaatgtagttattatctctctttcatacacacacacacatatatatgtgtgtatatatatgtatgtaacattttttattctgttctcctttttttttttctgagatggagtcttcctctgtcacccagactggagtacagtgacgtgatctcagcccactgcaacttccatctcccaggttcaagcagttctcctgcctcagtatcccaagtagctgggattacaggtgtgtgccaccatacctgcccaatttttgtatttttggtagagatggggtttcaccatgttggccaggctagtcttgaactcctgatcttgtgatctacccgcctcagcctcccaaagtgctgggattacaggtgtgagccactgcacctggcctattctgttttctttaagtgttttcctatgtggtctgcttagcatctttttaatgtctttggagcatattaattgattgtgtgctttatagtttaagccctaatgtgtacagatattttatatatgtccactataatttatgctgttgcaaataacctttgctctaccatttgataaatttttttctgtagagttatatgtggtacttattatattattgaattatttttctatgtatacatttgagttttgaaatcaaatgagtgaatttttagtttatattttaagatcttgaatggtaaagcagacagcagcaagggttaactcgagcaataatctgaaaaatgctattctgaagggattaaaccgagcatatttaatttggttgcaagggccatttatagtttgtcagagttcacttagcataggaaattggcattaaaagttgtgagcttgaagaagattgaaatatttcagtttgtatatacagttttcacccttctctgcagtctgtattgctttcattcttagtttgttctctacattcttagtttgttctctacattctgttctgttctgtttttttttttttttctggcacacttttatgcggcgccttgtaagatctgggggtggattctggaccatctggcacttcagaatagctcaaaaccttaactctcttgactctactttgagccatacttgcttgaaatgtcctggtttgtctctctgcttggcacgttttctgctttataccctcagagctttttatgactaatttcttccttaggacaggaattttaagagtaccagtattcataagttaaagtggacaagacttatttcactgtaaaattcaccaaaaaaaccctcataaactttgcaatctgtttttaaatgtataattgacatgagcacttatgtctgtttgataaatatttaaaatattcaaaaatggaattttttaaggtactgcttatagtttttctttgattatgaggccagttaggaaagtgtaattctgcaaattgtaaatctactgagttgatttctagtcctagctttaaaatacttcatatgtccaaattaataataagttaaaaagatatacctgcatttaaaaatatgagccatctaccaattccaaaaagctgtggaggtagttaatgtataaaatatttaaacattgttggctgggcacggtggctgacgcctgtaatcccagcactttcggaggctgaggtgggaggatcacctgaggtcaggagtttgagaccagcctggccaaagtggtgaaactccgcctctgctaaaaatacaaaaatcagccgggtgtggtggcaggcacctgtaattctagctactcgggaggccaaggcaggagaattgcttgaacctaggaggcagaggttgtagtgagccaagattgcgccattgtaatccagcctgggtgacagagcaagactccatctcaaaacaaaccaacaaataaataaataaataaattgtagtgagccaagattgcgccattgcactccagcctggatgacagagactccatctcaaaaaataaataaataaataaaaataaaataaaatatttaaacattgtttacttttattaagagactttttttgtagctttatgctccattgttcttttctaaaatttttattttttactttttaaacagtttaattgagatgtaattcacataccatacaacttaccctataaagtgtacaattcagtggtttttagtctcttcacagatacgtgcaaacatcaattttagaacaattttatcacctcagaaagaaacttgtacccctcagctatcaccctcccatattgcatgcttcccccagcctaagcaactattaatctactttctgtctctatagagtttgttattctggactttgtatgaatggaataatataatacatatactcttatgactgccttctatcactttttgtggtttatctatgttgcagcaagtatcagtaattcattcctttttttggttgaaaaatattccatcgtatggttataccacattttgtttttccatttgttcattggtggatatttgggtggtttccaccttttggctgttatgaataatgcttttataagcattcatatacaaggttttgtgtaaatatatgttttcacttctcctgggcacatatctggtcatgtggaaattctgtgtttaatcatttgaagagctgcagatttttttttttttgagacacagtctcactctttcacccaggctggagtgcagtggcgcaatcatggctcactgcaacctctgcctcctcggttaagcgattctcctgcctcaccctcccgagtagctgggactacaggtatataccaccacacccggctaatttttgtatttttagtagagacagggttttaccatgttgtctgggctggtctcaaactcttggcctcaagtgatccacccgcttcggccgcccaaagcactgggattataggtgtgagccaccacgctcggctgctgactgttttagagcagctgcaccatttatatttgtaccagcagtgtaccgggatgaggatttctccacatcctctccagtaattgttattagctgattctttgattttggcttactttttttagtatctcattgtgttttcgattttcatttctctgatgattaatgatgtcaagcatctttttatgtgcttattagccatttgtatgtcttctttagagaaatgtctatttatattctttgcctgttttaaaattgagttgtctttttattattgagttgtaagaattctttatgtattctagatagaagtccttattagatacgtggtttgcatatattttctcccatttcatggattattttcttgatggtgttctttgaagtactttgaagtttttaatttaattttaatttattttgttttcagacagggtcttgctctgttgcccaggctggagtgcagtggtacaatcacagttcattgcaacctcgacctccagggctcaagtgatcctcccacctcagcctccccagtagctgggactacaagtgcacgccaccttgcccagctaattgtttttatattttttgtagagatggggtttcaccatgttgcccaggctggtcttgaactcctgggcaacatgctcgctttcgcctcccagagtgctgggattacaggctgacataagccaccttgcctggcctgaagtttataatttttataaagtctaatttatatatatttttcttttgttgcttgtgcttttggtgacatagctgagtcttttggcaaatctaaggtcatgaagatttatccctgtgttttcttttaagagttttatagttttagctattatatctaggtccttgatctatttcaagttgatttttatatatggtgtgaggtaaaggtccaacttcatttttttgctagtggatatcttttgcttgtgacatggtattccagcatcatttgttgaaaaggctattctttccacattgaatgatcttggcactcttgtcaataatcagttaaccatagatgtatgatttagttctgacttaattctgttccattgatctatatgtcctgtgcagtacaacactgtcttgagtattgttgttttgtaatacattttgaaattgggatgtgttagtcctctaactttgcttttttattttttattttttgttgttgttcacttctgttgctcaggctggagtgctgtggtgcaaactcggctcattgcaacctctgcctcctgggttcaagcgattctcctgcctcagcctcctgagtaactgggattacaggcgcatgccaccattcctggttaatttttgtatttttagtagagatgtttagtagagtagaccatgttggctaggctggtctcaaactcccgactttaggtaatccacccgcctcagcctcccaaagtgctgggattacaggcatgacccaccgcgcccagcctactttgcttttttctttcaagattgtttcggctattccggattccttgcaattctatctgaatttcagaatcagcttgccagtttctacaaaacagtcagttggaattctcatataaattgcattgaatctatagattagtttggggagtattatcttaacaaggtcttctgatctatgaacgtgggatgtttttcctttttatttttaacttctttaattttgttcagtgtcttgtagtttttagagtatagtaagtcttgtacttttgttaaagctataacaaataaattgataagaaaactgtttgatgctattgtgaatggaattcttttttttttttttttgagacagagtctcactctgtcgcccagactggagttcagtggcatggatcttggctcactgcaacctccacctcccagattcaagtgattctgctgcatcagcctcccgagtagttggaattataggcaagcccccaccacgcccagctaatttttgtatttttagtagagatgcggtttcaccatgttggccaggttgctttcggactcctgacctcaggtgatccacccaacttagcctcccaaagtgctgtgattacaggcgtgagccaccgtgcccagcctggaattgatttcttaatttcatttacagattcttcgttggaagtgtataaaaacaaaaatttttttatactgatcttgtatcctgtaaccatctgaacatatttattacctttagtagtttttagtggataccttaggattttctgtatataagttcatgtcctctgcaaatacagatttacttcctcccccaatctagatgctatttcttattcttgtctgattttcctggttagaacctccagtataataatgattagaagtggcaagagtggacatccttttcttgtacctgaagcatacgtatgtataatcaatacctcaaaagtgcctagttcagctatgaaataaaactagtgttatttgaaagggtttttttaaaagtatttatttatttttatttgccactatactaatgaggaagaaggggtttctaaattttgtcatttatttatttgtttgagacaaggtctttattgctcaggctggagtgcagtggtgagatggtggcttactgcagccttgacctcctgggcttaagtaattctgcctcagcctcccaagtaactggggcaacaggcatgcaccaccacatctggctaatttgtttgctttttgtaaagatggagtctcactatgttgcccagggtggtctcaaactcctaaggtgcaagtgattctcacatccttcgcctcccaaagtgttgggagtataggcatgagccacctcacttggccagagggttgttttaaattcacattttaattatgttgcttcagaggggttcttgagggtggtccttatactatcagcacctgaaaacttgtttgagatgtaggttattattagactctcccctgcaactctgaaaagaaccagggggtgggaagttcacttagccttttgcatggtaaatgtagtttatcttaaaattaataatgtggcagggtgcagccgctctcacctgtaatcccagcactttgggaggccgaggagggtggatcacctgagatcaggagtttgagagcagcctgggcaacgaggcgaagccgcatctctactaaaaacacaaaaattagctgggcgtggtggcagacacctgtaatcccagctacctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttcgcttttgttacccaggctgacaatggtgccatctcggctcactgcaacctccacctcccgggttcaagcaattctccttcctcagcctcctgggtagctgggattacaggggcctgccaccatgcctggctaattttttgtatttttagtggagacgggtttccccatgttggccaggctggtctcccactcctgaactcaggtgatctgcccgcctcgggctctcaaagtgctgggattacaggcgtgagccaccacacccagccaatacaaggttttacatttatggaacatgtaattttcacaaagactatttatagtacgttttttctttcttttgtgttttttaatatatgaggaaacaccccagagagattgtcaattttctttctttattttttttttttgagatggagttttactcttgttgcccaggctggagtgcagtggctcgatcttggctcacttcagcctccacctcccgggttcaagtgattctcctccctcagcctcccaagtagctgggattacaggtgtgtgccaccatgccctgctaatatttgtgtttttagtagagatggggtttcaccatgttggccaggctggttctgaaactcctgacctcgtgatcctcccacctcagcctcccaaagtgctgggattacagacgtgagccactgcacccgacctacagattttcttttaaaaattagctgggtgtgatggtgcacacctttaggtgcagctacttgggaggctgaggcaggaggattgcttgagcttgggaggtcgaggctgcagtgagctgtgattatgccactgctctctagagttgagaaaggcaagaccctttctcaaaaaacaaaacaaacaaaaaccacaatgaaataccacttcatacccattaggatggctatgataaaaaaaccagtaactagcaaatattgatgaagacgtggagaaatgtactactgatgagattataaaattgtgcagccactgtggaaaacagtatggcagttcctcaaaatattaaacattgaattaccgcataatcaccatataatccagcaatttcatgtctgagtatatatccaaaagaattgaaagcagtgacttgaacacatttgtataccagtgtttatagcagcattatccacagtgaccaaaaggtagaaataactcaagtatcctttgacagatgaatgagtaaacaaaatgtggtatctacatgcaacggagtatttttgactcttaagaagggatgaaattctgatatatgctacaagaaggaaaaatcttaaagacgttatgctaaatgaaataagccaaatgcagaaagacaaatattgtacgattacatgtatatgtggtaactagcatagtcaaattcatagagacagaaagtagaataattggtaacaaggggttgaaggggagttaagtgtttaacatgtacagatttccagtttgggatgatgaaaaagttgtggaaatggatagtggaaatagttgcacaataatgtgaatatacttagtgccactgaattctgtacttgaaaatgtacaattttatgttatgtgtattttaccataataaaaaagtagaacaaaaatgagaaaaggacttgaatagagatttctctaaagaagatatgcaaattgccagtaagttcacaagaaaattttcaacatcattagtcattagggaaatgcaaattataatcacaatgagaagccatttcatacccattagggtggcttttatcaaagaaaaagaaggaatttggagatactggaacccttgtgcatggctcatgggaatgtaaaatgagctgatggaaaacagcatggcagttcctgaaaaaaattcaaaataaatggttcagcaattccactcccagctgtctactcagaagaattgaaagcaaggatccaaacacatacttgtacagtaatgtttatagcagcattattcacaagaattaaaaggtagaaataacccaagtgtccgtgaagagctaaatgaattaaaaaaaaatgtggtgcatgcataaaagaaaaggattaaaattatcatacatgctacaacatgaagaaaccttgaagacttgaaatgaaataagccaaacacaaagggacaaatattatgtttgtttttatatgtgtcttagtctgtttttgctgctataacaaaataccaaaaactgggcaatttagaaagaacagaaatttatttcttccagttctggaggccaggaagtctaggatcaaggtgctagcagattcagtgtctgatgtggactgctttgtccttccaagataatgcttcttgctgcatcctcatatggtagaagggcgtaaaagggatgaatgctgtgcctcacatggcagaagagaaggaagggcaaaaaaaggcaagtgctgggaggactctttgatacgtacctaaattgcattcacaagggaggagcccttatgactttatcaccccttaatggccccacctcttaatactattgcattggagattaagtttcaacatgaatattttggggacacaaacattcaaactgtggcaataaggtattcaaaacaggcaaattcataaagacagaaatagaaatgtatttaccaggtgactgggggagagaggagtgagaagcttttgtataatgagtacaaagatgaaaaaaatctggaaataaatacagatgcttctcaacttacaatagggttgcatcctgataaacccatagtaagtggaaaatatcatatgtcagaaatgcattcaacatgcctaacttaccaaacatcatagcttagtctagcctaccctaaatgtgcttagaacacttacattagcctacaattgggcaaaatcatctaatacaaagcatgttttataataaaattttgaacatctcatataatttattgaatactgaaagtgaaaaacaatggttgtatgggtactcgaagtatggtttctactgaatgcttactgcttttgtactgttgtaaagttaaaaaattgttaagttgaaccattgtaaattggggaccaactggtgatggttatacaacattgataccactgagcaccgtacctaagatcatatcatcaatgaaaatttatgaaccatttgaaatatatgggtatgtgggtgtttctttaggtctctttgttccattgtaccttttatgagttggataagtgaatttatcaatggtcaggcagaattttttgaggataaaagcataaaatccaaatatagagaagtgacattgttatcttatcgactagttggaaaaggggggtttaagttttttttcctaattatgaatctgtatgtcattatttgaatctatcacctttatacttcacaatacacactagttttttttttttttttgagacggggtcttgctctgtcgccaggctggagtgcagtggcacaatctcgcctcactgcaacctctgcctcctgcgttcaagcgattctcctgtctcagcctcccaagtagctgggactacaggcgcgcaccaccatgcccagcgaatttttgtatttttagtagagatggtgtttcaccatgttggccaggacggtctccatctgttgacctcgtgatccgcccgccttgacctcccaaagtgctggaattacaggcatgagccacggtacctcacactaaaattttaagtggctgatttaagtgatatttttcgctgctgccagaggactgttgcaaagatatgtgtgatttaacgaatatttatatgtcatgatacttctaagatgcgtgaattgggtgtgggcctattcaagctgccttgcttggctgattaatgagtatttctcaccctttgttgtatgcttataaataaaatgtgcatcatagtcaccatatccatgtatcatttcgagggcattaggtcatattgagctttttctttgcatttgtcatgattaacttttttgtgactttggacaagttatctttttccttgtaagtttatctcatctgagaaggggattttcccctcaattttagtataaccctgttttatttttctgcttcttaaaatggatgagaatgacaaaagaaatttgctagctgactggttagaggagttagttgtgatggcagtcatcattgctctgtatgtatgtacttggtagtacatagaaatattcatcaaatgattacttcagttgagttgcatttgtagaactacatgaagttgaattttaacttaaatttgaactcctaagtgtcttctaaaaaatattctatatgtaacattgaatagcttttttctgtatgcagaatgcagaagatttcttgttattcagttactcatttcattctttcatttttgttcacttataaaatatttattatcttctatgtgtcaagcaccattcagggtacagggcactgaaaaaaattctagaactcagaatcgaagtgtccactgtcatatgtcacatagtagacattagatagtagtaattgttaaactcttggagaacattgtagaattttaaaagctaaatgagaagttgatatgttatccagtgactgttactcaagttctgactataatggagtgaattttaaaaattaacagtttaaaaaaatagaaaaaaggaaatgtaacagaaaactgcagtattttaaaatatttctttatactgaagagatcagtgttagaagtgaggcctaaattatatgaagcagcaagtctgtctgattctgggcataattgccgaaagcaattcagaagaatcttcagattttgaatgtgaagaaagctttgacttaatgtttgtttatgatactaggggaaaatgatgaataaatgtatgcaattgtaggtgaataaaaagtatgcttttaaattatctattcattttggtaatgcttttgttaaatggaaggtggcacttacaactaaaggtttcttagaattgggggaatatggtatacttctctgagtgttatcaagttcaaatgttacaattcatatgaaagagcttagtacgataatggggaaaataatagtaacattgattataaaggcaacaaacttaatgattaagagtgaaagtcctggaatcagacttcttggattttaatcctgttaccaacacttaactaggtgtgtaactttgagtcagttactcagttaatgtcttattttcctcatttgttaaatgggtataatagtatgtgcctcaggttaaatgggcttaatgtgtaagtgcctagactagtacttggagtataggaaatgcttaatgagattcaatgtatgttatttgttatgaagctgtgaaacactgtgtatatgattttaaaatgtgctatttaaattcatactttacagtttaacttgccattttaaaaagcaacatttgattactgattgaaaaaattttttggtctcatttgtgcagagcttatatttttctccttgcctaagctgttcttcatttgtttgtataaatattggcatgtttatttaccttggactagtccatgtcacctttcactaatcaaagctgttatttctgggttattaatcatcccacccaattgggtggcagcagtaaaccctgagggcttgccatctctcccactttataagttattactgtcattattgtttaaataattaaggagaggttttttttttgccaaattctttgctgtttggaaataaggaatggaacaagtaataaatatgctgaaaatatatgttttcttagttcactttaagaaattgatttatttaggaaatggtgtttgttttaaattacacttgatttttttgaaaaatttgtatgggcatatttcttaaaatgttaggtctatagtataaaaagaattaaaacaccaaagatttctattgatttatattctttggttattcttttatatttcttgactggtattctgtatggttcccaaaaccagtcaagaactgtaaaactcttactctacatacttgccagcaaaaaaaaaaataaaaataaaaataaataaaactcactttgtcagttttatccattctcatatcagaacctttttgtttgcatgtgacaggaaacatcaattctaacagtcttaagcagaaaacattagtttatataaatggtaggtccattagtagacctggcttctggtgtgtcagggtcacagtgatgtcactacttagtttttctttttttgtaccttggctccattctaaggcaaattattctgttgtagaactaagatgattataaagcttcaggcttgcatactttataattacaagtccagtggacccctttctaataggtcccactaaggttacatttctgccctgacatagttgctgtggagaatgagtttaaaagtaggtttgccagaaagaattgaggttactgattgttatgagttgaattgtgtcccttcaaaatttgccagtactggagaatgtgaccttacttggatataacattgatgcagatataattagctaaggttatatgaagtagagtggggcacagatccagtatgactggcatccttataaaaagggaaatttgaacgcagacatacagggagaatggcatgggaagattggaggtaggctgccacaagccaaagaactaccaagagtaggagagaggcctggaacagatccttccctaatgccttctggcttccagattgtgagacagtaagtttctgttctgagccatctagtttatggtactttgttatggcccttgtgaactgatacagtgatcatgaatttataatagtggtctaccttgttgagtgactttctcagctgcagcatcaaagaaaagtttttagatggtttcattcaggtttgggattttgctatattggtgtcataagacaagaggagcaagggaatttaggttattggcaggagaattattgaaatgatgaattgtagaatctaaactgaataaggtggaagagaaagtaaaatagagagggcctgagggatcaaagtctattgggcccatggataagaggttttatagaggtcaaaggattataatctggaagaagaggttgtggttggaggacaaggtgcttgaaatagtgattaaggaggtggagcacttttggttgaagatagaagggcaaggaaggattttactatgggacaaggagggtgactgggacataatatatgtgttcactgttgatcctgtgttttggagaggttcttgaagttaaagagatcaaggaagtaagaagccaggctgtggatgggttgtgcaaattgataattgaaattactaaatttgatgtagggttggggtagagaagatgacagtgagccatcaaagccttaggtaaatgaggtagagaccaggagcttgaaagttaacatgaaaaggaagaggagagagtaatttagttgaaagttaagagcctcagctgggcaccgtggctcatgcctgtaatcccagcactttgggaggccgaggctggtggatcacctgaggtcaggagttcatgaccagcctggccaacatagtaaaaccccgtctctactaaaaaaaatacaaaaattagccaggcgtgacgcctgtaatcccagctactcgggaggctgaggcaggagaatcgcttgaacccagaaggcggaggttgcagtgagccgagatcgtgccattgcactccagcctgggcgacagagggagactctgtcctcccatccaccccccaaaaaaagaaagttaagagcctcaaaagaatagagctttatttttatttatttatttatttatttatttatttatttatttatttatttatttaatttgagactgagtcttgctctgtcgcccaggctggagtgcagtggtgcgatctcggctcactgcaagctccgcctcctggagttcatgccattctcctgcctcagcctccagagtagctgggactacaggcgcccaccaccacgcctggctaatttttatttttttggaggatggagtctcgctctgtcatccaggctggagtgcagtggcgcgatcttggctcactgcaagctccgcctcccgggttcacgccattctcctgcctcagcctcccgagtagctgggactacaggcgcccaccaccacgtctggctaattttttgtatttttagtagagatggggtttcaccatgttagccaggatggtttcaatctcctgacctcatgattcgcccgccttggcctcccaaagtgctgggattacaggcgtgagccactgtgcctggccttttttttgtatttttagtagagacggggtttcactgtgttaggcaggatggtctcgaactcctgatcttgtgatccgcccgccttggcctcccaaagtgctgggattacaggcgtgagccaccgcgcccggctgttgtttttgttttttaaaacaagaagttaaatagtgtaatgtggacaagctgctggtgagcaaagaggagtttattcacatttctaaaacctgagataggcaggtcgttaaaacctgacagctgccatttgaggggctacaaaggaggtgagaggatttttataaattcgtatattagtcattcatgcttaaagatcatgcttcttccactgatctgttttttttgtttgtttgtttgtttttttggcctacctagaatgatgtatatagggctcactaagtcttctgatgaaagacccaagctatactttgctttcattctgtctctatgtcacctagatttttgatcaaattgagttgtattcaattaaaaactggcccattactggtttgagttggtgatatggtctttacatccatcgtttttcagtagtattttctgtactatctctttgaaattcttttgtctattctaaagtccctttcttctttcatttttgaaagaagtgaatctccagagcaaatatatttttttatctggattttgaaaactttctttagaatactgtatttacagtattcctaggtctttgcctgctaagtcaatttgtaatgttttgttatggaacaaacatgagatgttagcgtgtttgcagaaggtagcattacaatttttactagaatttaagcccttgaaggcaggagccctatctgattattttaactccagacaccttaacctattgtcttgtacctagaaagcatccagtttatgtctattaaattattaaatgagggccaggcacagcggctcatgcctgtaatctcagcactttgggaggccgaggcaggtggatcacttaaatccaggagtttgagaccagcctaggcaacatggtgaaaacccatctctacaaaaaatacaaaaattagctgggtgtggtcccatctgcttaggaggctgagggaagaatcacttgagccccggaggtggaggctgcggtgagtggagattgtgccactgcactccagcctgggcaacagactgggcaacactctgtctcaaaaaaaaaaaaaaaaaaaaattaaatgagttgggaattacagagctgaggaatatgtgcactgtgcattctgtaagggaactgctcaagtggctgcttgtgtttccttgactccccaccctctccagttctaaaggtgaggactgcccaggtgatttgcctttctctgccccaccacgccctccaccctagctttagagttgttctcctttctcaaatttctcttattactagcttctgtaataagcaaacagcttccggtttctattttccttgtcactttggattgctgttaatcactattgctccttactatttttcattcttctgtttactcttagttttcatcctgttttcttttacattgtaaaatatacaagccttttctagatatggatagcctatcaaaagcttctaaatgttctgtcttgcaaactataaacctatgtgtataaaaacatagactcttggtgtattcatttagtactttggccttaggagttgctattctatctttaaagggtggtggtggtggttgaggtgggagttgaaaggctgtggtggctagtccccattctgatttctcagccctcttgaaaatggagtaatagaaggtggaattctaagtagttgaatttttatgtgttaatatgtcagaaataattttatggcaaattacagaaaattgtgtgcattaagagactaaaaaattttttaaagagcaaaactaaaaagagtggtttatttgaagggataaaatctattccattgtcttccttttactacctggccctgatttgccatcgcacagtgttcttactgcctgatttgccaccttctctctacttcacattggtcttcaatactgccttttcatgggaagttgcaaaaagtagtaccgagaggctctatgcacccttcatccaattttccctaattgtaacatcttacataactacagcaatagcaaaaacaggaaattgacattggtataacccacagaccttatttaaattttgccggttttatagatactcattagtgtgtttgcatatatagttctatccatatgcagttttattatgtgtgggttcatgtaactgtaagcgtaatcaaaataaagacttgctctgtcacaaagatcctttgtgttaccctctataatcatacccactcccctctccattttattaatttatttactgacgactccctagtatctgaccttgtgattaactgagaaaagattggcattatgttttagaggttgtctctttattttactttcacttctgttttttttttttttttttttgagatggagtctcgcactgttgcccaggcgggagtgcaatggcatgatctcggctcactgcaacctctgcctcccgggttcaagcgattctcctgcctcagcctcccgagtagctgggattacaggcacccgccaccacgcccagctaattttttgtatttttagtagagatggggtttcaccatgatggtcaggctggtcttgaactcctgacctcgtgatttgcccgctttggccgcccagagtgctgggattataggtgtgagccaccatgcctggccttccacattgtactgtaaccatttataataagactaaatcatttaaaatttcagtttattttgtgtgttagagaatcttgtactctcaaagtcatgtactctaatatctcctcccacataaccctcccctaaaaatgacaccagaaattccatatgagacaattcttgacatttaattattaacctataaatttccttagtaactgggatcttttttattactacttgatacactttggtgttgatttacttatgtgttaacatttgctagattatgctgcactaagaaacaagccaaaatatgagtagcttacaataagaagggtttatttgtttttcacgttataggcttcctaggaatcagctatggttctgctctgtgattctttctcatttgaggatccgggctggaggagcagtccctatttgtgacatattgttctcttggtagagagaaaacagtaagacctgtcagaaacacacaatagctgttgaagcttctacttggaactggaactttctcccagattcagtggccaaaacaagttatatggccaaacccacccttggaacacccacggagagacaccacaagtcacatggcaacaggcagggatattaatactactcttaaagagagagaggctatatactctgtgtatacaagagggaaacagacgactgggaattataataccacctaaacaccttaagatgctgtactagtcacctgaggccaggagtttgagaccagcctgcaaaacatggtgaaaccctgtctctactaaaaataaaatagtctggcgtggtggtgtgcacctgtagtcccagctacttgggaggctaaggctggagaattgctggaacccgggaggcggagattgcagtgagccgagatcacgtgattgcactctaacctgggtgacggagggagacgccatctccaaaaaaaaaaaaatacatacatacatacatacatatatatatatatatatatggtatactaggctatactttgtaaaaatttttttcttagtaaagtttattatatttacatttctatagctatatatgtaattataataacatattttttccttaacaaaaatagcagttcctccttttgttttgttttttttttttacattagttaggatattggtttaaaccaaaatcacaaatttcaagtaacaagtaacaatccaagtggggtaggtggtgtagagtgctgtaggagcttcatgatggtgtcagggactcaggctttttttctcgtgttgctgtatttttcccatgttttccgtcgcaatccaagatagcttctctagattctgtcactatatctgtattctagccagctatgagaagggttaggagtcagaaggcatttcctttctctttagatgcacatcctcggagttggacacatttcttttatcattccattgatgaataactgaaattgcaagagaggttgggaaatgtaggttttagctaggtgtgtgtatgtaaagcttaggggtactattactaaagaaaggaggagaggctgggtgtagtggctcatgcctataattccagctacttgggaagattgtttaagctcagaggtttgaggcagcagtgtgattgtatcactgcacttcagccaggactgagtgggatcctgtctcaaaaccaaccagatcaggaaacaggcttttcaaggaggtaaaataagctactaaagatcatacctaagaagtagtagaatgggctttgaatacctttctgatacaaagtctgagttttttttttttttttttttttttacaaaactttattggctttctagcatctcttgtttacaggtactttacatttttcagactagtaagaaatagcaatggactctttcaaaagaattctgacatttatgaatatttaactttgtgacagctggtaagaatttatgatataggtaatgaatatataattgcttttaaattgtaataacagaattgtaaaaggtcagattttgattttgacagttggagttaaagttttcctttagaaattaatttgattgttaaaaattcatatgcagttttatatactgatcacatttggggatttttatatttttctctagattgaaaatagccttattgtttcattcttattatataattaggatgtgtttattctcagagtttccagagactgcagagtagtatgaagaagaatgtaaaaatcatttatgatcttgctatccagagataatcattgttaccatttaataagctatgcctttcaattttttcctctgttcattcattatatgtgatttttttttccctgcctaaaaagtgatcatgttcatagtccgacaataacaacaaaagccaattttactgagacacaccagaaacactctttgatcatcttgcttgatgagtgacttggcactttggatggctttttccattctcacttagctgtatcacattagtgtagttatcagcacagggtgtactttagaacactttggtgagctaatatcttctcctatgtgtttaggtagtaaccaatgaacctgtaatgtgaggattattaaggcacaggttggagatcaggatttcttactgtgtatgaggttttttttccctgtattcaaaaaatccaattaaaattaactttttattattgagggaacatatttaatttgctgtctttggcaaagtatttatactgttgtcataactaagtagatgactatataatttttcattcaaactggtacatttttgagaatgaaagggggtactacaaatatttaaaattctatatatttttggaatatttacttttttcaaccattaaaatagtttttattgcattagtagatcaataaaatagctccatttaaagtctgttttcaaaaacaatttctaaaacattttgttgtacattataacaaagtttttaacatggacttcagttgaatatttaaaaacaaactatttttggtaataaatatttttatcagtttctcggtcaaatctgtcactaatactgtgtcactgatacttttctgaatatgattttccatctggttttactagttttaattttttcataaaattgcagtattttgcagagttacattttatacttgtggttgttaacttctacagttgatgcttcactataaccaataatgtttttagttgctaacatactttatatgtgctgctgtccccagttagctcaggaaaaattttgctagatggagaatattcttaattctaatttttttcttattgaaaattataggctgggcgcagtggcttatgcctgtaatcccagcattttcggaggccgaggcagatggatcacctgaggtcaggagttcaagactagcctggccaacgtgatgaagcccccgtctctactaaaaatacacacacacacacacaaaaattagccaggtgtggtggcgggaggctgagggaggagaatcacttgaccctgggaggcagaggttgcagtgagtggagatcatgccactgtactccagcctgggtaacaagagcaaaactctgtctcaaaaaagaaaaaaaagaaaagaaaattataaatatatcagtctcagtattttcacaggcagtgtccttttgcctgtattaaaggtaatctctgtttttacttttcattttttatagagacaggatctccctatattgtccaatctagtcacaaggtactgtctttgatacaaataagttgtccctatttatgattattttatatgttccaccagatttaagtgttgcaaaattgtaggccttctctaattttttttttttttttttttgagatgcagtctcgctcttgtagcccaggctggagtgcaatggcacagtctcagctcactgcaacctctgcctcctggcttaaagcaattctgctgcctcagccttcctagtagctgggattacaggtgcccgccaccatgtccagctatttttttttttttgtatttttagtagagacgaggtgttgccatattggccaggctggtctcgaactcctgacctcaggtgatccacccgccttggcctcccaaagtgttgagattacaggcatgagccactgtgcctggcctgtaattttctttcacctacttaaaaatagaaagactctttttttcatggcggctcacatttgttgtgccagcgctttgacaggctgtggtggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaatcccagcactttgggaggctgaggtgggtggatcacctgaggtcagtagttcaagaccaacctggccaacatggcgaaaccccatctctactaaaaatacaaaaattagctggatgtggtggcgggcacctgtaatcccagctacttgggaggctgaggcatgagaatcgcttgaacctgggaggcagaggttgcagtgggccaagaaagtgccattgcactccaccctgggcgacaagagcgaactccatctcaaaaaaaagaccctcgatggaacttctaaaattcattccaaaatataatgataaaatttcaaaatgaaatctcgtgtactatttgaactctcatttaatttgttcggttcttccttgcttttgaaggatatatttcagtgtcttggcaaactttgttgataataattggtatttgctaaaagcttcaaaagctgaaggttttctggagctttattcattaaacttgtttttgtttgtttgtttgtttttttaaggagatgatgtctcactgtgttgcccaggttggtcatgaattcctgggctcaagtgatcctcccatcccagcctcccaaatagctgggactacaggtgtgcgccatcatgcccagctcactaaactttacttttgattaaaggtttccaactgattttgaacagtatgcaaccaatttctagaggacttatttttaaaaagactcactattgagacattgattggatttataaagtagttttttgaaagtactagcctcggaagtccgatgacaggttgcaaggagaatacacatattgctctgttgcactattttattgtattcagtatcagtcttatccttaaaaatttaacagtgggaatatgaaaacatttataaatgttgacgtttgaagctgactcattaatagtgatgtcactagagctccatgataaatagaaactgcctcagtggttctctgcaaattgtctgcccatctattttctggagaaatgaaaatttagagcttagtttttattggatacagtgatgtctttatagctcattgctcctgaaaaggcttatgaaataataaaatggttaccaaacaacaaaataaataaacagttgtagacttgtacaatacaataaatgacaaaaccatctaagagttttcatactattgactttgcacatacttcatttgcacccaacctgcaatttcccactgacatagccagctggtggcctagtgtgtcttgtggtcactgtacatgccactgcactgcctggcataccaggtaaccaacaggagcaccagtgtcaaatatttctcctaatattttgcaagaccatacagagttaattgcccatggttgcttaagtctgaggatacttttcagtaagtctatgcactccccttgcaaagaagttgttttgttgaatctgtaaagaatcagaacaagaaagatggaattatcactagttctcttccagatttcatcacttgtttatgtggtgaaagcacttatagactactagttgataacttggccagaaactagatatacacagtagagatacaaaatccattctggttttagtgtattttgatataatgattgataatagtttttttaaaatttaaaatttaatttaattttttatttaaaaaatttttttaaatggagacaagatctcgctgtgttgcctagattggtctcaaactcctggtttcaagcagtcctcctgcctcggcctcccaaagtgctgagattacaggcgcgagcgactacacctggcccaataatagtttctttttaaaaatgggaaatcggagacatatgttaagctgaatgggatgctgggacaatgacggtaaatcaagattttcctgggcataccagggcatatgggaagcaacacagagctgggagcaggacacctaagtcctgactctgacttttttttaagagacagggtctcactctgttgcccaggctagagtgcagtggcacaatcacaggtcactgtagctttgacctccgtggctcaaccaatcctcctgcctcagcctcctgagtagctgacactatagatgcatgccactatgcccggctaatttttgcatttttggtggagatggtgtttctctacattgcccaggctgatctcaaactcttagattgaagcaatcctcccccaatagcttcccaaatcccctcctgggattacaggcatgaaccaccacatccgtctgactctgccttttttttttttaggtggagtcttgctcttttgctaggctggagtgcagtggcgtgatttcagctcactgcaacctccacctcccgggttcaagcaattcccctgcctcagccttccacgtagctgggattataggcatgcaccaccctgtccagctaattttttgtatttttgtagagacgggctttcaccatgttggccaagatggtcttgatctcctgacctcgtgatccgcccaccttggcctcccaaagtgctgggattacaggcacatgccaccgtgcctggctgactctgccttttaaaggcctggagaggtaacctctctgagactggatgtattagggttctccagaaaaactgaaccagtatgagacacacacacacacacacacacacacacacacacacacacacacttgcagtcttgagttcgaatatatatatctgtgtgtatgtcatacctgtgataaagtttaatttataaattaggcacagtaagattaacaacaaaactaatagtgaaatagtacaattataacaatatgctgtaataaaatttatgtgaatgtggtttctctctctctcaacatatcttattgtattatactcatcctttttgtgatctgtcagcctgataactgagtcggctactaagtgactaatgggcaggtaccatatacagagtagatgccctggacaaagggattcacgtcctgggtgggatggcatgagatttcatcatgctacttggaatggtttacaatttaaaagttatgaaatgtttatttctggaatttttcatttaatactctgacggcgagcaactgagggtaactaaaactgtggaaagtgaaactgtggataaggggaaactactgtgtgtgtgtgtacacattttatgtatttttaaaattatgctttccttccccctcacccacttaataagtcctgtcaaatctatgttacaaactttttttcaagccatacccttctcttctgccattgtcaatgttcagcccctcaaccagaccattaaaattacttcctaaggccgggtgtggtggctcatgcttgtaatcccagcactttgggaagccacaacgggtggatcacttgagatcaggagttcgagaccagcctagacaacatggcgaaaccccatctctactaaaaatacaaaaattagccaggcatggtggtgcacgcctgtaatgctgctacttgggaggctgaggcaggagaatcacttgaacctgggaggcggaggttgcagtgagcctagatcgtgccacgccactgtactccagcctgggcgacttcatttttttttactctacaatggcagatgaaacccttcataagttgtcttctacaaaattttataatcttatctccctatccctcttatcgttcagaacttcttgctgttctttttagacataactgagttttctgttgatcgcatgcctttgtgcatactgctatctctgtgtagaatcaccctctccccatcttccccatacctcaagttcctgctctgatgtcaccccatgaagccttcctggattcccatcctgatcccagaacactcttacacattcatatggaggcaaacttgatccttcaaaccttttttttcttttttgagacagggtctcagtctgttaaccagacttgagtacagtcacagagtcacagctcaccgcagccacaactgcctgggctgaggcagttctcccacctcagcctcccaagtagctgggactacaggcatgtgccaccacacctggccaatttttaaattatttgtaaagacgaggtctcactgtgatgcccaggctggtctcaaactcttgggttcaagcagtcctcctgcctcagcctcccaaagtgctgagattactggtgtgagccactgcacccagtcgatccttcaaacattgaatttcagatgagtctgttcataagctgaccaaggaactctttgaactgtagtgtgaatttaatggaactgcctttctgcaagcagtttatatctgatgacatcactacctttctgtatgtcagtttgtatattcatttaattgttttattgaagtggtttttgaaatgtattcataggtactttgggtacttgggtagaggatgaattcttggggatttgggcctctcaactggctttagagaaagcatttcattctcaatttgttacatattgggtttctgggtaaaatattagatgaagaggagttttgatgtcaaaaacaaaatttaagattcttgtttcatttcttgtctacctgattcttagtaacccatgtgactatctttatctattctctgtctcacgctccccaagaagaaacaaaatctaacccctgaaatcaaggatattttatcttattcatctttgtttctcaaatatctgttgaatgaatgccaaatatgttaatagaagttaatgaatagcatctaatttttattaatgtgtttatttcagttatcaagtgggaatcctgtatatgaaaaatactatagacaggtaagatttttgtttcattgtttgcctggattgaacattaaatgtactgtcaactcttgattgtatgcctgtagattaccagctagctcgataaatttgatgtgtcttgttttcaacatcttgtttacagcctccactttgagtacttaatgcatttgacaatcccagagaaatgaaggaaagataattaagtccaagtacttagttgtcttaaatatctatgttgaaaatgtatacatttgatagatttatccagatataaatattccaaattcttaagacaaatacaaataacttctatgttgtttttaagacttattaaagtataattttcacaaagtgaaaaacatgacttttatacaaatacataatgagcatgtatcagattttattcaactcattaattactggttaattagtacagatatacagcctctggtcagatataaaaatgggaatatggccgggtgtggtggctcacacctgtaatcccagccctttgggaggctgaggcaggcggattacctgaggtcaggagttcaagaccaggctggccaacatggtgaaaccctgtctctactaaaatacaaaattagctgggtttggtggtgcatgcctctaatcccacctactcgggaggctaaggcaggagaatcacttgaacctgggaggcgaggttacagtgagccaagatcgtgccattgcactccagcttgtgcaaaaagagtgaaactccatctcaaaaacaaacaaacaacaacaaaaaaatgggaatatgagttacagagatttacatacttcaccagacaatattcatttgtgttggtatggacaggagtcacttgcatcgctatcagtttctattaacctctacctctacgagtataaagtagtctagacagaagaaagtcatcaagggtgcataccatagatcagacgataatttcttgaaggtgtagacaatcttatttgcccattttcaagtgtcagattattttttctaacagtctcactaccttatgattatgatcacagaaaaggctggtttcattatttttggcctggctatttacatagttgcagcaagtattaattaaacattataggcctctttggttttgacttgcaaatcaggagctataaactatatagcaacttctaaggtcagagaataatttctgcctgaaaaatatcaagaatctcagactgtactttttaattcccctgttacatttgttcttctatcttaaggctgtgctccaaaccttagaaattctctccaccatatttcaccttcactacatataaatatgagtgaatttatctcatcttgaggtttcccagatttgctaaggttcctagcctgctggtaagtgaccttactttactacccgtgaggctaggatcttgtaaaccaggtagcagcccagttttcttgggagatctttgtgatgttcgtgccacataaagtcagtgcttgttctttaatctttgttttgtttgaataaaagaagtcattctcaaataatggccttgttttacacaattggcttatccagttacatcctaagaagaaaaacaaattgctattgaacccatgtaataactatattgctataaagagtaaaaacattccatacaagtatttgtttttgaattctgaggagtcagtgagaatcagatactattgatggggagaaaccagagcagaaaagctgaaaattctaaaaatcagagcacctcttctcctccaaaggaacagagctcctcgccagcaatggaacaaagctggatggagaatgactttgacaagctgacagaactaggcttcagacgatcagtaataacaaacttctctgagctaaaggaggatgttcgaacccattgcaaagaagctaaaatccttgaaaaaagattagacgaatggctaattagaataaacagcgtagagaagaccttacatgacctgatggagctgaaaaccatggcacgagaactacgtgacgcaagcacaagcttcagtagccaattcgatcaagtggaagaaaaggtatcagtggttgaagctcgaatgaaatgaagcgagaagagaagtttagagaaaaaagagtaaaaggaaacgaacaaagcctccaagaaatatgggactatgtaaaaagaccaaatctacgtctgattggtgtacctgaaagtgatggggagaacggaaccaagttggaaaacactcttcaggatattatccaggagaacttacccaacctagcaaggcaggccaacattcaaattcaggaaatatagagaatgccacaaagatactcctcgagaagagcaactccaagaccacataattgtcagattcaccaaagttgaaatgaaggaaaaaatgttaagagcagccagagagaaaggtcggtttacccacatagagaagcccatcagactaacagtggatctcttggcagaaactctacaagccagaagagagtgggggccaatgttcaacattcttaaagaaaagaattttcaacccagaatttcatatccagccaaactaagcttcataagtgaaggagaaataaaatactttacagacaagcaaacactgagagattttgtcaccatcagacttgccttacaagagctcctgaaggaagcactaaacatggaaaggaacaaccggtaccagccactgcaaaaacatgccaaattgtaaggaccatcaaggttaggaagaaactgcatcaactaacggagtaaaataaccagctaacatcataacgacaggatcatattcacacataacaatattaaccttaaatgtaaatgggctaaatgctccaattaaaagacacagactggcaaactggataaagaggcaagacccatcagtgtgctgtattcaggagacccatctcatgtgcagagacacacataggctcaaaataaagggatggatgaagatctaccaagcaaatggaaaacaaaaaaaaagcaggggttgcaatcctagtgtctgataaaacagactttaaaccaacaaagatcaaaagagacaaagaaggccattacataatggtaaagggatcaattcaacaaggagagctaactatcctaaatatatatacacccaatacaggagcacccagattcataaagcaagtccttagagacctacaaagagacttagactcccacacagtaataatgggagactttaacaccacactgtcaacattagtcagatcagtgagacagacagttaacaaggatatccaggaattgaactcagctctgcaccaaccggacctaatagacctctacagaactctccaccccaaatcaacagaatatacattattttcagcaccacaccacacctattccaaaattgaccacatagttggaagtaaagcactcctcagcaaatgtaaaagaacagaaattataacaaactgtctctcagaccacagtgcaatcaaactagaattcaggattaagaaactcactcaaaaccactcaactacatggcaactgaacaacctgctcctgaatgactactgggtacataatgaaatgaaggcagaaataaagatgttctttgaaaccaacgagaacaaagacacaacataccagaacctctgggacacattcaaagcagtgtgtagaggaaagtttatagcactaaatgcccacaagagaaagcaggaaagatctaaaattgacaacctaacatcacaattaaaagaactagagaagcaagagccagcacattcaaaagctagcagaaggcaagaaataactaagatgagagcagaactgaaggaaatagagacacaaaaaacccttcaaaaaatcagggaatccagaagctggttttttgaaaagatcaacaaaattgatagaccactagcaaaactaataaagaagcagagagagaagaatcaaatagacacaataaaaaatgataaaggggataccaccaccgatcccacagaaatacaaactaccatcagagactactataaacacctctatgcaaataaactagaaaatctagaagaaatggataaattcctggacactacaccctcccaagactaaaccaggaagaagttgtatctctgaatagaccaataacaggctctgaaattgaggcgataattaatagcttaccaaccaaaaaaagtccaggaccagatggattcacaaccgaattctaccagaggtacaaagaggagctggtaccattctttctgaaactattccaatcaatagaaaaagagggaatcctccctaactcattttatgaggccagcatcatcctgataccaaaacctggcagagacacaacaaaaaaagagaattttagaccaatatccctgatgaacatccatgcaaaaatcctcaataaaatactggcaaaccgaatccagcagcacatcataaagcttatccaccatgatcaaatgggtttcatccctgggatgcaaggctggttcaacatatgcaatcaataaacataatccagcatataaatggaaccaatgagaaataactaagatcagagcagaactgaagaaaatagagacacaaaaaacccttcaaaaaatcaatgaatccaggagctggttttttgaaaagatcaacaaaattgatagaccgctagcaagactaataaagaagaaaagagagaaggatcaaatagacgcaataaaaaatgataaagggaatatcaccactgatcccacagaaatacaaaataccatcagagactactataaacacctctatgcaaataaactagaaaatctagaagaaatgggtaaattcctcaacacatacacgctcccaagagggtgaaggacctcttcaaggagaagtataagccactgctcagcgaaataaaagaggacacaaacaaatggaagaacattccatactcatggataggaagaatcaatatcatgaaaatggccatactgcccaaggtaatttagattcagtgccatccccatcaagctaccaatgactttcttcacagaattggaaaaaaactactttaaagttcatatggaaccaaaaatggttccacattggctcaaaaatgagcccacattgccaagacaatcctaagcaaaaagaacaaagctggaggcattacactacctgacttcaaactatgctacaaggctgcagtaaccaaaacagcatgggactagtaccaaaacagagatatagaccaatggaacagagcagagccctcagaaataataccacacatctacagtcatctgatctttgacaaacctgacaaaaacaagaaatggggaaaggattccctatttaataaatggtgctgggaaaactggctagccatatgtagaaagctgaaactggatccgttccttacaccttctacaaaaattatttcaagatggattaaagacttaaatgttagacctaaaacccataaaaaccctagaagaaaacctaggcaataccattcaggccataggcatgggcaagaacttcatgactaaaacaccaacagcaatggcaacaaaagtcaaaattgataaatggtatctaattaaactagagagcttccacacagcaaaagaaactacaatcagagtgaacaggcaacctacaggatgggagaaaatttttacaatctacccatctgacaaagggctaatatccagaatctacaaagaacttagacaaatttaccagaagaaatcaaacaaccccatcaaaaagtaggcgaaggatatgaacagacacttctcaaaagaagatatttatgcagccaacaggcacgtgaaaaaatgcttgtcatcactggtcatcagagaaatgcaaataaaacccacagtgagataccatctcacaccagttagaatggcgatcattaaaaagtcaggaaacagatgttagagaggatgtggagaaataggaacacttttacactgttgatgggagtgtaaactaattcaaccattgtggaagacagtgtggcgattcctcaaggatctagaactagaaataccatttgacccagccgtcccattactgagtatatacccaaaggattataaatcatgctgctataaagacacatgcacacatatgtttattgcggcactattcacagtagcaaagacttggaaccaacccaaatgtccatcaatgatagactggattaagaaaatgtggcacttatacaacatggaatactatgcagccataaagaaggatgagttcatgtcctttgtagggatgtggatgaagctggaaaccatcattctgagcaaactatcgcaaggacaaaaaaccaaacaccgcatgttctcactcataggtgggaattgaacaatgaaaacacttggacacagggtggggaacatcacacaccgtggccttttgtgggttggggggaggggggagggatagcattaggagatatacctaatgtaaatgacgagttaatgggtgcagcacaccagcatggcacatgtatacatatgtaacaaacctgcatgttgtgcacatgtaccctagaacttaaagtataataataataataataataaaagaaaactatttcatttggtttacaaaagcagaggctactaagttgagggtctcagaaagggcttatgcacatagctattagaaaatagaacattaaaataataccaacagtattccaagtaaataactataattaaattttcctcaacagttcattcagtcctgtgtaattcttgttcagctgaatctcggattagaagtctgcttttatgaagtacatcttctttcagactgaaaagagtcctggaaatcctgacttcatctaccaatatggtctgaaagtagtgtgatgtcagctgagtagtctttatccaaaaatccactttttgaaatgttaataattcagactatgtatgtcttatagatacagactatatcaaaagtatagtcattttcatgaggctctaagactctttgttgaagatatatcagcttctggcctatagcttctggctttgcctatggcagagcctttaggcaagcagcagaatacctcagaaactgcctgtagatgacaaagactaaatgtttatattattagggtaaccaaaagaatggaagatagtaaaattcttaattgggatacagtacataatgatttcataagagtttgatcaatgtttcccctgaatgcttctatatttagtaggctgtgttgggtatggatatttgttttgtatgctgatcaggaagtaggcaaagaaaaggagttctgaagaattctacaggcaggtttcccaatccttatacttcctcttattccaaatttgaaggattaggccatgtttttcttttttgctgagtgcatgatttttcccatgttgtaccacttgaaagaaaggttttcccttttgcttctttgctaggattggactgtctagaatgctttgtacagtatatgtttacagtaaacttaatcttttaactaaactggaaaaacagatatctcacaaatatactattatcctgttacctttcccatgactttttaaaatgtacttttcatttttacaaatggaactttaggaaatctttacaaaaatgagtcttttttttcctgtttttgttgttgttgttgtttgtttgtttgtttgtttctgttcttgtgacctcattctgtcttaaaggaaagtccctggtcagttaaaatggtatgttccctaatatgttttaggaacttaacagctttaaaaaggtttcttcaagtttattttggaatcactgctggttttagagctgctattgctttgatttgttttaaagtgctgcagttcctaagagtaggtataaaagtgaaagttgatgattgaaagatgtttgaagaggcacataacatgtgcaactattcccatttgtcagaagacctctgtaggaaatgctgctcctttcttcctagtgccatttaattggaatttaaatgacagctatagaagatatgtgttgatgttacaaccccacgaatttgctttgacaatcctctgagcttcacttttctcatttgtatggtagggcatgataaaacaaaaaccactttgtaaattgccagtgctgtctagatagtactactcatatgtctgtccacatattctttggcccatggtagtcaaaggattctcattcctttcttgcaaaagccaggtcccaaatcacagggatggaaggcaggtaaatggtgataattttgccttttgtattttgttgtcaacttacggatttgtatcttttcaggttgatacaggcaatactggaagggtgttggcttctgatgctgctgctttcctgaaaaaatcagggcttccagacttgatacttggaaaggtagtattcgttcattataactagattataagtttgtaaggaatgtgtactatagatgaactggatgcaaatttagaaagatgccatcaagaaatttagaagttagaaccgagtcatagaagccattttaatagtaggatgaagggaatttgtagcgtagtgatttaccctcttgaaaagtaaggtgtttttcagatttttagaaacaaactactttttaataggataaaatgaggaagtaataagtacatttggtggggagaaacagtgaagactgggaatcttgccacacactcaaagacttggctctatccctacttcctctgttataactgtctctgtttaatgtgtggtaaatagactgggggatgagaggctttttaaaaagagcacaaagaggtggaaagcccctcccctgtctactccttatatgtgatattgatatatattcagaatcctgaaaaataatcacaataatttaattattcacaaatatcaatcatctcaacttgcacatagaaaagaatatcttaaggatccaaaatcaagaatagtatgtacattctagtagaaagagcattggtctcagagttagaacttggattaatgaaaaaggcatgtgactggaagttagaacttaggcttcacttctttccctggtgccttgaatgttcttgagctaagtcacttaccctcattgggccttagtatctttgtgaagggttgcactaaatcaggggtgcccaatcttttggcttccgtgggccacattgaaagaagaagaattgtcttgggccacacataaaatacattaacactaatgatagctgatgatcaaaaaaaaaaaaaatcataaaagaaccctcataatttcttaaagaaagtttatggatttgtgttgggccacgtgcaaagctgtcctgggctgcatgtggcctgtgggctgcaagttggacaagtttgcactaaatgatctttaagggttctttccactcttaattctatgattcttagatctgattaccagagagcctgaggttgtaaatagcagagatttaatttatcattcagatgacttttgtttaaaatatacattgatattttttccccctaaatttcagatttgggatttagccgacacagatggcaaaggtatcctgaacaaacaagtaagtttcagatattcatatgattttttttttgagtgattcaaaataaaaaatagccagcagggttttcttgtattttgaagccaagaattggtttttaccaacattagagttttgcctagggcaagtgtgtaacaaagtatttccaatcactagatgttaatataagtcttaacagttagtgtgagtttggtgacattgttctcctggagtttatttttctgtctttcagagagactttgctctttaattaattttcctagttacatagggttataagtaaaagtgaatgttattaagtaagtgttaagatggtattgtctagtagatttgaagatttgaaaggaaactcttggttaatcacatgtgagatgtgagtattctggtctagatcttactcctgatatataaaccaaaaaatgatttataaaccagaagtaaattcttgaccagaatacataaaagtggttatggccaagggtgttgaacaccatcagtgtactctgaagttctgattgttggggatggatttcagagttgtataaggattgaattccaagtttgctgagtgccactactcaaagttaggcttcctccccacccccggcatagctaaagcaggatcaaagccagatattggagaaatttgatgagagggtcagaatatccagtcttttaattaagatttcggggctagattgtagtccctgttcatgtctctgggtagaagggctactttggtgtattggaggtataggaaaacaaaattcataggggcccacctaggtgccatgtagtcagtcagcaaatatttgttgagtacctatgatgagccaggctttagaaatacagaggttaacatgatagatgtggtcactgtcttaaggttttacagtataataaattttttacttataattgtttgattttggatattgagtttgagttgccttagtacttccaggtggctggatttatgagtctgcagttaaactttgaagttcctttggaagcatagatttttttttttttttttttttttgagacagagccctgatctgttacccaggctggagtacagtggcgtgatcttggctcactgcaacctctgcctccgggattcaagcaattctcccatctcagcctctggagtagctgggattacaggcatatgcctccgcacctggctagtttttttgtatttttagtagagatggggtttcactatattggccaggctggtcttgaactcctgacctcgagtgatccacccacctcggcctcccaaagtgctgggattacaggcgtgagccaccgtgcctggcccagatttttaagttagcatatgaatgaaagaaaagaaaccaatacttaatgaatttccatgtgacaaaaatgacagtaggcactttcctcctgcagcatggtttttattttgttgctcataatacattgcaaggtaggtattagcccccctattatggaagggttttaacttgcccttggcctcacaactataagtagcagaaatagaatttaatgcagaattatttcacttcatagcccatccatactgtggtaatagacttgattacctaagagtaattgaatctcaaatagagtgagaaaagaaagagggtcatgttagaatacttagaatactagcagttagggaagacattgactccaacagaagagacctaaaaggtcagaagagaactaggagggttttgtgaagctgtttggtggaggagagcttccaggaagatactttcccaggctgcaaaaagaataagcagtatgaggcttttttttttttaaggctattctatttggtagctaggagattatctgtgacataggcggtagtttttctagctaatcatgggagttgaagtcacattgcacagaaggttgtggaatgaatgagaagaaaatgggatatcttgaaatagcattttttcaagaaatgagtgaaggcaagggattgtataaagcagacagtctgcaaggtgataagaatgggttatgaattgggtatgaagggtatgggggagagtacgggatttcagagaagtagtgaagggttgattacatcagcgactatactagggtattgacaggttggacaaattgtagctggagtaaaggcttttgttatcatgtctatgacactaactcaaaacagctgaaaaccagttgcttcagcttctttgcatttatttattaagttttggactaagacttcaactgctaaaaatccaaggacttttgggagagatttataattattttgaagttaaaccgttacataattttttttgatgttgcacagttattttctgtagtttttctggaattgcagtcattaagtcatttgaattactgttccagtttcaaaatttataatctcacaatccagagatgacttttcataacattttaggtattattttcttttgggatttttctctaattctttttttctcatttaaatgataaaatacatctcttaatatcattaaatattatttgtttttttttggtttgtctgtttttttgagacagtctcgctctgtcacccaggctagagcgcagtagcccgatctcggctcactgcaacctctgccttccatgttcaagtgattctgctgcctcagcctcctgagtagttgggactacaggtgcacgccaccacacctggctaatttttgtgtttttagtagagagacggggtttctccgtgttggccaggttggtctcatactcctgacctcaagtgatctgcccgtctcggcctcccaaaatgttgagcttacaggtgtgagccactgtgcctggccctaagtattattttaaacatgagtattctgtatgatttccactatctgtatgtattttcccatttatgttattattagcgattcataaatactaggaacatctttctacataggatttttctgcaagatatttttgaagcaaatatgctacttgttgctacataagacctctgtagtaattatgaattgttttatatttttagattgtaagtatttgtgcaggtaggtaagttggtagagggagaatgctcttaacattcatacttttctttcttaggaattctttgttgctttgcgtcttgtggcatgtgcccagaatggattggaagtttcactaagtagtttgaacctggctgttcctccaccaagatttgtaagaaatgcttttagatttaaattgtatttaatttttaaaaagtgacaccacgttatttgaaaattaaaagtaatatattaaaaggaattctccctttggccctttcactcagctacttggcttttttccccctactggctcctgctgtttttagttaatttcttgtgtatccttccagagtgattatatatgtatatgtgagaaactataggctgggtgaggttgctcacgcctgtaatcccaacactttgggaggcagaagtgggaggatcatttgaacccaggagttcaagactggctgggaaacaaagcgagacccccatctctacaaaaaaatctaaaatttagccgagtgtgttggtgtgcacgtctggtcccagctacttgggaggctgagatgggaggatcatttgagcctgggagctcaaggctgcaatgagccgtgatcacaccgttgctctccagcttggttgatggtttaagaccctgtcttaaaaaaatatatatatataaatacttattttcttattttactttaattgtagcatgctatatattaacggtccccaacctttttggcaccagggaccggtttcatggaagacaatttttccatggacctgggagggatggatggtttcagaacgaaactgttccacatcatcaggcattagattcttataagtagcatgcaacctagatccctcacatgcgcagttcatgatagggttcgtgctcccatgagaatctaatgccaccgctgatctggcaaaagttggagctcaggccataatgcttgcctgccagctgctcacctcctgctatacagctcagttcctaacaggccatggatgggtaccagtttgtggcccagggattggggactcctgctatgcacataattctataccttttataagtagcttattaagttttagaggtatttatatatcattacatagaagcttccactttgttttttatagctgtgtagtatttctttgcttatgtttatgataattaactttctattgataggcttttagtttattttgaatctttcattattaaaaaaatgctgcaatgaataataaacttggacatatgttattttgcatgtgcaggaatgtatttatatgtgttaatttccaaaagtagaaatgctgttcaaaagtttttgcctttgtaatttctatgtattttgtcaacttgctttccatagtggttgtactagttcaccctccctccagcaattgtttgagtgcctgtttctgtacactttggctagcatactttggttaaacttttagatctttgcggtttgataggtgacagtatgtaattttaaatttatccttttggttttatggagtgaggttgaatagcttttcttgtgctaataagaatagctttcttataagcttttcttatgtttacattgcctttatgtgaatgtctgtttatagcttttgcccatttttcttggttgttgctcttttacttattgaattctagggcctctttaattattaggacattaactctttgtctgtatgagttgcaagtctttttttcctattttgtcatttgtcttattttttttgaagagacagaatcttgctatgttgccaaggctagccttgaattcctgggcacaagtgatacttctgccttagcctcccaaatagctgggacaattggcatgtactactgagcctggcttattattgtcttttgtgtaaataaattgtcaggttaaattttttttaattttttacatttaagttagtattgatctaggatgtgagtacagattttatttttatttatttatttatttttttttgagagggagtttcgctcttgtcaaccaggctggagtgtagtggtgcaatctcagctctctgcaacctccaccccctaggttcaagtgattctcctgccttagcctcctgagtagctgggattacaggcacccaccaccacacccggctaaattttttttttggtggtagagatggtttttcaccatgttggccaggctggtctcgaactcctgacctcaggtgatctgcccaccttgacctcccaaagttctgggattacagacgtgagccaccacacctagcctagattcaactttatattttttcaagatggctaccctacagaaagtatagtcaatacagtttattaaataatccatccttcacttcctgtctcttcattccctttgaaatgccatctcagttgtgtgctaaattctcatatgtattttgattgcttactcgattttttttgttcttacctattgatctatttatccataccatatgctgatgttacattgttttaattatcatatttggtgacatgttttttaaatctagtatgctagtcctccccacctcactcctttttttccccagatattttatggctcctcttgttttttgtttttttaaattttaagagatggcctcattctgtttcccaggttggaatacagtgctgcgatcatagctcactgtcaccttgaactgggctcaagtgatcctccccagtaactagttgcttgtttttaaactcaacattttagaagtttttggtctgcatactaataatttaatttcttaagtttagagaatttctgcacttttatgtttaggcatgtagtcagaaggttaatttagggatttgttgcctacgtgcattacagtcatgcattgcttaacatggtgaaatcccatctcaactaaaaatacaaaaattagctgggtgtggtggtgcattcctgtaatcccagctactcggaggctgaggcaggagaatcgcttgaacccaggagatggaggttgcagtgagccgaaatcatgccactgcactccagcctgggcgacagagcaagactccatctcaaaaacaaaataaaacaaaaaccagaaaaggtacagtaaaaatatggtattataatcactttgtttcattgttatttagatggtctagtaaatgtaaaatagtgtcctgtgtgcattgagatccagcattttgtgtgaacatatttaaatccaaaaaccattttttcttcattgcttcttgatgtgagaatttcaactcttgttgtgctttactttcttctatagcatgataccagtagtcctttgctaatcagtggaacctctgcagctgagctcccatgggctgtaaaagtaagtaaactttgtaactattctctcaccccttcattgcttcctatctactctctctctacctctgaaatatattgctatcttcattagactttcatacatgtttagggaaaggtaggggagaagctgttactggtgtttctgagggatctttcggctctgtcagttgttttgtgacagtatcggtctacttgtatatctgttataatgtaaagaaaaatggtgatgtcataatcttgtattaactaaaatatttgattaaaagatagtttaccccactggtgttatctcttacttgaaaattctggttaactatgtattttctagatgactctaaaacaaacaattctttatgaaatctttttagaaataggtattttgcattatagtttttcagagccacatcatatcgtactataaaacttgtaatttaaaaatgcttagactatagcagatcaaatgagctttgataaatgtgtacagtttttttgaaaaccatttttatttgtatgtctttgtatgctgtggactgggcactaagttttaaaagtgtgggaatatggccttgactgggcaaataatgaacaatagtttttcatgttacactaataacttttaaaaatttaggagatatcttgttattgacaagaaaaagaaatattgctttgggaaaaatggagaaatcttgatgtttattcctttagtaattattttatttttaaaaatttatttgtggctcatgcctgtaatcccagcactttgggagggtgaggcgggcagatcatgaggtcaggagttcgagaccagcctggccaacatagtgaaaccccgtgtctactaaaagtacaagaaaattagctgggtgtggtggcaggcgcctataatcccagctactcgggaggctgaggcaggagaatcgcttgaacccgggaggtggaggctacagtgagctgagattgtgccactgcactccagcctgggcgacagtgcaagactccgtctcaaaaaaaaaaaaaaaattttatttatttgaactgcacctcataccatctttagagagtcatggaatgtcactaattagctgtgtgttcttataaaagttacttttttgctctgggtctatttaagtgagagggttggactagatgttcttcaaagcccttctacctctgaaatattttgattctaacccaatagttggaaaataaagatggtgttccagctacaaaaagaatgggcaacaccagactcttgggtaaagtcactttgaaattattatttcctatgtatttttttcttgcgtatctttacaatgaatattatattttgatgaaagtgaaaaatgttttttaaatgatagtttaaaaacatatgtagtctattctttaaggacttgatttttataactgcagttaaatccttttctcttattatttaacttgtgattttgttttttattgtagcctgaagataaggccaaatatgatgcaatatttgatagtttaagcccagtgaatggatttctgtctggtgataaagtgaaaccagtgttgctcaactctaagttacctgtggatatccttggaagagtaagatattatttactccgaaatgtaatttttatgtattttaattttatatctattatgccaggagcatgtataactctttgttaaaaatatacaaatcttattttaaagttgtatcattataggattttttgttttctgacttaatgtataaaattattgccagcatatttctgtatttggttattccctgtaaaaatgagtggttgaaatgaattacatatgtaagccccttaagtaggtccttttttagtttgtgctgtacactcttgacctcctatttgcttgagttaatttctagagaccatcagtattttatgtctgccacttactctgtggctgtatcatggtgtcttgttgtaaggaatagttttatctctgaaatcataaattcttctctctaacttgtacttcctgtctttatagagctcttttccagaaactagcaagactaattctttgactggttttactaagacctttaaatctgacttcttggctgggcatggtggctcacacctataatcccagcactttcggaggctgaggcgggtggatcacgaggtcaggagttcgagaccagcctggccaatatggtgaaaccccatctctactaaaaatacaaaaattagccgggcgtggtggtgcgcagtctgtggtcccagctactcaggaggctgaggcagaagaatcgcgtgaacccaggaggcagtggttgcagtgagccgagatcgcaccactacactccagcctaggcgacaagcaagactgtcttagaaaaaaaaaaaaaaaaaaaaaaaatctgacttttttacttttcctctttttttcaatttttttactgtgataaatatgcatatcatgaaatttaacatcttaaccaattttaagtgtacaattcagtggtattaactacatttacattattatgcaactatccccaatatccatcgccatgaattcttttcctcctgtaaaagtaaaactttattccctgtcttttggtctacagcttcatatctatccttagccccctttgccatgttatttttctatctctcctgcctgatggaaaaaacatgaagtaaattatctgccttctctgtggtgcatgtggactactgagcaggtgtagtaagattgctgtcactttaaatttatcatcaccagcttcagctgggcttctccgtactgccagtcactcttgtgctgtttccatagtgatttctccataatcctcttcatatttcaaatcttaactactctctttaaacctcttgccctttctttttttttttttctttttttgagatggattttagcatttgttacccaggctggagtgcaatggcgcaatcttggctcaccacaacctctgcctcccgggttcaagcaattctcctgcctcagtctcctgagtggctgggattacaggcgtgtgccaccacgcccagctgatttttatatttttagtagagatggggtttctccatgttgttcaggctggtcttgaactcctgacctcaggtgatccacctgcttcagcctcccaaagtgttgagattacagcgtgagccaccagcacccggctgccctttctttaattacctgcttcagcagattacatagggtcaaatcctggctgcaccacttcttagctgtgtgaccttgggcaagtcattagaaagccatgtctcagttttctaatctttaaaagggacataattcccagcttatagaattgtagtgattgaatgtgataatgaatgttaagtcctgcttattaccatgattgctacatactctttgaatgctagctgctatgatgatgacaaccaccataccaccatattattactactactggatcaatgttatatagattttagatgctcaataaatatttatttaaatgccattttttagtattgtttcccactaattatttctcccctgtgtgatcagtgtgaaatttctaaactataaatacactgttgttattttattacttaaacctaactttttagtagctttccattgcacttagaataaagcccaaactcctttcaaggcaattataaccagacacttgcttatctccatttttaactctcaacagtacacttttttttttttttttttttttttttaagaaacagtgtctagctccgttgcccaggctggagtgcagtggcatatcatagtgcactgcagccttgatctcctaggcttaagggatcctcctacctcagcctcctgagtagcttggcctacaggtggatgccaccatgcccagctaattttttatttttatcttttgtagagatgggatctcgttatgtttcctaggctgtctcaaactcctgggctgaagtgatcctcctgccttggcctctcaaagtgctgggaggccatatgggcatgagccaccattcctagctcataaactttcttttcttgccctcgagtagaacatgaactgaaagaacattaatcttttttcaattattctctttttaaggtttgggagttgagtgatattgaccatgatggaatgcttgacagagatgagtttgcagttgtaagtaatctaatgttcttaacatcttcattatcttaatgattttctcatgtgcaaatttcctcttttagttcatccttagaggaaaactatattctcatcagattattgggtgaactttttttttttttctttttgagacagagtctcactctgtcacccaggctggagtgcagtggcacaatcttggctcaccacaacctctacctcccaggttcaagtaattctcgtgcctcagcctcccaagtatctgggattgcaggcacatgccaccacgcccagctaattttggtatcttttgaagagatggggttttgccgtgttggctaggctggtcttgaactcctgacctcaagtgatctgcccacctcagcctcccaaagtgctgggattacaggcatgaaccactgtgcccggctggttgaacattcttatatagaatttatatttattttctaaacaaatggataacagaaaatgtgtgttctgccatcttcattttatttggctttaaggtacataggaacgtatactttgtataattactgtaaagatagtatcttttgtatcacaacctgaccaggtatcttagtacctgcttctaatatggaataattttgcttcaaatgtatctcccaaatttcacatttccttttatttcatttaaaggaaacatgaataacacttgagtttcacttcatttatgaaggcagaaaagttttgacattttatctgaagacatgtcatcttagtaattgaatagttaattccaaatatggttgtattcacctcttccttaaaggtttgataaaactttgctgtgaattcatcagtggtaaatttctaatttcccttttactctcagattttctctttttattttggtaaggaattactaatttcttttactttcaaacttgttgctacaaatttgtgatactctctttcgtggttgttctctttactcactccaagtcttgggagtactcccacttgtatttttacttaatctgattttgtctagtttattgatctgttagaagaaccatcttttgaatttacttatcctttctattatattttgacttttaatttaatgatgtttaacatttaattccctgttacattttcttattctttttattttaaatttctcggagatgagtattatgtttcttcagttctctttatctttaatattgaaatcatttaaaggatatattcacccttgaatacaggtttagtgggattccatagatattggtacaaagttttctcctttatacagctttttagataatttttagttttattatctggttaggaatatgtttcctaattttaaagtggttaagtttggttggtttttgttactttgatgtatactttcaacctgattggattataactagaaaaatatagtctataaaatgtctaattaaaaaaattagttaaggctttctttgttgccaagtttatgacctgcttttacatatattccatggatatggcagtatttctgtttggaggatattagagttttataaattcattatatcaaatttattttattttattttattatttttatttttgagacagagtcttgctctgttgcccagtatggagtgcagtggcgcaatcttggctcactgcaaccaccgcctcccaagttcgacgattctcccgcctcagcctcacaagtagctgggattacagaagtgcaccaccacatctggctaacttttgtatttttagtagagacagggtttcaccatgttggccaggctgctcttgaactcctgacctcaggtgatcctcccgcctcagcctcccaaagtgctgggattacaggcgtgagccactgcacccagcctcaaatgtattgattatttagtttctctttgtccttatttttcttttgtttttggcccttccttagattttcctcattttccacaagagccagatgaaataggcagaatacatattaccacattttaaaaatgcagaaagagaaacttaaagtgacttgaattcttgttcacaggtacctaatctttttaattttaatttgaataatagttgggaaatggtaaaggatactccctcgcggtggtgacaaaagttatctcagtcgcatttcaggggttgagccattgtttgtgggatgcttttgggaatggggccgtgctgaagagatttcggtgatgatatactttgaaacatcgtcaaaccctacacataaacttctcataaatggtttttgtggtaagaatattggtgcaaaatctttgcatggtacgatgtaatgagggattttttttctcataaagacaaattttttttttttttagacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacagtagtgcatgctaaggtaaatgaataaacacaatttatcttatatgcctggagcctattcccaggtaactggccttttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccttaccccgcctcccagttaatgtggaaattttgttataatgtcttgtttcattaatatagttaatacaggttgagcatccctaatctgaaaatccaaaacttgaaatgcttcaaaatctgaaacttttgagtactgacatgacccacaaagtggaaaattccactcctggtctcatgtgataagttacagtcaaaacttttgtttcatgcacaaaattattaaaaagattgtataaaattatcttagattatgtgtataaagtttatatgaaacataaatgaatttcatgtttagacttgggtcccatccccaagataggataatattccagaatctggaaaaaaaaaaaaaaaaaaaaaaaagataatattccaaaatccgaaaaaatccaaaacacttctggtcccaagcattttgggtaggggattcgcaccttgtgccccttttcctgtactagtacttatttctcctatgttgaaaacaagattttcaaccattactctagcaaaatgagtcctttagattatttttatttattttcttccccatcatgttcttttttttagttttaatttttattttttttgagatggagtctcactttgttgcccaggctggagtgcagtggcgcgatctcagctcactgcaagctccgcctcctgggttcacgccattctcctgcctcagcctcctgagtagctgggactacaggcgcccgccaccacgcctggctaattttttttgtatttttagtagagacggggtttcactgtgtttgccaggatggtacttgatctccctgacctcgtgatctgcccgcctcggcctccaaaagtgctgggattacaggcttgagccactgtgcctggccccccctcatgttctaattccagaagaccttagaacattttttgtgactcaaattctagattttgctcagttaatttatttcttttggttttggtatttttcttccagttttgttcaatattaataactagtattcttttggttagaatttgtctgataaatctttctttatccttttactttaataaatagagcaacataatctgtactctttttaaaaattataattactgcaagatagcctgtgtaactacagctgcaagtcattgatttgtttttatttacaagcatcaatattttacaaaactgaattttgagagctgatatcattcttccttgaaaattgaagtaatttaaaaaatacttttgcagtagtgacgtagctaagatctgaacattttaaattatcctcctaaataataaaatataatgttcttatttatatgatcagtccttttggcctatggcagtttatactctgccaggattttggtttgttgaagtataatacaagtttaggtcttattttactagataatcaaaactgacttgaacataggaatctttttgttcaagacttacctttaaaattcttgcccatttccccttgggttaaatgctttttgtttgtttgttttaaagaccccgtgtctgctttgtgtttatttttttgaatgggaaaaaatgaaaatgaagttaaagagaggactctaacttggggtgttgaatttcagtatagattttttaaaagagtaacttagtaattaaccaaaacttgcttgaacttgagtctttatgtttagacttacttttaaaattcttaacccgtttcttttattttatagcataaatgagatttttggttggtttatctttttagttagaataaatgaagttaaagattctaacctgtataacttctgttgccatgtgaacctttgatgaatggcccttgtttcttttcaaatgtaaatgcttgttcatattctcagaagcccagtagtttaattaaaaatccagaatctagaatatcttttagttttttggttttttttttttaaaagtaaatttgtaaaagttaggccttggcatgaccatgggtattctggccacaactaaaatgacttcagagagttttgtgtacgtggaatgtataatgtatatatgtatgtacatacacaaaaatagatttaaaaaatcatatctaccccctcaaatctggatttttaaaatatctgtgattgtgtatcagtattctgtttactcatggatgaattatctgactagattgtaaggatattggaaatatatttccgagtttaacttctggcccatttggctttgtagaaagtctctgatggagcattaaggcgacattttgtaaaaggagcaaatttttctttttctttcttttcttttttttttgagagtctgtcacccaggctggagtatggtagtgtgatttcggctcaccgcaacctccacctcccaggttcaatctgttcttgtgcctcagcctcctgagtagctgggattacaggtgcccgccaccacgcctggctaatttttgtattttttgtagagatggggtttcgccgtgttggccaggctggtctcaaactcctgatctcaggtaatccacctgccttagcctcccaaagtgctgggattacaggtgtgagtcaccgtgcccaaagggccaaatttttctgttatgatttgaaaactagaaatgtatctaaaattatgctactgccagtgaaccaagggaagtgactgataattatgttaaagtttattctctttgtggggtaagttctgcaagtgtatagtcctattctgtgaaatagttctttgttttattagggctgaaactactgctttttattttaaagaaaaggcccgtaaatctaggaatctagtatttggtgaatgagcctatgctcatgatttttgtagatttagagtttgacaagatcctgtaatttagcttctttaagcacagcagttcctggcttacaacccaggctaacctgagccttctagagtcatgctcttttttttttttttcctaatgaactttaaattttggagtgattttagatttatagaaaagttgcagagagcacagttttccattccccttcgctgttttccctttttaccatattacattaccatggtacatctgtcaaaactaaaaaaccaacattggtgcattattaactccagactttatttgggtttcgccagtttttcctttctgtcacaggatccaatctagggtatcacgttgcatttagttgtcatgttttcagtctctctggtatatgagtttgtcagtcttgccttgctttttatgaccttgacatttttgaagaatactggctagatatcccacagaatgtctcccaacttaggtttgtctgatgctattctcgtgactagactggacaaatgagtttttgcaaagaataacacggaggcgtaatgcttttgtcatcacattatattgggggtacatgatatccatgtgacatcactattgatgttaaccttcacttatttaagataagtgtttgccagatttcaccactgtaaagttactttttcccttttcctactctattctctggaagtatagactcatgccctttttactttgctgtttgtctgcatatctatctattggtttttacattcttactaagccttaaatttttctatcaggtaagttcttagactgaaagtggcttaagcttttgtcagtaatatttgtttgggtcttcattatgtgaagagtttttggcacttagagatgtatagaggagctgtttttgtgtgtattagtgtgtatcacgttgtattaaaattaactgtttacatatttcctcctcctattgggtcgtaaaactgagcacgatcttttccctttttttttttttttttttttttgaaacaaagtctcactctgtcgcccagactggagtgcagtagtgagatcttgactcactgcagcctccacctgctaggttcaaacaattctcctgcctcagcctccagagtagctgggtttataggcacctgccaccacgcccagctaatttttgtatttttagtagagacagggtttcaccaaagtcttgggctttggccaagaattaaaaaccctccaggtgattctcatggtgactaaaatttgagaaatactgcctaaaagcatggaaaatgaaaaaatatcagagaaagtggacagctgttagtaactgattgcaacagtaaaattaaatcccctctttccctcctgtctcaggagtttgatacttttattattcttattaataaaattttttatacttttactttgaaataaaaagacattctaaatgcttcttccttaagtgtctctttctgtgtaaatgcacttgctagtatgtttcagtttgacaactagttactaaccagattttttttggtgtgtgtgtgaatgcatttgatttaattgcttttgtttcagtggcatacttttaataggaataagtacaatataataagaaaacaaaatcacaacccagcagtattaaaagtattctgttcacttttgctcttttatttggaggtataatttttggctttagttttgccagggaaactattttcaaggcaacatgaaattaataatatatatttttaactttcataaaaatgtgttgtctattggcagcagatggctaacgttgctttttcgcttctagtgtccacttttccaggaaatgactcccatctgcagcaagagaagtgctgactgttaatgtgtacactaggcacttctcttagctcagtgccattctgacaatttcacagtacatatattgtgaatttggttggaagtgtatgttagtcagattgttttctttctggagtttcaggcttttggaaataaaaagtttgtgtgtttctaaaactgaaattgaattcttctaggttggctagtgaaaaaggagaggagaattcttggttaagtgtggttcctggacaaacagcatcagcatcattcgggaacttgttaaaaatgcaaattctcaggcccaaccttgctggttagaaaattctgagtgcaggggccagaaatctgtgctttatcatgctgtccaggtaattctgatgcctgctaaaatttgggtaccaatgggttaaggtttagttttatcgcttgtaaaggacagcgtggtattgtaagattacatatgtgctgctaataaagctgatcaaatttggaaaaaacaagagctttgtagccagaagatgttggtttgaaccccactgtatcacttcttaaaaatattatattgggcaagttacttagcatcttagcttcagtgtgttcatttgtaaaatgagattggtaatcctggaaatcagtgatgaatgttgttgcattgagtgctcaataaataaattgaggggttgggtgtggtggcttacttgatcccagaagtttgataccaacctgagcaacgtagtgagacccccatctctgcaaaacataaaaaaattagccaggcatggtgacgtacgcatgtagtcacagctacttgggaagctgaggtgagagactcacttgagcctgggaggttgaggctgcagcaagctgtgttctcgccactgcattccagcctgggcaacagagtgagcctttgtcaataaattattaaataaaataaacaaattaaataaatatataaatatatgtgaaagccccacaaaacttaatatatgattatatgcaaattttctctggaagaaaaaatttaacaagagactgggctcagtggctcacacctgtaatcccagcattttgggaggctggggtgggtggatcgcttgagctcagaagttggagaccaaccagcctgggcaacatggctaatcctcatctctttaaaaaaaaaaaaattagctgggtttggtggcgtttacctgtagacccagctacttgggagactgaggtgggaggaaggcttgagcccaggagacggaggttgtagtgagccaagattgcgtcactgtgctgggcaaaaaacaaaccaaccaaaaaaaaagaaataaaaatttaagaaacatgcaagctttcttttcgtggttgctggactctttctagaggttccaagttagtttgagtgatttcatatgctaaaagatagttatggaaaactttcatgctctgaaagtgttgaaggtaccttgaatgctttaaaatgaagagaatatattctgggacagtctgtatgcaaatttttcccattttgtgcaagtgctttatgtattaaaaatacttgtcatggttcaagaatcaatataagaagatatacagtgaaaaaaatctcatttccacccctgctctcaattgctccatttatccctattctatgcctaattttcttaatttcttatttatcttagaatttctttttttttcttttctttctttctttcttttttttttttttttttgagatggagtctctctctgtttcccaggctggagtgcagtggcacaatctcaggtcattgcagtctccacctcccaaggtcaatcaattctcctgccccagcctcccaagtagctgggattacaggcatgcgccaccacgcctggctaatttttttgtatttttagtagagatggagttttaccatgttggccaggctggtttcgaactcctgacctcaggtgatccacccacctcagcctcccaaagtgctaggattacaggcgtgagccaccacgcccagcctatcttagaatttcttaatgcaaatataaacaaatataactaattatttcctccttaccacaaaagataacccactaaacacactgttcaacactatactttttcatagttaacagtttatcttggataccttttcactatgagagctccatgattctttttttcctggttagcattattcaaggctatccacaacaaactgcatccaatttaagtatataatttgatgagttttggcaattatatgcctgaaggcaccaccacagttaagacacacaatgttctttgtgatttttttaatgctttatagtatttcattatatggatataccatttttaaaaataatttttttaccttaacttcccagtgtagagtataccataattttttaaaccaggttttgtagatgggcatttgggtgctgatacaaacggtgctgcaattaatctttttcatacagcatttcatatggatagattcccagatgtgggattgcagagccgaaggggaaacacatttgcaatttggtagatgttgccagtttgcccttcataggggtggtaccaatttgagcatgttaggggaagaaaaataatttttcctatacccttttaagttcttggctgagaaccctgtaacaaaagataagagaaaaacagaagtttattaacatgtatatttcatatatacatggaagaaactcaggaaaggagtaactgtcaaataggtggcttacaactcaggtttgctcttgctcctgctcttgccatgtgacacgtctgcaccccctttgccttctgccatgattggatgctccctgaggcctcatgagaggcagatgctggagccatcttggtacaccctgcagaactgtgagccagttaagcctgttttctttataaattacccagccttaggtatttatttatagcaatacaaaaacggactaaaatacagccccccccagtgtggcctttccatcctaggagctgcccaggagtgccctggctcctgcagggtagcagttgggagccttatgtcccacgttgtgcccaatccttcaccacagctagctgaagcccaaaaataccagaacacatcctctccaaattctgagctattaggaatacctccttggccatctcttgagtgatccagtaagaaagagaagaagagcagcatctgacatccagccacgggccaggcactcacagcgaggccatgtaattttcctactgaatcttcagtggagcctcccttatgccttttccacaccctggaatcaagctgccctgcacttggagttttttgcaaccatggcttcctcctggacttgttcctgtggtcccacccagaagccattcaatgcacaggaggacaatttcccgtaccccaagattgcaccctcagccagtcagcagcaagcacccattgcctagccacccccaccccttccccaaactgtctgaaaaaccctagcccccaaattcttggggagattgatttgagtaataactctgtcttccgtgtggtgtggccagttttgcatcaattaaactcttcctttactgcaaaagaaacttagcctaatatagcatctttaacaaagaacaatgaatttttttaactcttattttaggttcaggggtacatgtacaggtttgttatataggtaaattgcatgtcacggggtttggtgtgcagattattttgtcattcatttaataaatgataggtagttttttgaacctcttcttccctccaccctcacattggccccatgtctgttgtttccttctttgtgaccccatttactccatgtttagctcccacttagaagcaagaacatatggtatttgtttttctgttcctgtgttagtttgcttaggataatggcctccagctgtatccattttgctgcaaaggacatgatcttgttgttttttgtggctgtgtagtattccatggtgtatatgtaccacatttttttaatccagtctaccattgatgggcatttaggttgattccatgtctttgctattgtgaatagtgctgtgatgaacatatgtgtgcatatgtctttatgataaacaatttatattcctttgggtatatacccagtaataggattgctgagtcattgataattctgctttgagttctttgagaaatcaccagacttttctacaatggctgaactactttacattcccaccagcagcattaagtttgttatgtaattcttctggcgacacctctaggctgataagggtctgaattcattttgggcaggaactgttatccttccttgtagagagggcaagagggatacctttgtaaatttatatcctgcttttaggcatatagaaggagggcagagagcttttatttatttatttatttttttgatgctactacttctcagttgctttcagttcaaaataatccttatgccaaagtggaatgttttggggtagcatgctaccgctcagctcccaccagcagtgtaaaaatttccccacagtttagctaacaaagtatattatgaaactttgagtttttgccaattaggtagaaaatggtatttcagtatagttttaacttacagttttcatctgagattgggcattttttttatgttaaagaatggaccatttaagggatttgcttgtctgtaaaatatctcttcaaactctttttccatttttctattggacttttttttctgttaatttttaggagctctatatattagggagagtacttctttctttgcatatgttgtcttctcaaattgttgtttgcctttgacattgcaagaactttagttgaagggtacgtctctaaatttttactaaggatatcttcctaaaaatttcttagtttttatttctttctttttctccctcctttcatccctccctcattttcctcttctttccctcccagcccaatttcttaaaaaaggatttgagagcctgacgatgatttatcattgaacaataatcaattcagtgggtggatgttaagtgcttttaatatatatgaccctggttcatttattttgaaggccatgtttttggtatactgtgcactggagaaagaacctgtgccaatgtccttgcctccagccttggtgccaccatctaagagaaaaacggtcagtatatcaggctctgtgcggttgatcccctcttcagcatcagccaaggaatcttaccactccttaccatctgtaggcattttacctaccaaagcaccattaagacaggtatagatttatcagtgttaaaggatttttttttaacaaagtacatggcatttaacagtttactatttgacaaagatagagcaattaaaaggataaaaattttagagcaccatctcgttgaacctgcataatgtgatactccagagaagacagatattccttctacattaggccttgggtcatatggatgttttattggttttattttgatctccctggaattaaagttagaaatggaagatgctccatgctaacatggcatgtttgccctggcataattaatagttgtttttatttttgtttaatacctagttaactcttgattctttgggatcaaattattgaattctgggttgtccaaggcttttttttttctgcccccagcctgcctcttgtcagattgagtaaaggaagataatgacaggatatgcaaatcagccagtttggctatggttaacactgctgggtcaaactataaaaaataaagattgagaattatctgagtattttgtttatacagactttcagttacctatattaatgtgggcattagtcaagagttaactatgtttgaatttactcatttcttaaaaaaaagtaaaaatgtgcacctatggataagtcctaactgacctgtattttcttctgttattttctcttccccacagcattttgattgagatgtcatatggaagtgatacattgttgctctgagttagtagggtagaattgttcagaatttgtgatggatattgtaatggattgaaagagtgacacttcaaagtttgtttcattttggcagaaatactgttttttttcctccctgtagtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtaagactttatttgaattgattttttaaaaatatggttttgtatcaattccagtttctgcattttgatttttagtcatttgtaaataggacagtttttgtttcagaattttttatagagaaaatcagaatctgaagaattcttctggctaatggacaaaagcttgagaatgggttacctgaagctttataagattgacagcatccgctgggcatggtggctcacgcctgtaatcccagcactttgggaggccgaggtgggtggatcacctgaggtcgggagtttgagaccagcttggccaacatggtgaaaagctgtctctactaaaaacacaaaaaattagccagacatggtggtgtgcgcctgtagttccagctactcgggagggtgaggcaggagaattgcttgaacctgggaggtggaggttgcagtgagctgagatcacgccattgcactccagcctgggcaacaagaatgaaactccatctcaaaaaaaaaaaaaaaaagaatgacagtgtcagttaattgttattagaatgttaaaatccagcttctgtttatatcaattaaacttaaaattttcagagagaatccagatatctgaaatttaaacaatgtaaaaaacagtatcttcaaggcatacctgcataattttatagtgtatatgtatactttcataccttcacataggaataacatacttggtccttgaaaaggcaaaccctagtgtctttaatgaatttcacagaaaatgagataatgtatatgaaaatgctttatagtttgtctgccgccaatccacctaacgataccagaggttatcttcaggttttcaagaggcagaaacgtcacaagtggggccacatggttgtaaagagaaacttagaaaagaagggaggcagacagtaagtagatctgccttaaaagaaacaagaacccaagactgggaaagattaaatatgcataactagtagtagctgccactattgagtgcctagggtaggcactatactcaataaatggcagttgtcacgggcttaatgttatgcctaagctttttatatatcctgtctttaattctcatagtaatttcgcaagatgggtgttatcatctccactttatagatgaggaaactaagatttggagaggttaaaaaacttagccaaggttataagaagaaataagtagaaaagctggaatttaagatctatgtgacatgtagtctttttacttatgtagtcttttcatcaggccctactggccttcagtgcattaaacagatcaggatttcagaaagctgagctttttttttttttaattacagaaaaagaaagtagagtaaaacctttgcagtttctcttcaagtgattgtgtaaagctttccagattgctgccttttcctcacatgtgatttccatttgcagctgtttattctgctttggcttggtgatccttgtatcctcctactccaagagttgcaggaggcatagcaatatcaaaattgtgcttgttttagaatccttctaatgccaccagtgaatcaaatttgttgagacttagattttatctttaatatcttttaatgttaaaaatgttgggtgtaaggaatgttaggattctttggcccaccacaacttttactgtatagtggttctgaaaattggtaagaaaacacaaagtgtaaacccagattagaggctcctgctcagcaccagggtgaacattctctttttaccatcttagctgatctacctcttcgaacagttgagtgagtttttaataacctgcaagttggtgtgactgtctttttaaattcacctcattattttaaaaaagctgcatagtggtactttttctctggactttttgcagttgtggcacttacataccattcattttgtttatttgtgcaggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaaggtaagaaagcttaaaaggaaacctgaatgtattaatttcaaaggaacaatactatgtcgaattacagattcaatttggatgaaatagaagagaaaatgtatctggctaagagcagaacagtatactgtttgtggtttagtttgtgcctataaatatgctggagtgccttgtataacatccttggccagtagcttgtttaccccattcattaaacatgacaactatatttccagtcttaaaattggaaaatgtgggcttatttttcctttcctggatttgtgaattaagttttatgaatagattataaaaggaaagctataaaaattaaattattgtgtttcacttgatgattcactcttacataaaatgatacagatttgaaaacagaatcttgcatatgatggttgcttggtgtcaattttacatcaaaaaagcctccaaggaaaacattatgttgaggatgtatctgtgcggtttttgctgtaggtgaccttttgttcctgagtataccactgaacttcatatttgaacagctagaagtgggttttacctagttttggtttctggacagcagtgagaattttcaaaacttcattgttttagtcatgccttgatttttctctcctcatgtagaaacccttcctagtatgatgcatttgcaatatcttggcctttaatagacctttgaaaggacttgcataccatagtggctatttgcctttaaaaataaatactttgtatttttaaatctcttatggcctataaagtataaccatggctgtggagatttttcagggttgttatacagtaataagagttgtcaaatgtgtggtatgaggagagctctttaaaatatcatagaatattttgggttttgcattaattttgtcacatggttcttaaaaatcccattttaaaaagattaataaaaaccaaattgggaccaagcacagtggctcacacctgtaaacccagtattttgtgagtccgaggtgggaggatcacttgaggccaggagttcctgggcaacatagcaagaccctgtctctacaaaacaaaaacaaaaaaattagccaggtgcgttggcgtgtacctgtagttctagctactcgggaggctgaggcaggaggatcacttgaacccaggagtttgaggttgcagtgagctaagtaagatccaactgctacactccagccggggcaacagagcaagaccctgtctcttaaaaaaagaaagaaagaaagaaagaaaattggatttttttggtaagctaaatggaatttatagctaccaggtatggagagttacttatagaagtttttgtccttatttgtaataaaataaatattttattatctgctttgtgagttatggggggggcctttttgtgaattttttgattccttatgatgtatgacatgagtcccttaagttgtggaaaaggctgaaagtgatgccacccagaaggataaaggttactgaatatgcatttttgctctttgctatataactgtacctcagttatggaatactgtgttgtttcatgctttctttcacctatgcagactgctttttttttttctgccttcttcattttataacctattcaattgcctaccaacacaaattttagatatgacagaaatttctgaagcaaattaaaagtttgaagtctatgttagtagatgcttgaagttgcatgaggtatagtttttaatttagtagatttgtctgaagttcattcactagatcatagatacgtttgtctatttatgtcagataccagtattattcattgaaatgggaatttatcactgctatcttatctattaacccaaaattttaactttaaaaatgaaaacttgcattgttttatctttcaaataacctcttttctctttaatctggtttttttagtactgcattttttgcagctttgactaatccttttttgaatgttgctttcctttctgtgttttttctagtttggactattttttccattctgcagcactctgcttttcgcctttcttgtactgtcagtttcttaactctactctctctcaaggttagagctttactttatgccttttttagctttgtggtttttggtttacaagatacattttgaaatgagaggttttttattcagcaaaaaaaagaaaattcctaaacagcatgcttttgtcacatgtcacttggtccttgtgtgcattttagtctgccttccctaggctctctgatccacttaacatcaccaaagtagaatttttgtgtaatgcacaagaatagggtaagagaaaacattttgaaagaaggggacatgctacatattttttctcatatacccttcaaatgctacataaaatattaactaaacttttttcagtatctggggtgtcactttctaacttgtttgaggttaaactaatttgtctcactttgtcttcttatttgatgatatttttacaggcaagactataaaatgtgagtcacctttttttgagttagagtgacagaggagatgtggtagtcacaagttctttggtacatttgcacctctgatagcaaatttctgatagcatttaagtgaagtaatttactcttgctgataaaagtgagaccaagtgctaatgtttcattttgtttagctgtctggccaggcctagctcataggtcaagtttagatagagttaaaatactagtgaataattgtcacattcagaaatccactttaaaatatctaatttaatttaacactgataagtttttgtgtatcagtggaacacagaaaataggaggtatatttcatacaaagctgtaattaatataaaattgagattagtattaaacctttgtagatgagttttggtactgatagtcaaaacagctcagtactaaaactgcagtgtggcataaagaaatacagaaggaattacttgccaaattttattgatgtacctgttttatcaaatttacttttagagtaataatttcatttaccgaaatgatcttgatatgcaagtgccactgggggcattgcgtgaaatagcacttaaatcggaagactcttgattaaactacgtattggctgggttcaactttgagcaagttatttaatctgtttcttcagttctaagatggggttaataacaatatctgccctacctactacccacttttcagattagttttgagaattaactagtggaatttaaagtgcttagtgaattgtaaatgagtatataaatatgaggagatgggatattgtgtgcttttaggtttcttctgttgtgcaagttgttgacgtaaattaactatacaacaacataagtattaacacaaagtcttatgttctgttatataaagtcagcagtatatcttagtttttaaatgttcaggcctcagttttaacatttccagatggtaattatcctgttatttgttaatctggttgtagcattgggtgtagatgaaatgtttgaggaagcatttatcttttcgctctgacttcagctagctatctggggcatcagtgatagtttacagaggacattgagccaaggtagaaacaactcaatgggaggccacatcttttaagagcatattctgttgaagagttaattataacaatagcttacatttataaaatatcacagtttgtagactgatgtcacatcacattatttcatttaacttgtaaagtgggcaaggcagagattatttccctattttacaggtgatgataatgcagttagtaaaatagcaggacccagaataaacccagctagattttctgaatacaaggaccattcagagaccaattttgtaaccttcattgttgaaagaaaactgtatggacaggatgtcatatatgaagacagtttcatatatgatggtattaatatttattatggaacatgcttgagcagttggttttactttaaataaaatagacacagtatgtaacaaaagtaaaaattccttgaattaaataaaatcaaccactactgtaggtctgagattcaacaaaaatttgtgtgtttactctcagccagtttatacaaatacaaataaatcaccatcagtttctctgagaaatttacacttcagtggaggaattagtttatgaatctggcatctcttttactgcaaggttctgaacaggctaggatcaagtgacaaagacattcggatcggaggtggggatggggtacatagtatagaataacagttttcggagaatttaagggaaatgtaaatgtcttactatataattaagtataaaattatatataattgtactagatatgattttcttaattaaaaatctcagtaatacagtaaaatatgcaataccttatatctgcgtagagctttaatatttttagtgttttgtcttatattacctaattttatagtaatgtataattgtgaactttttgtttttagaacatcataggatcaagtcctgttgcagatttctctgctattaaggaactagatactcttaacaatgaaatagttgacctacagaggtatgtaaagcaaaattacagcctactcacatacacacacacacacacacacacacacacacacacacagtacatgtatatatgtatacaacttcctccccacacacacctttctgtttctaatgtatattttgataaatgctacctaatatttggttaagtaccacagttctgtttaaacggagtcagtgtacttcatcatatatgaggcaacctttaattgcaggatacactgtttacttatgtaccactgaaaagtcactgccaaataaacaatgacgtgccattaactataaggtactgtttgatttcatttagagaaaaatgcgaaaaaacgtatatcctagaatgactgaaaaatagtttttctccaaccttagatatttgaataacatattagaaaaacattatcatttaatacatttaatagatggaatgttaaattcagacaccatgccaagagctttcataattgttacttgaccctcacacaaaccttgtaatttgagataggtggtggtgtttctgttttacaggtaagaaacttaagatgcttagatattttgcccaaaatgatacaagcttgtcagctgcagagctgatacctgatcccaggactactttattctaagttgaatcttctttcttatacataggtactatgtagaacagactcaaatacaatttgatttgaatctgagtatagcagatattattggtacttccttaatttccgtgttccctggaaactttatagtaatactgattgtaaaaatgactataaaattactttttaaaagtgagataatttttctgtctacagggcactgtatctaaatattcacaccagtctttttctttttttaaccctcacaacactttgaagcagataatggctgatatactttattttactgacagtattgagatataaggagattaaatgagttaactgccttatatggcaataatttggcaatgatcttaaccttatctgtgagactatgttgagatttctgtagaaaaactggttgttagaatttttcagttgtaagaaagaactaaacccaaactaagagtgaaatttattgacttgtgaaactgaaacctttcagaggtagggctggcttaaagcattccttgatattgaggctcagatgatataatcagttctcttgctctccatttcttgtttccatttccactgggttgattccattctcagatagactttctccttattttggcaagagggctatagtacatctagctacatgtacttataatttcaaatttggtgaagagtgcctctcttctggcatttcctggaaaagacctgaaattcagtctgattggattggcttattggccttttcctatgacataaaacttctaatattgaaatctgaccagggcaaaaaacacttcgtggtgattgtatagtttaattttgtccttactcacggaaaaaaaaaaatcaaatccaaagtcacacatcacgttaagagacagtattggtatcaaaaccaggttgtataagttcagcattctttctgttatacaattctgccactcattaggatttttaaatttttgactttgttgcaaaatagaagtagtaaacaattactgaacctataatggtgtttatactgttcattttcatgtggtccataaatggtccataaacatttttgctttccttatatatgtaatatacatgttatagtaggtagatttgaaaatacttatcatctgggcctcttaagcctatgaaaatggatacatacaccaatgttctaggacttgcttgatttgacttcaagtgtacttgtttaatgtataaaatatttctataatgaattttaatgggaattagagcatcatagaaaaaatgctcttactgttgaaaacattatttgttacattttggtcaactaatctttcaataacttttagtaactataatgttaagttgtaccagtggcagtcttatatagtaaatggcagctgacagcatgaaaataacatatctaatattttgtgactatcttattaggaaaatcagagaatttcaaaaccttgttagtttttagggtatagtcacattttataaatgtgcggtatatttatacatgatttgacgtttgtgaaaatattttccctggacttttattttagatgagatctacagtgtaggcaaacttatataatctgtcaactccattagtgtcatagtcagactcatccccatgctaaaattatagttgttaaaatacgcttttgtaaatagttgtgttaggtcattatcaccaagtcttcaaggtattacattataaaaaccttggtttttattcttgtgaataaccgttttttccatgcaaagttaaaattcttcagcctttaatttttttattaatatataaggatgtgatgagtatgactacaaaacaggaaaaaataaacagatttcgtttgtggcttttgctaaattgttacctgacaaaatcttagccagttcttcattttcgttttgagatgaagatacttagttttagtccaggggctgggcgcgatagctgatgcctgtaatcccagtactttgcggggccgaggcaggtggatcacttaaggtcaggagtttgagaccagcctgcccaacatggtgaaacgttgtctctactaaaaatacaaaaattagacaggcgtggtggcacacatctgtaattccagctactcaggaggctaacacaggaaaattccttgaacctgggaggcagaggttgcagtgagccattgcactccagcctgggcaacacagtgagactcttgtctcaaaaaaaaaaaaaaaaaattttttttttttagtccagggatcaaacctctaagtaagcagcatgtatgatgtgaaattgtaattactgtataatgaatgtagtactttataatacttttttcttaatgatagttataatacatattcattgtaaaattcaggaaatagataaatgcataatgaaaaaaggaatatatttcttagaatcatattttgttttgagcattgcaaaccaatggaaatattgaaagctatatataaacttgagttagttgggtgaagaatgttctttgttattggtcagaaaatgagatttcgttgtctttgttttcatctttagttcaccaaattgtttctagtagaaaatataagacattgggagcttgaagtgcgagatacctttaggtatattttaaaatttttttctgtgatttcttcaacatttgctattaattaaatgatttaattatgccaattagattaaattagtatgatatttttaacttaaggaaaagcaatacaggtagttgtaatataacactcatcgaatatctgaatctcttacttgagctcaagacctgtatttttcattgcctactagtgttttcatctgaacatctagtaggatatgaattccctaattgtcccctcacctctgttttgtatctcccttctcagtgacatcaccattcacccaatcactcaagctagaaacctgagatttttcttcttctcatctttagtcttctacctttgaaatgtctgttgaattgattccttaccttcccatctcttttgtctaatcaacttctcactcttcaaatctcatcttagacatcatttcctctgggagaggaagccttccttgatttacctcccaacctccatactctcttcaagtcttatttaagagcctattttatgtagtctttatatttacaactgttataacacttatcattctttgttataattctgtgttttttaatctcccactagattatgtgcttcttaaacacgggctgcttgtatccctagtgtttagctcataatagatgagaaaataattttttcaatattgttgaaatctgtcttctctgttttctatgtttccttcttagttttagcctttgtcttttatctggatcatggctgtaacctcctcattggctctctgctttgagccttttcctcctttggaccatcctacttccaactgatatataaaatacaactcagatccctcagtgacttcccatctccaactgaatccagttcacttctttgaacatggtgtaaaggctcttccttcatggtgttctcttggcattctgaccgttctgtcttagccacctctcacagtatgctgccctgtggtactaaaaagctatttgagaacagatacagtgtgtttgctctttgtactctgagtgttcagtacagtactcgaatctactatttcagctttgttccctttctccagtcgtatgatagatgggtttattacctcttacttcaacataccaccacttttattcttctatgcctctgatcctactgttcgcctttgcctggagcataccttttaccttataaagttttgttcatgttcaagacccgtcttaaatattgtctcttctgtcaagccttccatgaaatcttcagattacttttctttcctcttcttccagaggctttattcgtttattgtagtatttctactgtttaactatagtaatttatattgcttttttggtaaatttttaattcctaagggcaagagctatgtcttgttcattttgataggcctagaaattaacacacacattacttaacaccgaggaataggctagttggttgaatgaatgacgcaaagtatgttataaatattagaatatttccaagacttacttcctgcaaagtttatggcagaatagaagccatgtgttaaatgttgaactaaggcaaagaccttctgaataatagcttattttgaagactataggaaaggattttaggccggacacagtggctcacacctgtaatcccagcactttgggaggctgcagcgtgtggatcacctgaggtcaggagtttgagaccagcttggccaacatggcgaaacctcatctgtactaaaaatacaaaaattagccaggcgtggtggcgcatgcctataatcccagctactcaggaggctgagacacgagaatcgcttgaacctgggtggcagaagttgcagtgagccgagatcactcacagccgagatcactccagcttaggcaacagagtgagactcagtctcaaaaaaagaaaaaagaaaaaagaaaaagaaaaggattttatatataaaaggtttttgaatcctcacaggaacattaaggttagtgggctgatttttttttttaaatattctgcagacttagtttttcttttttttcacatgtttaaaaattgtgataaaatacacataacatagtaatttatcatcttaaccatttttaaacatacaattcagtggtatgaaatatattcacatggccaggcacagtggctcatgcctgtaatcccagcactttgggaggctgagatgggtgaatcacctcaggtcaggagttcgagaccagcctgcccaacatgatgaaactccgtctctactaaaaatacaaaaattagctgggcatggtggcaggtgcctggaatcccagttactcaggaggctgaggcagcagaatcgcttgaacccgggaggtggaggttacggtgagccgagattacgccactgcactccagcctgggagacaagtgcgagactccgtctcaaaaaaagaaaaagaaatatattcacagtgttgtgcaaccatcatcaccattcatttccaagacttttcatcttacaaaactgaaaccccatacccattaaacaataactccccatactctactccctcccattttccccgcccttcctcatagcagccaccattctattatactttctatctctatgattttgactactgtaactatctcatataagcagaatcgtgagatatttgtctttttatgactatcttatttcactcagcataatatcctcagggttcttctgtgttgtggcatatgtcagaatttccttcctttttcaggctgaataataattccattgtacttacataccacatttgtttacctgttcatctattgatggacatttgggttgtttccacattttagctattatgaataacgctgctatgaacatgaacatacaaataccatttcaagaccctgctgtcagttctttggagtatatttgcaaaagtggaattgctgaatcatggtaattgcagacctgtttttgtgtcaaggatttcctttgaaaatctgatgaagactgttataccctgcccacagaaaaaaagaacatgtatatctgtgatactattttgtatttatttcaggagttcccagacacttaaaaactatctgtggacccattcttgagagctgttgctgtgacagtaaaatgcctcagttagagaagttcttggcagtggaaaagatgaaactactaagagagtgcttcagtcacttggataatgtggtagtggtaaattatgctgaggcaggagttaatattttgtcatctactagcttccatttccttcctgtctctgtccttttagcaagaacatcaggaagttaaagccacatcctgtcaggcctgtttgttatcctggtcttgggccagtaaacaggatagataattagaataatagttatcaggcattgtactgtgccttctttatgtaagttcacttgctgagctcttgtaacatccctgaagggtaataactttatttcagtttttcagatgaagaaatgaactagtcttcatttccacgaagttttccctgattatctacctcagctcagagagcactcaatttccttctctcccagtagattctcgactctgtgtgatggcacaggccaactcttacttctaatgaggcaatatagtgtagtatttcagagcatgggctttttaaccagatttccagattgcctgacatgacctggatatacttaactatctgtacctcagtttatttatctgtaaaatggaaatatgaataaccatgtacaatgcttaacgcaatgcttggaacatagtaagttctcaatacatgttagtatttatcatcatcatccccaacaccgagttcagcacttagagtacaggatttactcaatagctgttcactaaatattggttggagtagctgaatgaactttctttctctagttgaagagtgaatggaactatgtagccaggtagccagattctgtgttcctaaatatatagacctctacttcagtcatattcaagaaccgattttttaaaatttctaaatcctagcatatggttcaaatttttaaaaattctatgtttttgttttagttcagttcaaatatcattagaaaccattatgtctggagagttcattgcttatattatcaaatctggagctcttttgcttatgatccaacttgatgtgtttgtgaccctctaaagatctgtgacactgacactaaaaggtctcttttgtgactctgccttaagaatggtattactggttaaataattgaagctctaggttgcggtgtgcatttctttgatagtaaggaggcagcctaattcattttcacataaagtgtatagatcatcattaaaacctctgttttgggagactctccttacttgaaaacctccttgctaaagtctgaacctgtgctgtccagtatagtagccactagctgtgtggtgattgagcacttgaaatatggctagtccaatttaagatgtgttgttagtataaaatatactggatttcaaagatttagaatgaaaaaaaaatgtaaaatatcttagtatttttcatctttattacattttgaaatattacattaaaataaatttcactcatttctttttattttttaatgtgtgcctgttagatcatttaaaaattacttaggctgggcatggtggctcacatctgtaatcccaggactttgggaggccaaggcaagagaattgctgaggccaggagttgagatcaccctgggcaacaaagcaagtctctattaaatatatacatacatacatacatacatacatacatacatacatacatacatacatacataatctatgtggcttctttgtacctgttctgagttagaattattatacatttcatttgcttgtactgttttgtggctctggtagcttactaagggacacttacctcttttaatacagcaataattattgagatgtattatagtctgtctttggaaagcaaaagcatctaccaagaaatttcaactcctggaggatttaagagtcacagtctctgccgacatactggaggcctgattgccatcactccaggtgctttattacagctttcaaaaagccagtaaatgtatttttatactagtaaacaatgtaatggtaataataataatagctgaaatttatttagcacttaactacatgccaggcattgctctggagtctttctagatgtaacataaattaatcctgcccatcaactttattatccctattttgtaattcagaaagttaaggtttcgttttatatttcttttctgttagtttcttttaatctcattttgtcctgccagataagtagaataaattattatggatttgcaaaataaatttatatttctggccaggcgcggtaactcacgcctgtaatcccagcactttgggaggccgaggtgggaggatcacctgagggtcaggagtttgaaaccagcctggccaataaggtgaaaccccgtctctagtaaaaatacaaaaattagtcgggcgtggtggtgcacacctgtaatcccagcttctctgaaggccgagacaggagaactgcttgaacccgggaggcagaggttgtagtgagccaagattgccccactgcattctcgcctgggtgacagagtgagactctgtctccaaaaaaaaaaagaaaagaaattatttcacctttgtaaaatgaaccatctgattttgggacctgccactaagggggtgtgctttgtcatataagccacaccccaaagtttgtattttttctgattctacttaggctctcttttcagttacttacacccataaatatattctcttatttttaaaaataaaacccattaaaaacagccagtctctcagaactaagtaagaacattagttattcccatagtaccatcatactttcacagaatttatctttaatttttataattaatggctactaattttccccagcaaactataaatagaggcccaactacaatcttgtttggaatatagtagacatttaataaatatttgttgaaagaatgaaattgtatcacataaagattatataattaaggcaagttttatttttgtgtgtgtgtgtgtgtgtgtgtgtgtgtgtgtgtgtgtgtgtgtgtatgtaagtaatgtatttttcagatagggtcaggctctgctgcccaggctggagagcagtggcgtgatcatgggtcactttagccttgacctcccaggcttaagcagtcctcccaccttagcctcctgagtagctgggactacaggcatgtgccatcatgcccagctaattaaaaaaaaaaattttatagagatgtgggtgtcactatgttgcccagcatggtctcaaactcttggctcaagtggtcctcccacttcagcctcccaaagtgttcagattacagttgtgaaccactgtgcctggcaaaggaacttttaatttaaaacttatggtaagaataaatgtctttgttctcaaactttaacctaagcttttgtgaactacgaattcttgatttttttttttttttttgagacgaagtcttgctctgtcacccaggcaggagtgcagtgacacgatcttggctcactgcagcctccatctttcaggttcaagtgattctcctgcctcagcctctcaggtagctgggattaaggcatgcaccaccgcacccggctaatttttgtatttttagtagagatggggtttcagcgagttggccaggcttgtctcgaactcctgacctccagtgatctgcccacctcggcctcccaaagtgctgggattaaaaacatgagccactgcacccggccatgaactctgaattcttagaatgaaaggtcatgtaactttcaaattgtttaaattaaaaacgaagactttctcatcagctttctatagttattactgtaatctagctcaaggcttctgacagttcctaagataagcagagtcagggtgttttattgcctttctagcaattgtcatcagctttctgagcgataagagcctctgcttcctctcttcctccacaagccagacaggaaagaagagctgtgttgctaaataatgccattcggtgttcaaagaagcatgtctcagaaacctctaagggactcaccatttcctgtgtattgaaagtctgtcttggctgggcacgatggctcacacctgtaatcccagcactttgggaggctgaggtgggtggatcacctgaggtcaggagttcaagaccagcctgcccaataaggtgaaaccccatctctactaaaaatacaaaaattagccaggcgtggtggcggatgcctgtaatcccagctactcggaaggctgaggcaggagaatcacttgaatgcgggaggcagaggttgcagtgagccaagatcgcgccactgcactccaacctgggcttcaaagtgagacttcatctcaaaaaaaagaaaaaaaaaaaaaaaaccaacaacaacagtaaaaggctgtctttacctagtacagaagttctttataatctttttctgatttaccatttcagctttatttaaccacacatgaaccttccattctaggtaagttagtctgtctagaattttctcatctctctacttttttttcattaattttttattatcataaaatatacataacataaaatttactactttaaatttttaactacttaaagtgtacaattcagtgtcattaattgtacacttaaagtggttaaaattttaaagtggtaattttttttttttgagacagagtttcactcttttgttgtcaattttaaatgtacttaatgtcattaaatacattcacagtaattgtgtagttatcaccactatgaatctccagaactttatcatcccagactgaataatctaattggaattgatatcaacttacttcagtcccatacaaaactgtgctcctggccaggcgtggtggctcacgcctgtaatcccaggaatatggaagccaagatgggaggattgcttgaggtcagggcaacatagtgagaccttgtctctacagaaaataaaattagttggctgtggtggtgcatacctgtagacctagctacttgagaggctgaggcgggaggactgcctgaggccaggagttcgaggatgcagtgagctatgatcacaccaatgcactccagcctgggaaacagagacactctgtctttaaagacacaaataaaattctggtcctatacagctccattctctcctctgccttaccctcactttttttttttttttttttttttgagatggagtcttgctctgtcatctaagctggagtgcagcagtgcaatctcggctcactgcaacctctgcctcctgggttcaagtgattctcctgcctcagcctcccaagtagctgggattacaggcgcctgccaccacacccagctaatttttgtatttttagtggagacagggtttcactgtgttggccaggctggtctcgaactcctgacctcaggtgatccatccgcctcagcttcccaaagtgctgggattacaggagtgagccactgcacctggcccattctcaccctgttatgttattgatgtcacaaactgtatcagaactccccctgttatgttattgatgtcacaaactatatctttatacattgtgtatctactaacagattcataaattcttttttatgcatttgtctcttaaattctatagaaagtataaagtggagttgtaaacaaaaattacagtaatactggtttttacatttgtccatgtatttacctttactggagatctttttatcttcatatggctttcagttactgtctagcatcctttcattttaacctgaaggactccctttagcatttattgtagggtagatctagaagtaatgaactccctcagcctttgtttgtctgagaatattttaatttctccctcatgtttttgaagcacagttttgtcaggtatagaattctcagttgacaggttttttttttccttccagcactttaaatatatcatttcattgccttctgaccttcaagtttctgctgagaaatccattgataatcttattaaggattgattatatgtcacaaattgacaagttgcttttcttcttgcttgctattttaaagattattgcaacagtttgattataatgtgtctcagtgtgagtctttttgtgtttatcctacttggagttcattgagctttttagatctgtagatgcagatattttatcaaatttgagttttcttcttagtctgcttcttactgctgttttgccaacatcttctgtgctttcttacgtaagctctctctagtagaaataccattttcttacctgacatttactctttccttcaaggcttagctgaagtctctcacctccatcacacagtattctcagactggagtaatttatattgtaaatatgacattattatctgcacagctcactttgcaattaatcatcctgccttcagtgataccaaggaggccttttctgacctccttcagggagagtcaagttcccattctctgtgttccaatagcaccttacctgtcccacagtgcttacctgttgtagcacctagtacactgcattgtaattatctctttatattcttatccccaacccctcacaccaggtgtgtgttcacatacactgaattaagagcttcttaatgacaggtgcctatctcactggttttatgtacctcctaagtatagcatagtgacaagtatgtaataggattcagtatgtgttattgagtaagtagataagttgtatagtggtatattaggttttattgtgtattttccctatcgctcttcatagcaatcccatatatggtttgtaaagtagatattcattttatagctgcagaaactagagcttataaagagtttgttggtgtttaactttttatttagcatctactatgtaaactgggtatgctggcataagttatgtaatcctgtatgcagttgtgagatacaggttttattatccctctttgaagagaagaaaacggaggcttaaaaaagatgaaatgacctacctaactggagctggtttaggcaaaaagaatttgatgacccctatataattggaagagtaaaggtataagtgggcgggaaggagggttagaaagagaacaaataggatgtgtatatatatgtatgtatatatgtatatatatgtgtgtgtatatatgtgtatatatatatgtgtgtgtatatatatatatatagagagagagagagagagagagagacagatttattttaagaaatttttaagattgtgggagctggcaagtccgacatctctaggacaggctggcaggctggagacccagtgaagagtttatgttgcatctcaagtttaaaggcaatctgagatagaattccttattccttgggagacctcatcttttcttaatgccatcaagtgattggatgtggtctacctacattattgagggtaatctgctttactcaagcctaccgatttaaatgttaatctcacctaaaaaataccttcacagtaacatctagggtcgtgtttgtccaaatatctgggtactgtggcctagccaaatcagcccataaaattaagtatgacaggaggtgacaggagccagggcttgctacctagaatgctagctttttatcagttccaaataaaggcatcctagatgaagattctgactgctttggcattggtcacaggctcattcttgaattaatctctgtgattgtgtggtggggtactttggctaagcttcgaccaggagccaatttctggacagtcattgcccagagagatggcatcttctgtttgaactatatgagtagaaagacattagaagaggcggaaagagaagcaatctcctaaaaggactgctgaaccctagaaggagagagagtcggtcagaacaaatagcttacatcaccactacagtgatgtaaggtgacttgtgacagagtttgtatttagtatttagtaacctatttttctccaaatctgatggtttcaaaaccatataatgaatttctaaaagtagagagtagataggttattttgaatgatattgagataagattttgggggcagaaattttagtgtttacattatttattctgtaactatattagatcagtgttttctaaccttttttataacccataattccttttaacaaatttaaaaactacttcactgttgtttaaaattctaagtaatgttaatatttaggctcaatattaattacttgacatcttacatattttgccttgcaaatcctaagatgatagagatattaacatccacatatgaaaaataagactagggttctgaaaggttaagtgacctgatcagagtgagaaaaactatttctcagaagagctagatttttctctgtttgcttgtgagagagattgacagttaagctacttaatgataccatttttatggtgaaatgtactccaagagaatttttataaataagtttcaggattggaaaatacagctttgtgagttttcacaactttgtagtttctaatagtttctagtttttaatgttttctggttacgaaatagtggatgctgctgtttaggaaaaaagacataaaactgtgtttctgggaaggactttgaagatgattttatcttgtctttgataatattggaattgcatcaaaaactgagacagatggcttacaccctactgcctgtacatagagtctaggaaaatggaagtggattgcatagactcaaggtccctcagcctaactgtccttgtgaataacttgaccatttcatattagatttatgtatttatgaaccttaggcttctgaaagcctagcttgggatttgctttccttgatggttcaaattcaccgctccatggaatcagaactgtgagcctttggaataccagggaggtttattcttggcttgttctttatagctttggtacttgtggattcctcaggatgtgtaagcatcttaaaaatgaaaacctgaaagatagtctaaaatagaggatgagtaggatcatttcatttcccttttctggagattactaaggtgaaggtaatagcttttcctgtcatgacatccaagatgagtggtggtttgggcaaaatgctcacacacctttttttattttattttatttttttttgagacagagtctgactctgttgcccaggctggagtgcagtggcctgatagctgctcactgcagcttccgccttctgagttcaagtgatcctcctgcctcagcctcctcagtagctgggactacaggtgtgcgagaccacacccagctaatttttgtatttttagtagagacagggtttaccacattggccaggctggtctcgaactcctcacctcaagtgatccatccacctcggcctcccaaagtgctggaattacaggtgtgagccaccacacccagcctcacacacctatttttgaaataatgtcttatatctgtcttatctacctatattggtgggctccttgagaagttgcatataaatattacttcttattgtggcacagatccttaaagagaattgcttttaaattactagtgttaaaaataatgcttgtattgattatgtgtccatcaactgtagaaaaatatacatgttcaaaattagggagaatataagaaatatggtcaagtatcctaagtgcacacaaagatatgtttagatatttttatttgcctgaaatgagaagaatagttataaaggttaagaatcattgcaagacaacagaataacatttgagcatctctgaaactgtaaactaggtcaagaaaattacttgattttcagtctgatatacaggacaagttttcagtcataatttttttaatagaaagtgatataattgaacatttaattctttttaagttttctgtttagcaatatatgttatactacttggttgtgctaataaaaggaatattgtaagaccagaattttattagataaacatgaatcaaaagttaaatttaattgatcttcttactaagaggaattaatgcctaaagatctccatattttttttttagttgggaatggtcttcaggatatgattagagataacaccatcctttcctccccttcctcttcctcccccatagaccccaaattatgaagagaaatttgtagtcctcaagcttcctccattttacccaaacatagactgtgtttgctgtttagagctgagtcctttgtaatctgttttggattttcaccaagtgagcttccttcctttgctctcccatctttctgccttggctactttgagtcagctcactggcttcttgtagccctgttttcctgcatgcacacttgatctgagcagacactgtcagtgacagcagttagcagcagagcagaaagaattcagtacaaatgtgtgcactgctgatctgtgacactgtagtgttttctatttttgttattatctactttcagaaaccaggagctgagttgatactgaccttgtgtggaatgcctctgaggatttgggatggggggagggtgctagattttcatgtgacttatctctaacatgctgcagcaagactgaaaacattcatctgctcacataaggaggaaagaaaatttccaagattgagcttgcagaatttgttgggtattttcagaaatttttccccgtgtttttgtatttcttgaatttgcttaatttatataagggttggaggtgggggatggtctttgcatgataaataggttgaggtatggaaggatcgggctgcaacaatgattctcatggtaagggactgtttaaaatcacaacatcgcgacccacattgcgacccatctgacaaacggttagtgagctccttggccatctcaaatgtttaaaagtaacagtgtacaaatagctttatttgtatgctttcttccatagacatcttaagaacattgtgcctacgtatccaaaacagttgatttttgtctacatttaaaatctcacctcaagaaggtgagaaatataaatgaagcatgcagttgtcccttaagtatctgctttggtataattttctcactttcctttatgctggagctaaatggagcctgagcttacattttgggttatgtctgagatggaaactgaaatgtagtcttgaagctcgaaggagaaacttggctatactaatctggaggacttgttaaatgctgtcttcccttctccatgttgccgccttttacctttccctgcgaccccagaaatgtactgctgcagaattctttgagctttttctctcattttgtagaaaagaaagtgaagggaggtgtgtgtgtttgtgtgtgcgtgtgcacgcatgatttcagtacaactacaaatgggcagttaaattgttacatcaaaagtgacagctttattttgcaattctgaatctaaggttgcttgggattcgttcatagccactcaggcctgattaaagcatataagaatttaggtaacgatgtttcaaagtaaaagcggagcccagcatgtttgatttgaagagcagaagagataaatgctgctgtggttctttttttactttatatatactgtttgtatatttgatcaattggatttgatatatggtcctaaaatagctttttttgagatgtaatttttgatagagcaaattgcctgtgtattaataatctttcccattttctctgttgtttcattctaaaattgatgcacaccagtgatttaaggggaaattaacacttcagtaaatgtctttttccttagtattgttgactgtttttattagccattttcatttaatttgacagtggtacctaagggttaaccttacagagctgatgcaacccctccttttctttaccagcaattttcattggacactatttccatagcaacagtgacatcagtgaaacctgagtgtttcattgattatttttctcctcttccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttaaaaagcgattcaggattaggaggatggataaccataccagctgtagctgatgttctaaaatattcttgcattgtttgctggtcttctagggaaaagaataatgtggaacaggaccttaaggagaaggaagatactattaaacagaggacaagtgaggttcaggtaagtgaccataaaatttagtgttccactgctgatttaggactattcattttaaatttatatggttatttactatttgctggatgtagtattaggtcaagagaatgcctaatgtttatattatataaatgtttatcttttccaagatgattgttcttgcttggaattctggcctgcaaagattatactgcaatgagaaagcagtatttttcagcatagatttctagttttgaaagtattttttaaatggtacttacctgcatattatatcattaaaggggtaagtttgcatgacttacaatgttaatatttttgcaccagtaaaattagagtgagatcatcatctcatcatcatcatcatcatcatcatcaaaaaccagtatgctttttcatgcatgtgaggtttttgttagctaggagacctagtatgttaaaggactgtttctcataatacttgtagggtgggagatgatacagaacaatttaaagtagcattttatgagtagcttagtaaccagcatatcttaaactttggcataaagagctttagttcattttcattaggtgttgtgttaaattgtttcattttacaaagagaaaggatgacaaaaacctcagtttttgtttgggaaatgataaaaataagggagtagcagtgtttctaacgttagaaatagagaaaactgggcagtgcctcacttagagcagtaagcaatgcatgtggccatgttattggggtactgtttccttagtgctgcaccggcacatagaggagattggatatagaagcactggtagcagttgctagtaagaactcttggatgggcatttcttaatgtgttgcttgtatgttggattttcctgcttttcctaatagttttaagtagggaaaaactctaaattgtgttaggcccattgttttgttttgatgcaggacattcattagagattgtctgtctggtggactgtgctagggtggggagaatgatttactgaagaattgaggaagaagccagagagacttcttgttggaagttgattctctgattgggtgactacatttattatatttacttgaattttcctgaaggcagtgcaagttaagagatcatcatcaatataattctctctctggcagtgaggttaggtgggcataagagggtaagttatctgaattacattattttgtgcagtttttgagcttcttaggaaatgcaaaagagccacacattctaagcagttattactaaaaatagtttaaaatggaagataaaataatctacacaagttttcataatttgaagaaataggtgtagctactgatacaattttggacagcttctaaatttagccagttactgctttaaagtacataggttcttgtgatagacagtattttgttgagtatatctacctgttggtttttccctgctgcattttttgaggatgtgaatttaaatacccagtttagaagagtgctgaaatttacattgtttccttcagtttaaataggctatccctgaacatttggtgtcttataattatagaagttttgttgtccatcagaatttctccgtgatttgcttgcccttcttacttagtggcaatggtaaggtgtatgtctaaccttaagctttgcaaaatccaaaatgtgtgattggcacaggaagtcgaaatggttcaatttttccacatagagtgctctaagtataagtaaggcatcttgggccatggtaagtaaagaccaagtaataatcaatgaaaaaaatagtggattaattaaagatttgggttagtagattcattatttattcattatacactacagttatctatgttacgcatggtaatgaggtactagactaagaatgatgtggatagttgacatctaccagtaattaaaactcttatattagtgatcattttcaattttctgaagcaaaacttaccataggtggtaataagtatatttcattacctattttgaggtaactctgatttacccattggtactgagatgtagactggaaataatatggataattaaagtctgtaaataactccaactctcaatacttactttctaatttccctggcaaaaggcaactcactggagctattaataaatggcagaatcaaagagagtgtatttcactgcttctttctgatctactttctaatggtgatgctaatgagaaatgtcaaaatgaagacattggggaggagaagtaagggaattttgacctatcagtacctgccgcacttggctttttgagtgttcttgcttttctccatattaataaagtcacagtgataatatgagctcatatctcaaacacagaaatcaaacttttaaagccaaaagctttaattttttttttgttttgtgtttatgtagtctgtctaattcagttagagtagaaagtctgctatgtaattaatttctgaatttttgtttcctgtctgtatttctgttaattactgccttgaaaactttctgtttaggattttttcttgaagatgacttcacattttatttcatgagatgatcactgttagcttgtatgagatatataccagtggatcaagttctgtggacaaattaggcccaaagtgatccaattccaagggggaaatgttgtgaaaagccattttatctaaaatgtctaaggtttgggtgtgtattttttgttttgtttttcataaggggagaaagtaggctcacattcttcctaccttaaagaattgcctatgtatgatcttattaaaaatttttttcttctgagtagtcaacagatattttagaaattcactctcatatgcctggtttcttcagttttgagtagaactttatagcaacaatttgatgtcaaacaaacttgaattcagttcctagctctgccacttcctaggtttgtgatcttaagtaatttaaccattctatactttagtttcctcttctgtaacatgggataataaaaataacaaacacttaagagctgatgtaagaataaaatgagataatgcagtaaagtgcctcacagagtgattggcacttggtaagtgttcagtaaatgttcttactagctgtattattccgcaccctacaatcatctctttattatcttctcttcacctttaagctctttcttctctttcttcacataggcctcttggacataggactcttcaatttgaaaataccccttccttggctattgctgccactttaactaccaacttattttgctctacttttattgctttgtgtggccattttcccccccttcctatctttgtagcaaccctgtacagtctgctgcttgcccataccacactgtgcattttctccccagggccaagaataatcttaaggccaaatctgttcgtccttcttgtattaggtactcctttcttgggttgtattctcctggatatcttcctacctctctgaacctttgcttccattgactttgccaaggacagatggacagacagattgtgtgtgtgtttatgtgtgtcctttctttccttctccataacccctgtcatccatatgctgataacacccaaatgtttatcaagctctcaactctcctgagtgccagtcccacatctccagttaaccattttggtgtttatcatttgaaaatccgtgtgtctaaaatgaatcttattgaaaaaacttggcttctggtttgaactttcctatttttctttctcactactgccacctgtatcgcctaatatctaaaatcttaaagtcatatcagaagtactcactccattcgctcttgcctttcctcctaaaccaatttagtatcatgactctcagatgtgggaatctttactgttgctcactgccaccattaatgatgggagggtgtcatacctcaggttattggagacagagaaaaagatgaaatacaaaccctcctcttttttgactgtctgactctgtactctgtgccatatatattctccttcttattcccacttttataacttttgttgttatagtccagaatgttctctactttcctgcttatgtgaattccactcatgccttaaagcctagctcatatcccaccgcttgtcttaaactttcccttctctgtctcttggtccacaccagtctttcctgtgttggaactcccagaggaaggaatacgtatccacttatatatggcatgaaccatatgttacctggtagtgttagcttggtgtgatgtgtatagcttccaatatcttccttcctatatattgtgagttccttgggcttagaaattgtgccttggatcatatttttcattatatttggcaatatattgttagatggaggtaaatttaaggaagctgttcacagcagaagtgaataaactttggttttgtgtatacaatttaaaataagacaatataactggaacccataggtagaaaagattgagagcatagtagttatcatgaaaagtcagacttcttgatattgttcatattaccctcatgtaaaagaagctccctattatttatgtttcatcataagattcagtaattcagagtacttgtccatgttttttattttaattcacttagtttttttcttagatgaagagggatgacttatcttagatagaaataaaattagatacatgagctcagcattctttttctggccataatgctctttagaacatactgggaagcatatgattgagaaataaaggcagtctgttaatggggttttctaacacccaccctagtttattaggcttcctttctgttcattgacttaaacatcttgttctatagttgatacatttttaatgttaagaatagtcctaaaacttccatcagataaaacagtgtatctgattatttctaattgtaggttagtttatagaggttttcttttaaaaataaataattatataattatgtataatatataaaatatattactgatattgatatgaactattaacatgatatgtttgcatctgtttcatataaaatacagagttaaaaggtttaacttttcagataacttttaaagtaacttcatcagttgtacatctgacttgagttgctaaaatgaaagttttattttttcatatgtctaaaattcttaggtatttgtttaaattttatttccactaccccatagcacttcatgggggatagagggatagcagataatttgccattttcagtaacttcagtgatttctagaaaacaggacgttttccttgaaatttctttttaagtaaagccaagattgccagctcaaatatcctttaatttctagatgagtaacctcggatatggcttgctttgatatttttctaaaataaaccttggcactatattgctctagttttgttcacttcatccttgccatgcttcagctgctgctatcttcctttcttttgctgttgatggcactagtaggcaagtagaccatgatcaggggaataaagcagaactaggaaagcatctgcaaatgtcttctgtcattcactggagggaatggcatttgatagtgctgagtctgtgcacagacccaggaaaggatgttcccaagggccacgtttaggaaagagaaaattacccaagttcagcagaagacactgtttgttaggagaaccttccactgctctagttaagggcatggcgggggaggagagagcaggaagagagagagaggtacatctgttgccttaatttagtctcaggataagcaatctgtaccaaaataaagttgctaagtatatctagatgctgatattgatattgaaattgcattgtgatggtggtagccttacaaataattttccagtgaaatttgttattagcatgtatatttgcatgagttcattttgattttgtgcagtttaataattttaattctgtatactggaaaggaaggcctttttgtatgtagtttagtgttggaatttttttttttttttttttttttttttttttttttgagacggagttttgctcttgttgcccaggctggagtgcaatggcacgatctcgactcactgcaacctctgcctcccaagtttaagtgattctcctgcctcagcctcccaagtagctgggattacaggcatccgccaccacgcctggctaattttttatttttagtagagacggggtttttccatgttggccaggctggtctcgaacttctgacctcaggtgatcttccagcctcagcctcccaaagtgctgagattacaggcgtgagccaccacgcctggcccagaatttttatagaccttttttcatatttagaaatagacatagagagacattaattataatgaattttaatatggacatcgttccagcttgaagtttctcattaatgttaggtatttcctcagtaacctttcctttaagtcctgtagttttgtattactatgtggatttttactgaagctaagaaatgaaaaagggcagtgagtctgggaaatttgaatgaatgtgtttgctctttgggagagaaagggcagaaagaagtaaatattatattggtttgtttatttgtcttcctcttacataagcctgtcttttgaggttgtgtttaagtggctcactaaaaatattatttatgaaaaatagttcagtttattaaaggaaaccagcattgattctattattggtagttcttacataaaaatttagtcacatcagaatatttttgtattggtatttttatattttatattggtagcaatgtgatacttaaaaaaaacagcaaacttgacattttctgattataaaagtaacatgggttcatggtaaatttgtaaaatgaagaaaagtatgaaaaagatgtaaaaagcctttctagagagagctattgttaacattttgctgtattttctacaaatatgtataaatttctttatattaatttgtgatcatactgtatatgcctctgtattcagcttttaaaacttagtatcatgtcctagacattttcttatattgtgtgacccttttaaggtaaattgtgttttttgtccctggatttacaataaaagacatcaaaattacatctggctttaaagatattattagagacatgaagtagataaagaatatttttctttggggtatgagggagggtggggaatatgactagagtatttactaatggggatagataacatatttttcctattcccactcttgaacatttttagttaaagggaaagagaaaaaacttttttccctctaggatttaaaacatgcttttgggaccagcatattgttatataaacctatataataattttatgaacaaagtaaggaattcaaaatagattatattttcttttttctttttttttttgagatggagtttcactcttgttgcccaggctggagtgcagtggcgccatcttggctcactgctgcaacttctgcctcctgggttcaagtgatcctcctgcctcagtctccctagtagcgggaattacaggcggccactaccacgcccagctgattttttgtatttttaatagagatggggttttactatgttggccaggctggtctcgaactcctgacctcaggtcatccacccgtctcagcctcccaaagtgctgggattacaggcatgagccactttgccggctcaatagattgtattttcaaactaacaaaattactttagatctgcaggtaacattcttttaaaatattttatagctgaactagaccaagcactgtggctcatgtttgtaatcccagcattttgggaggccgaggcgggcagatcatttgagcctaggagtttgagaccaccctgggcaacatggtaaaaccccatctctacaaaaaaatttaaaaattagccaggcgtggtggcacatgcctgtagcctcagctacttgggaggctgaggtgggaagattacttgagcccaggaggttgaagctacagtgagccgtgattataccactgcattctagcctgggtgacagagtaagatcctgtcttaaaaaaataaaggtatatgccacagtgacatgttaaagcagtaatgattatttccaaataatgaaagttttaaatgtcagatcagccttggtctatagattataaaaatactgaatcagtttagaaatgtaggtattattttaaaaagtttaaaaagcatttgtcataggtcagtttggggtattaataaatagctatagtttaaatacatagtgaagtgtttcacattatgtaaaaagaatgtaagtcttttctttctgtcagtctcatgcgtgtttcccattagtttttcccacatactaaaatcctatgatagttacagtaattgcttaattaagcccctggaatgtgctaggcattgtacaagattttggataatcaaagaaagatgaagcatggacactgtcctttagaagtttgtaatttagaggttagctatgattacagtgtattaagtatgacagtagaggttaggaacaaacagtagagtttgagcataggtgaaggaagcccaagatgagtcagacgagattaaatttggctggattctgaagaatcaatagtgggtttccaggtacatatggtgtggaaggacattgaagacagaggttatggcttgtggaaaggcatagggtcattgaaatatgttgtctattggagaaggaatagggtcttctgaggctgggacacaggtgaatatgagaggaaaagaaggtagaacccagaactgaaggttttaatgtgtcttgcagcaagttttacttaatcctctagataagagggaacaacacatattttaaaaataacagtgactagagaaatatcctttgcagtgagttattttttaagcaagttggacatttggaataggaagaaacaaagggagaaaacccagttgtatgtcaaggaaggaacgatgaaagctaaaataatttggtaaacagcttaaagagagattttaaggtagaatctataggacatgtatgaatggagaaaatcaaagatgaatctgaagttactagactgggtgatacagaaattgaagtcatttttctcttttggcatgggtttattcagagccaatgccatgtgcatatctaaagtcgtatctctatatggtatggattagttaacagtgtaggcaaggttaaaaatttagacatgaaaaaaattaggcatgctggtaaattaatgataaagtactaaaggagttcaccagtttgaaactgtgatcacacaaactcacggaatgttagcactggaaagtctttcatgatcatctattgtgttggcatttttaaaggaatttttaaaataaattatagtaaataattgataaacatttttgtcaaaggaatcagaaagagaacatctaattcttttttattattattatactttaagttctgggatacatgtgtggaacgtacaggtttgttacataggtatacatgtgccatggtggttggctgcacccatcaacccatcatctaggttttaagctctgcatgtattaggtatttgtcctaatgctctgcctccccttgtcccccacctcccgacaggccccggtgtgtgatgttcccctcccttgtgtccatgcgttctcattgttcagctcccacttatgagtgagaacatgtggtgtttggttttctgttcctgtggtagtttgctgagaatgatggtttccagcttcatccatgtccctgcaaaggacatgagctcattcttttttatggctgcatagtattccatgggatgtatgtgccacattttctttatctagtctatcgttggtgggcatttgcattggttccaagtctttgctattgtgaatagtgctgcaataaacatacgtgtgcatgtgtctttatagtggaatgatttataatcctttgggtatatacccagtaatgggattgctgggtcaaatggtatttctggttctagatccttgaggaatcgccagactgtcttccacaatggttgaactaatttacactcccactaacagtgtaaaagcgttcctgtttctccacatcctctccagcttctgttgtttcctgacgggttaatgagagaacatctgattcttaagaaacctaggcaaagcaaaactctatataatacaataaagaaaaattcaatttagaaggggcataagcatatttaactaagatttaaaatgtacttatttcctcatttaaaatttcttctccttcaatattataatttcaagtctcttaaaataaggactgaattaaaatacagaaattgtttttcttccagaaatcaagtgtccctgtatcttaaattctctgtacagttccatttatcagtcctttgtgcaagagttagcaattcatggcacaagggtcactttttgcctttctttgcagagttgatgatactcatcaaacattgtccgaattcctcaagtatcattgaggaattcaaaggctactgcctttgagtttccctttttgtctgcctgctctgcctgggctttaaaggaattttttaaagaaagcaacatgatatttttagactaaccagttggttaagaaaatataagataaaaagcaattattgaaagcattgttcagtgttctatttaatcacagaaacatctgcatatatttgaaaaatagtgacacatgtgagacatttagtctgcagatggtatgtcacatggtggttaagagctcaggctgtggagtcagaacccactttgaatccatagcttactatttttaactttggacacattacctacacatcagtacttcagttttctcatctgtaaaatatgaaatgatatcagtacctaactcgtagatctgtcatatagactataaataagttagtatatttaaagagcctagagcacaacctagcacattttaagtagcatttaaagtgttggctattatcataatggtgctatcttgtgtaacctatgcagtaattcagagaccttttacctgtaagtttctcttctgttcttagattcttattctggtgaatgactgttgggacctttgaatagatattatttttagaaatttgtgttcagttttacctcacccgctttgaaatctttgcctacctcctgctgacagatacttcggagttattaatccctgagccactgcgcctggctttttaaaaatttctgtagttcttgttattaagcatgaggtctggtatgtacatggatgaataaataacattttcaaaatggttctttttttgttttaagaaatcttttcctacactgagatctgcatttcttctacacattttaaagttagacttttacattcaggtccattatttacctggaattaatttttcttttttttttttttggagacagtgtctcactctgttgcccagtctgggcatgctgtggcatgatcacagctcactgcagccttgacctcctgggctcaagagatcctcccatctcagcctcccaagtaactgggaccacaggcacgtactaccacgtccagctaatttttttttttttgagatggagtttcactcttgttgcccaggctggagtgcaatgcatgatctcggctcgctgcaacctccacctcctgggttcaagcaattctcctgctttagcctcccgagtagctgggattacaggcatgcgccaccacgcccagctaaatttttttttttttttttgcatttttgttagagacagggtttctccatgtggggtttttttttgaccagagaatctgagaggggaaagattgagcttaaaacagatttgtggggaaattccaggagttctattttcaacatgttagcaaagcccatcacatgtccaaggacagatttgagttagcaaattgaatatctaaatatggattctaggaaagatgtcttcaagtaaagattgtatttaaagctgttaagtaccctagtctcatcaacacagtatactcagtaagactttattctttcttaaggtagatttaaaattactaacttaaccctcccctgcccgcaaagaaaataaatatattaattttcttggattttaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggtaatgtctggctgtttcctgctgcctgcacctatacattagttgcttttcctggcttaagatgaaaacattctctactttttgttattgatggtggtggttggcaatccagtcagcatttgggttcatgggggcgatggagcaaggttcatccagaaattacaggccttctttagaggaaatagaagggcagttaatgaactgtttttccaaatttttgttggaaatatggtgcctataccttcaactctcctctgtccctcccccagttacccttctttacgaaaaccatacatcaaaaaacatcataattggctgggcacagtggctcacacctgtaatcccaacactttgggagtctgaggcggggggaattgctggagcccaggagttggagaccagcctgggaaacatggagaaatcccatctctacaaaaaatatgaaagctggttgggtgcagtggctcacgcctttaatcccagcactttgggaggccgaggcaggcggatcacgaagtcaggagatcgagaccacggtgaaaccccgtctctactaaaaatacaaaaaattagccagggcggtggcgggtgcctgtagtcccagctactcggcaggctgagccaggagaatggtgtgaacccaggaggcggagcttgcagtgagctgagatcacgccactgcactccagcctgggcaacagagcgagactctgtctcaaaaaaaaaaaaaaaaaaaattgaaagccaggcgtggtggcccacatctgtaatcccacctactcgagaggctgaggtgagaggatcacctgagcctgggaaagttgagcctgaagtctgaagtgagctgtgatcgtgccattgcactccagcctgggtgacagagtgagactgtctcaaaaaaataaaacatcaacaacaacaacaacatcaaaaactccataatagggctaggtatggctgggcatgttcctatagtcccagctactcaggaggatcacttgagcccaggagtttgaatccagcctgggcaacatagcaagactctctctctcaaaaattaaattaaataaattatttgctattgctgtcaaaaaaaacaccaaaatagtaaactaaacaaataaatgtattgcattttggaacattttaatgacatctcttcttttaatccccatttcttctcattcactttcacattatagatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcagtaagtctttgtaaagcaagaaatatattcaaatggatcctctgtgtcctttagtcagttatactttccaacttctgctccttcaacctcttgcctagtttactgttcatttttcagtcattttatacaataggtttttttgtcacctgttatatattgaaactatcatacatcttgtatatctatctgatgattatcattggagtagtgattaagagtgtgggctttgtggctagatggtctaggtttaagtactggtgtgccacttactagctaaatcaccttagtatcagattcttcatcttcaaaattggaggattaataaataccctaccccttagggccactgtgaggattaatgaggcaaaacctgtaagacattttagcatggtgcttggtacataaatgctccataagtgttgcctgttttataaacaataacctagtttcttctgttttgtgattctaattttgaattcacatttgctaatttggaaacttttttcttaaggaaattgttccttctgtagataaatttgcagtgttatagttggtcttatgtatagatcctttgctttatttccaggtttccctacatgaagactaatgttttaatgaatgataagatagttagggctcggcatggtggtggcccatgcctgtaatcccagcactttgggaggctgaggcaatggatcacttgaggccgggagttcgagaccagccctgccaacatggccaaactctgtttctactaaaaggtacaaaaattaactgggcatggtggtacctgcctgtaattccagctacttgggaggctgaggcacgagaatcacttgagcctgggaggcagaggttgcagtgagctcagatcacaccactgcactccaccctgggcaacagagtgagaatctgtctcaaaaaataaaaactaaaaaaaaaaggatagaaacacagagatcatggagttgatttctttcattatgaatttgaacaaactaaagccaaggaagttcaagtaactttctcaaggttacatatccttgaaaagagctacatctaaaatccagttcttctaaaacccagtccagtgtgctcagttattacatataatgaagtccttcacttttgcgcttccttaccccctgttatctggcagctgagtacctacctactcattcgtcatgcaagatataccttaaattcttatttctttatggtattttctgcatcctgcttttgttggactttgtatttatgttacagcaataataagatttttccctgcatatttgcttatatgtctgtctcccctagcagagtcatggttttggtctgggaacttacacatttttaaaaatccgtatcatttagcacagttcttgtcccagtgtaggtactcaataaacaggtaacctgaaagagttgttgtagtgagaatgctaccagatgaatgggtattctttaaagtattttctttttttgaatctctttaaaaaaaaaatccatgtatactaaaatttcaagagagaaatacttattgtcagaaattactgaatcttttctctaagtcacgtagcattcccagaggattcttcttaaaggaagcaaatgtatcctagaccaagtctacaggtatagccatttttattttatttatttttttgagacagggtctcattctgtcactcgagtgcagtggtgtgatcatggctcactgcagccttgacctctgggctcaagtgatcctcccatctcagccttctgagtagctgggactacaggtgcactccatcatgcccagctaatttttatatttcttgtagaaatgaggtttcaccgtgttgctcaggctggtcttgaactcctgggctgaagcagtcctcctgcctcagtttcccaaagtgttgagattataggcatgagctaccacacctagcccgtcaggaagtggaggagggcgtttttatgttacatgtctttctagtaataaattctgttctatatttcttctttgtgttggcagatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagtgagtctaatactttcataaccttcataatcaacctccttgtgcagatccaagtttcactgacattatatctaatataaatacatggccttgcctcatctgaggacaattgagatttcctttttagaagcagagagtcctaatccaaacaattgtacgttttaactagtataaaaagataactttagctaatttttttttttttggagatggagttttgctcttgttgcccaggctggagtgcagtggtgcgatcttggcttactgcaacctccgtctcctgggttcaagcaattctcctgcctcagcctcctgagtagctgggattacagtcacgtgccaccacactcagctaattttttgtatttttagtagagatggggtttcatcatgttggccaggctggtttcgaactcctgacctcaagtgacccatctgcctcggcctcccaaagtgcagggattacaggcgtgagccaccacgcccagccagctaatttattttttgtagagcctgtttttaaaatggtggttctatagagtaaaactttttttttaagtaccctcaccaaaagctaaaattatttttattacgtagtgttaaggacattcatttaccaattatttgacgagtaccaactatgtgcaagagtgctgtattacataatataagagctacagagacaagagacctcagtctttccttcaagcagcctacagtgtagtagtgtaacactgtgttaaagggctgtgctaaaggaagcgcagaattttcagttaggacagtttggagggggttcataaagattttgttggggaaagctttgcgagtttagacaagtgagaagtggttaagcaaagaagaggaggatacattcctgccagagaaaacagtattagtataggtacaaggtggaagaatacatgcagcacagaatcttgagaagttctgaaggatatcttgtgatggtggagagggtattggtaagagatgaggcgcttctagtaggcatctgcattacctctggtgattgtcaaagtataaatgtgtatccctttccccaaacttgctgaactagtttctgggatagagccagatatgtatattttaaaaacacactctatgggtgattgtcatgtgcacctggataaaaatgaccaattttaggtcagaaagtgccagaagatgagaaatttagattcatcttaaagcattgggggatttatcctactgcaatgaacagccattgaagaattttaagcaagaagtgacgtgattaacttttagaaatgtggaaaacggattagagagtgagactgtacccgtagaagggataatgagaagaatagaagtttgagaggtattaaaagtgaaaagttaacagactcgattttatttacacagtgcagtcatgtatgcattataaaatattctttcaagcgcaaaaggcagattactaggttatcctgcaaatagataagggtggtataaagtagctattgccctgctacttttttttttttttttgagacggagtctcgctctgttgcccaggctggagtgcagtggcgcaatctcagctcactgcaacctctgcctcctgggttcaagctattctcctgcctcagcctcccgggtttaagctattctcctgcctcagcctcccgagtagctgggactacaggcgtgtgccaccacacctggctaattttttgcatttttagtagagacggggtttcaccgtgttagccaggaaggtctcgatctcctgaccttgtgatctgcctgcctcggcctcccaaagtgctgggattacaggtgtgagccactgcatccggcctgcccctactacttcttaagtctttcacccactcgtctaaatgaagaagacaatgggaagccattgaaggacttttaaccagaagggtcacgatcacatccacattttagagctattagtttggctacaataaggagaagagattggaaatacatgtattggaggcaggaaagcagttggaaggaagactgctatagtaattggaaccaaagatgatagtactataagtgattgatagtgacagtgaggatggagaagaaggcaaggatttgaaaaagaggtaagaggtagactgagcaagacttggagtcatattctgaggattaaagatgacctgaaggtttctgacatgagtgactttgatgcttgatgacaccatttccctaaaaaagattatagaaggagaagttatttgatgaatacattctgcttgtctttttttatttttaaatagtttttggttatctttagtcagttttctctgccatgtcaaaaagtatattgttaatctacttgcattaatattttgtaggcaagaagtagtcctgaactactgccttctggtgtgactgatgaaaatgaggtgactacagctgttactgaaaaagtttgttctgaactcgacaataatagacattcaaaagaggtaaaaaatgattttatatttacattggggacttgtaagggtggaaggacaggaggaggtgaattatcagacattacttaatgggtacaatatacattattcagatgatagatacatcaaaagccccgacttcacctttaggcaatatagccatgtaacaaaattccacttgtgccccttgaatttatacatataaaataaataaatgttcttaatagctggatgtggtggcaagtgcctgtagtcccagctactcaggaggtgaagtaggtggattgcttgagcctgagttggaggcactaggcaacatagagggacctaatctctaaaaattaaatgatattttaaaaaaatgtccttatcactgttttcctcagatgaattatacactattttaggtgaaggaaagagaaaaatatgttaaggtgaaggaaagagaaaaatgtgttaaaggtgctttatgactagagagatatttgttacattaccatcagttgattttccttttgttttcaagaccaagtctcactctgtcacccagccttgagtgcagtagtgtgatcttggctcactgcaacctccacctcccaggttcaagcaattctcctgcctcagcctcctgagtagctgcacatgcccagctaatttttgtgtttttggtagagacggggtttcaccattttggccaggatggtctctatctcttgaccttgtgatctgcccacgtcagcctcccaaagtgctgggattacaggtgtgagccaccgtgcctggcccatcagttgatttttcaaagcatgtgtatgacctgaatgtgtgttattttattttaaaatgttaccttttaaaactttggtttctaaaaaataattttaatttaaaattatttttaggaagatccatttaatgtagactcaagttcgctgacaggtccagttgcagatacaaacttggattttttccagtctgatccttttgttggcagtaagtactcttttttttatattatagatttacccaaaaaaaagactttttaatatataaactaaggattcaaggcttcagtttcaatagcctaccaactcagtctgtcgcccaggctggagtgcagtggcacgatctcggctcactgcaacctccgcctcctgggttcaagcgattctcctgtctcagcctcttgagtagctgagactacaggcgcccaccaccacacccagctaattttatgtatgtatgtatgtatgtatgtgtgtatttatttatttatgtaattaatttatttagaaatggagtctcgctctgtcgccaggctggagtgcagtggcacaatctcggctcactgcaacttctgcctcccggattcaagctaatctcctgcctcagcctcctgagtagttgggattgcaggtgcctgccaccacacccagctaacttttgtgtttttagtagaggcggggtttcaccatgttggccaggatggtctccatctcttgacctcgtgatccgcccacgttggcctcccaaagtgctgggattacaggcgtgagccaccgcgtctggcctaatttttgtatttttagtagagactgggtttcaccattttgaccaggctggtcttgaactcctgatgtaaggtgatccgcctgcctcggccttctaaagtgctgggattacaggtgtgagccactgcgcctggcctgctttgtattttcctactgactaatgttgaacatctttctagatgcttattagccatttgtgtatcttctttggaaaagtgtttattcaattttggtgaagtccagttatctattttttcttctgtcacttgtgcttttggtgtcatctaagaaactattacctaagtcgcaaagatttaatgctgtctttgtctaagagttttatagttttgctgttacagttagatctttgatccattttgagtttatttttgtatatgatgtgagatagaggtcgagcttcattcttttgcaagtggatatccagttgtcctaacaccatttgttgaaaagactgtcctttctccattttgtgttcttgatacgcttgtcaaaaatcaaatgaccataaaggtaaggatttatttctggactcttcaatcctgtaagaatttttttttttttgcttcagtaaagctcagtacctttatttctgaactggtgatgataataccctcccagtactcttgtggagagtagagattttgttagtaaaatttttgctgtaatgtcttcccctccatccgtaacctcaacttgtgatcaaggtaagtatagttggctgtatatttcataaggtcaatgacattccttattttatctactgtgaagtgaagttattgaaataaactttgctttgcttttgtttgaaagttactctttaagtagtggtgtcaccacagtaaatattgttatttggatttctttgtgtttattttatcacaggtgatcctttcaaggatgatccttttggaaaaatcggtcagtatcttattgagtttcatcttagctttcattcatttctgcttaataataagcttatgttatttaggtctgaaactgaagccccagtaagatgctctatgtgcctggcattttcagaaagagagtagtaaattcttttgattttgcttaatgaattgttgctttacttttacttcttctttttttttttttttttttttttggggttttttgtttttgagacagggtcttattctgtcacccaggctggaatgcagtggtgtgatcatggctcactgcagccttgacttcctgggctcaagcaatcctcctgcctcagcctcctgagtacctaggtctacaggctcatgccagcatacttgactgatttttttttattttttgtagagacagggtctcactgtgttgccgaggttggtctcgaactcctgggctcaagcagtcctcctgcctcagcctcccaaagtgctgcgattacagacaggtgtgagcgactgtgcccgatagctttacttttttaaaaatgacattagtgtttagactttggtgctttaaatatttattctgattcctccttactaactaaaggtttggtgagcataatgatctatactgcttcagggtttagaatgtaattttgttttcctaagattatagcccacacgtgtgattagaggcagagaatcttgaagaattactaaaacatcaggctttttgagatattctttttctgggaattttcattagaataatgcaaatcttgtttaccatttagttttgcatcccaaacctgttctaaactattggctgttagctttgagctcagagagaaaaatacatttagaagtttttattgtgttttctttagttacggtagcgtagaataaggggacttaaaattggatcccttgaaattatatgttaattttaaaaataagtttattaggtggaaggttctgtatcttttatcaaaattgcaaaggagtctgtgaaataaaaagtactcagcttagattctacagtatttcaaactgtctttttggattttttttttgagacagtcttgctctgttgcccaggctagagtacaagtagtgcggtcttgactcactgcaacctccgcctcccatgctcaagctattattctcatgcctcagcctcccgaatagccaggattacgggcgcgcaccaccacgcctggctaatttttgtatttttagtagagacagggtttcactgtgttagccaggccggtcttaaactcctgagctcaagtcatccgtctacctcaacctcccaaagtgctggaattacaggtgtgagccactgcacctggcccaaactgtctttttgtttgtttgtttttgagacagggtctcactgtcacccaggctggagtgcagtggcagatctttgctcactgcagcctctgcctcacaggttcaagtgagtctcccacctcagcctcccgagtagctgggactataggtgcgcaccaccatgcctggctaatttttgtgttttttagtagagaggaggttttgacatgttgggcaggctggtcttgaactcctgacctcaagtgatctgcctgtctcagcctcccaaagtggtgggaatgcagacgtgagccactgcacctggccccagactgtcttttaattaaggcactgatcataccttcaagtgatgggaaatttagtgcaataatttttttttgtctcttatattcgtgccttatttttttagatccatttggtggtgatcctttcaaaggttcagatccatttgcatcagactgtttcttcaggcaatctactgatccttttgccacttcaagcactgaccctttcagtgcagccaacaatagcagtattacatcggtaagtgggagaattaaaaactgttaagttaaatggataataagtgtcctaagcaagtttcttgaaatacatagtgatgaaagaaccctcatttagattacttctaatggaccatataagaatttcagtctcatcccaattcatttagtttttggttcagactggtatttcatagtttgattacccactggaattaactggaatgactgaacggagtccaaaagtgatgttcatctttcaagagactaaatcttatcctattgaggatactaaaaatgattggaaatttataagccaatcttacataaaacttttctgaaatgtttggtatattattgaaataatgaaaattaaaagaattttagaaaaataaaatcgtttatgttatttcatagacacatctggaatgttaattctgcaaagtacaaattctcactaaatgtcaagctctcttgagaatgtacatacctacagcaatcactgtttaataaccacatgcctgatccaggtactggtgtgtgctttacattcattgtttctaatcttcacatcaattttgcaaagtaggtgttgatatccctattttaaaaatgaggacactgggacttagaaaaattaacatgtttaaggtcctatagctagttgctgttttatctggaggctttaaaaaaatcttcatggctgggcgcggtggctcacgcctgtaatcccagcactttgggaggctgaggtgggcggatcacgaggtcaggagatcgagaccatcctggctaacacggtgaaaactcgtctctactaaaaatacaaaaaattagccaggcgcggtggtgggtgcctatagtcccagctactcaggaggctgaggcaggagaatggcgtgaacccgggaggcggagcttgcagtgagccgagatcgcgccactgcactccagcctgggtgacagagcgagactccgtctcaaaaaaaaaaaaaaaaatcttcatcttgtggatatttagaaatactcaaaggagaataatgtaatgaaatattttaacaagcttccatgcatccattacccaatttcaatagttaggaatggttttgcaggtttttggttttgctttttaatttgtattttgagacttcgtttttgagaccacagtttcatgtctgtaggtaaactgaacctataaaggaccagttaactgagaagcatttgaagcaaaaaatttgtcttctagtactattagattaagaatatttcctttaaaatgtaattgattattttaaagataataggttttgtattattgaaagttgcttcttttttgtattcagtaaagagctgcttggctaagaactggtgttttccattgaataaaaactggacagataccttcgtgactgaatatttttcgtttccctgggctgctggatactctgttttcctatagcacttagtttgcaatgtggacccatttgccaaattcttctaaaattgctgctactggaattcttctcctctcaccttcttattctagcctctcattctcctatcatctaaagagcaagaaagctaaattagctcttctaatttaaaaatgaatacattcctcttgtcctgtcccccatgagatttttctaccatttgttttactgacttttattcccagttttctaaaggaatattgtccttgctttacagcttgtaatttcaccattcaaaacaaaaaaccagattggcaatataataatagctgcagtttatctaatttcctctgtgtgccagggatggtgccaagctctttatatgcattgtctcatttacttttcacagtaatcctatgaggtttacgtaggttaagttgaggccaggtgtggtggctcccacctctaattccagcacttcaggaggccaaggcaggaggatcacttgaggcaagtagttcacaaccagcctgggcaacaaagtgagacactgtctctacaaaaaaattaaaatattagaggtgtaatagcatgcacctgtaatcccagctactcgagagactgaggtggtaggattgtgtgagctcaggaagtcaaggcagcagtgagccatgattgtaccacagcactccagcttgggtgacagagtgagatcttgtctcaatttaaaaaaaaaaaaagatagattaagttggtagtaagttagtaactggtagaacttgactcaagccaaaatctaagattttcaccaatacaatctggaaatttttaaaaaattgccctgctaaactccccaattatcaaactgacatagagttttgtggccccttattccttcatgggctgcacaatctatcctgttccccctgctatcctgatggccttttagggtggttgcacagtatatgatgaaggactagaaactaaacctgacacacatgtggttatgccctttccctttctccttgtgatggcaaatcaaatctgcaagctgttgtttaaaacacagcctgttagttttttcttctctcaaagagaagaagtaataatacaggttgagcaccccaaatccgaaatgtgccagtgagcatttcctgagtatcatgtcagcactcaaaaggtttcagactttggagcatttcacgttttcagattatggatgttcacttggtaagtataacacaaatattccaaaatctgaaaaaaaacccaacatccaaaatactttttgtcccaagcatttcagataaggatgctcagcctgtacttggtgacttgttatgtcagtgaccttctcttacactggagttatgactatcatattaggaaacatggaaagttatctcgctatatagaccagtttaagtttttctttaattgctgtttattctgcagatatctaagttagtgtgctagttgtataatagtataattggcctcagttaatactatcattactttttatcattcatagttttcatttctaaaaacttcattagtattaattctttctgctagtagttttaatggactctcttttataaagagagaaggttagtcccagttaacattacctttctctacaattaatttttttaacttggagatttatacattagctctggcagtattatttgacatttatttgtaatatccaacttcttgataattggaaatagagtctgtaatacaaatgacattgataatcatgcatcagagttgcatataaatgttcagaaactcttttcacactctttttacctgtttgccaagtctttcatctagccccttaaaaagagcctggtgccagaaagaggaaactcagttatcttcctagatatacaatttgtttgactatgattaaaaactaaagtataaagtaggaagacagttaaaagccagaatcgctggcatctggtaacatcctcacctttagcaagatcagttgctcttgatcccagacttttacatagcttattgttgaaagcaggatcttagcaaaaagctatctttgtgtatatgtgtgtgtgtgtgtgtatgtgtgtatgtgtgtatatgtgttttctctctgagggtcagaatgcagaatgatttttagataacaattagaaaatagaaatgtaacattttatgatattaagtactaggatatttgagaattaaaatagtgtgtgcattctaaacgtaaaatgatattctggaatcgaaaaaggacattaatggaaaaactggtgaaatctaataaaatctatggtttatagttttgtaccagtgttcttagttttaatagatgtactataattatgtgagatattaacattaggggaaactgggtgaaaagtgcatgggaactctgtactatctttacaactcttatgtaaatgtaaattattccaagataaaaggttagtggtggctgccacctaaaatcccagtgctttcagaggccaaggtgggaggatttcttgaggccaggatttgaggaaaacatagcaagaccctatctatacaaataataacaaaaattacccaggtatggtggcatacacctgcggtcccagctattcaggaggctaaggcaggagagaggcaggaggatcacttgagcccaggagtttgaggttacagtaagctgtgatcacaccactgcattccagctggggtgacagagcaagaccctgtctctaaaaaataagtaaaaagttaaaacagtgtacatctatacaactagcaagattatgaagaaaaaaataaacgaatatcaccaaagtcaggattgtgattatagagggacacatgaagacttctgaggtattggcagtttcctgggagatgactacacaagtgttcacttgatacttacttgttaaaccatagatctgtttcatgtacttttctgaatagatgttatatttcacagttaagattagaaaataatatgtattatttccagttagtaagattgcagatcactatggggaaacatttgttcctaatgtctatattccttaattaattaagaatttgtaaagaatatattctttggagtggtgatgaggtttcagctgtgaagtgttgcctctctcattcatggttttgtatgctttgtttaggtagaaacgttgaagcacaatgatccttttgctcctggtggaacagttgttgcagcaagcgattcaggtaaataaataatttatcaacttcattgaacattaaacattttttttaagattcttttttctttgtctctaaatatatttgtcctgttatttatagctttaaaattattgcataattatatccaatagtaatttaccaataataagcatttgtatatcactttctacttatctttcattctttcatttattattcatgttgaatattacactagaatatgaactctacccagtatcagtaaaccaataaaaatgttttgctttataaaatgctgtgttgcttggcagcttcaaagtcagcattgactgttacggatcttggtctaagttaaaagattagtggcttccagtagaaaatgaaaattgctttacaaatacaaatgggttctgttaataatacagagaaaagctaaatgttattttagcatccagtcttcatacttcatttatggtataaaattttttatttattcttttaataactttttaaatagtaatctcattttaaacataaactgaggaccagaatattaagcagtgttcatcaagatcgtacagtttaatagatttgaaccaggtaaagccaagattcaatattaggtctgacaaaaagctttttcaacaaagtaactctgcttcttttctactgttcatttaaaacaaaacagataaacagaccagctatcatttgggatgggagagcagaaaatttgaggaaagtaaactcaaatgtgtaaatactctaatattatgctgaaaatagatcgctttatttttctaggtgaatacagagtgagttgttcagtatacagatgtattaattgtgactaattaaggattatgaacatagaaaaagaatagtagaaatgcctttacaggagcctgggcccggtggctcacgcctgtaatcccagcattttgggaaaccaaggcaggtagatcacttgaggtcgagaccagcctggccaacatggtgaaaccccgtctccactaaaaatgcaaaaattagccaggtatggtggtgggtgcctataatcccagctacttgggaggctgaggcaggagaattgccagaaggcggaggttgcaatgagctgagattgtgccattgcacgccagcctgggcaacagagtgagactctgtctccaaaaaaaaggctggctctaaaaaacaggttgggtttcttataatgaacaaattgtaacaagatgagatttagcagagtgcattgttttcgggttggaaattaactcccaacatgagtagcaagagtgaggaatacaaaaaggagatatgtagaaaataagatttaatgtaggctggatattgatttaaatagaaacttagaatgagagcaagtgagacttctaaaaggcttattgtattaacagtggttaaattacatattttttaagtacatgtgctctttttataccctcattattaagctgattatattgctaggggtactatagaattaaaaaggataacctaagagaataaaatgaaaggttaatacgtttatgattgcccacaccaaggaaatggtaagtgccataagagttaattaaaccagcagagattaaaggaaggggagatcacgttaaggataaatcattaatgatatcaaagtggaatgtggcttttgtggtatgccttgaaagcatgggctagtattttagcaggtaaatatggaaagagattatgtggagcaaaaagaacaatgtgaacaaggaatggaggcagaacatatagggcatattcaaggaaaaactaacacatttttgcaagagctatttctcttttttttgcaagatagaggaatagtcaaggctgaagtggtaggttacagtgttacattaaagatttctaatacctctgttgatcttctgcttaaattccagttcctaattcatttcctgtaaagtggtagaataaatgatgataatagcctaggagggtgcaaagatttatcattaattgtaataataatggctactatttattgaacacttgcagagttccagcagtcaacatgctaatcatttttctctacttggtcccatttaattctcacaacaactacgttagattatttgtattatgtttattatacagacaaggaaaatccaggcatggagagatgaaacagttttcagaaggttaaagtagtagtattagatgtatccaattcaaatgaggtctctggttttccacctgcctctttggtcattctttctttaatctcctttgttgatatttcctctttttctcaacctcttaatattgtgttgtcccaagtcttagtccttggacctcttttcttttttatctgtactcccttgggggaactcatctgtggcttcaaatactactgatacactgatctatatctctagtcacatctctttcctgaaccccaggctcatttttccagctatttatttggcatctccacttgaatgtctgatagatatatctaatgcataagtctaacacaaagcagctatttttccttcctaaacctgcttttcttggcaccttcgacatcttcatggttcatctttaatgttgtccaggcctaaaatcttagaatcatccttggttcttcttttgctcttcctctgtctctaatctgtcaggaaatcttattgactctaccttcaaattatatccagtaaaagccttacagtggcctgcacttttctaacaatatctcatcattattcccattactcactctgctccagccacactggtcttcttgctgctgctcaaacaacagacccatgttctttggccctttgcactagctgttccctcttcctgggatgatccttctccgtatgttcacatgataatctctactacctctgacaaatcttttattttattttattttattttattttattttattttattaaagttttagggtacatgtgcacaatgtgcaggttagttacatatgtatacatgtgccatgctggtgtgctgcacccattaactcgtcatttagcattaggtatatctcctaatgctatccctcccccttccccccaacccacgaaaggccatggtgtgtgatgttccccttcctgtgtccatgtgttctcattgttcaattcccacctatgagtgagaacatgcggtgtttggttttttgtccttgtgatagtttactgagaatgatgatttccagtttcatccatgtccctacaaaggacatgaactcatcattttttatggctccatagtattccatggtgtatatgtgccacattttcttaatccagtctatcattgatggacatttgggttggttccaagtctttgctattgtgaatagtgctgcaataaatatacgtgtgcatgtgtctttatagcagcatgatttatagtcctttgggtatatacccagtaatgggatggctgggtcaaatggtatttctagttctagatccctgaggaattgccacactgaattccacatggttgaactagttgacagtcccaccaacagtgtaaaaatgttcctgtttctccatatcctctccagcacctgttgtttcctgactttttaatgattgccattctaactggtgtgagatggtatctcattgtggttttgatttgcatttctctgatggccagtgatgatgagcattttttcacgtgtctgttggctgcataaatgtcttctttggagaagtgtctgttcatatccttcatccactttttgatggggttgttttttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaatgagatcccatttgtcaattttggcttctgttgtcattgcttttggtgttttagacatgaagtccttgcccatgcctatgtcctgaatggtgatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtagatatgcggcgttatttctaagggctctgttctgttccattgatctatatctctgttttggtaccagtaccatgctgttttggttactgtagccttgtagtatagtttgaagtcaggtatttgatgctgccagctttgttcttttggcttaggattgacttggcgatgcaggctcttttttggttccatatgaattttaaagtagttttttccaattctgtgaagaaagtcattggtagcttgatggggatggcattgaatctataaattaccttgggcagtatggccattttcacgatattgattcttcctacccatgaacatggaatgttcttccatttgtttgtatcctcttttatttcattgagcagtggtttgtagttctccttgaagaggtccctcatgtcccttgtaagttggattcctaggtattttattctctttgaagcaattgtgaatgagagttcactcatgatttggctctctgtctgttattggtgtataagaatgcttgtgatttttatacattgattttgtatcctgagactttgctgaagttgcttatcagcttaaggagattttgggctgagacagtggggttttctagatatataatcatgtcatctgcaaacagggacaatttgatttcctcttttcctaattgaataccctttatttccttctcctgcctaatggccctggccagaacttccaacactgtgttgaataggagtggtgagagagggcatccctgtcttgtgccagttttcaaggggaatgcttgcagtttttgcccattcagtatgatattggctgtgggtttgtcatagatagctcttattattttgagatacgtcccatcaatacctaatttattgagaatttttagcatgaagggttgttgaattttgtcaaaggccttttctgcatctattgagataatcatgtggtttttgtctttggttctgtttatatgctggattacatttattgattggcatatattgaaccagccttgcatcccagggatgaagcccacttgatcatggtggataagctttttgatgtgctgctggattcggtttgccagtatttgattgaggatttttgcatcaatgttcatcaaggatattggtctaaaattctcttttttggttgcatctctgcctggctttggtatcaggatgatgctggcctcataaaatgagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagtctgttattggtctattcagagagtcaacttcttcctggtttagtcttgggagggtgtatgtgtcgaggaatttatccatttcttctagattttctagtttatttgcatagaggtgtttgtagtattctctgatggtagtttgtatttctgtgggatcggtggtgatatcccctttatcagtttttattgcgtctatttgattcttctctctttttttctttattagtcttgctagcggtctatcaatttcgttgatcctttcaaaaaaccagctcctggattcattaatattttgaagggcttttttgtctgtttccttcagttctgctctgattttagttatttcttgccttctgctagcttttgaatgtgtttgctcttgcttttctaattcttttaattgtgatgttagggtgtcaattttggatctttcctgctttgtcttgtgggcatttagtgctataaatttccctctacacactgctttgaatgtgtcccagagattctggtatgttgtgtctttgtgctcgttggtttcaaagaagatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagagctttacttccaactacatggtcaattttggaataggtgtggtgtggtgctgaaaataatgtatattctgttgatttgtggtggagagttctgtagatgtctattaggtctgcttggtgcagagctgagttcaattcctggatatcctttttaactttctgtctcattgatctgtctaatgttaacagtggggtgttaaagtctcccattattattgtgtgggagtctaagtctctttgtaggtctctaaggacttgctttatgaatctgggtgctcctgtattgggtgcatatatacttaggatagttagctcttcttgttgaattgatccctttaccattatgtaatggccttctttgtctcttttgatctttgttggtttaaagtctgttttatcagagactaagattgcaacccctgcctttttttgttttccatttgcttggtagatcttcctccatccttctattttgagcctatgtgtgtctctgcacgtgagatgggtttcctgaatacagcacactaatgggtcttgactctttatccaacttgccagtctgtgtcttttaattggagcatttagtccatttacatttaaagttaatattgttatgtgtgaatttgatcctgtcgttatgatgttagctggtgattttgctcattagttgatgcagtttcttcctagtctcgatggtctttacaatttggcatgattttgcagtggctggtactggttgttcctttccatgtttagtgcttccttcaggagctcttttagggcaggtctggtggtgacaaaatctctcagcatttgcttgtctgtaaagtattttatttctccttcacttatgaagcttagtttggctggatatgaaattctgggttgaaaattcttttctttaagaatgttgaacattggcccccactctcttctggcttgtggagtttctgccaagagatcccgctgttagtctgatggggcttcccctttgtgggtaacccgacctttctctctggctgcccttaaccttttttccttcatttcaactttggtgaatctgataattaagtgtcttggagttgctcttctcgaggagtatctttgtgtcgttctctgtatttcctgaatctgaatgttggcctgccttgctagattggggaagttctcctggataatatcctgcagagtgttttccaacttggttccattctccctgtcactttcaggtacaccaatcagatgtagatttggtcttttcacatagtcccatatttcttggaggctttgttcgtttctttttattcttttttctctaaacttcccttcttgcttcatttcattcatttcatcttccatcactgataccctttcttccagttgatcgcattggctgctgaggcttctgcattcttcacgtagttctcgacttttggtctttgatgatggtgatgtacagatgagtttttggtgtggatgtcctttctgtttgttagttttccttctaacagacaggaccctcagctgcaggtctgttggagtttgctagaggtccactccagaccctgtttgcctgggtatcagcagcggtggctgcagaacagcggattttcttgaaccgcaaatgctgctgaccgctgacaaatcttaattcagatatcaccttctcagtgaagcttattcaggccactctgtctgacatttacaagtaccactacccagctcagtgctcccacattactattctctacttttcttctttcattgtcacttactttccatcttattatataaattactttacttttctcttatctgtttccttttcatcctattagaaattaagctccagaaggaattgagatctttgttttcactgatataacccaagaacctgaaaatatgcctgggcgtatgttattgaatgaaaaaatgagccagctgctcttctcagagaacatgtaatgggagtctagtgggtagacattatttattttgttatgataagtagtttttttaaattgtggtaaaatatacataacataaagtttggcattttaaccttttttaaatgtacagttcacgagcattaagtacattcacattgttgtgcaatcatcaccaccatccatctcaagaacttttttcatattccagaactgaaattctgtatccattaaataataactccctatcctccctctcaccaaaccctaacaaccatcattactactctgcatacttcatataagtggaatcataaaaaaaattcatattttggtgattgacttatttcatttaccataatgtcctcaaggttcatccatatggtataatgtattgaattttttacctttttcagacttgataatattctattatatgtatatactgcattttgtttatttgttcattcattaatggacacttagttgccgtcacattttgtttgtgtgcataatgctactgtgaatgtgagggtacagatatctgagtccctgctttcagttcttttgggtataattctaaaagtagaattgctggatcatatggtaatgctgtttttagttttttgagaaatgatcatactattctccacagcagccataccattttatacaccagccaacaattcacagtggttccagtatttccacatctttgccaacccttactactttctgttttataggcatcctaatgggtgtgaagtggtatcttattgctttgatttgtatttccctaatgattagtatgtagtgcctttttttatatgcttattggctatttgtatatcttctatggagaaatacctattcaagtcctctgcccatttctaaatcaggttgtttttgttgaattttttatatatcctagatattaaccccttatcagataaatgatttgcaaatattttctcccatcctgtgggttaccttttcattctgttagtactgtccgttggtgaacaaaagtttttaattttgatgtagctcattttatctattgtgttgttgttgcctttgcttttagtgttataaccaagaaagcgttgctaaatccaatatcaggaagcatttccccgataagttttatagttttagctcttacatttaggtatttaatccattttgagttaatttttgtatattgtgtgaggtaagagtccaacttcattcatttgcatgtggatattcagttttcccatcatcttttcttgtgaagaccgtcctttttccattgtttgttcttggcacgtttcttgaaaatcatttgaccatatatgtgagggtttatttctggattctgtattctgttccattgatctatatggtttgtatttatgcagttcctcactgttttaattactatagctttgaaataagatttgaaatcagaaagtttgactaccaactttgttgttcctttttaagactgctttgggctgggcacagtggctcatgcatgtaatcccagcactttgggaggtcaaggtgggtggatcgcctgagctcaggagttcaagaccagcctggccaatgactgagttcaggagttcaagaccagcctgggcaacatagtgagactctgtctctacaaaaaaatgcaaaaattagccaggcatagtggcatgcacctgtactcccagctacttgggaagctgaggtgggaggatcacttgagccgaggaggcagagattacagtgagccaagatcatgccactgcactgtagcctgggtgacagaaccagaccctgtctcaaaaaaaaaaaaaaaaaaaagaaagaaagaaaaagaaaaagactgctttggctattcaggttccttgagattccatatgaattttaggatgaatttttctatttctgccaaaagaaaaagtcattaggatttttgatagggattgcattgaatctgtagatatctttgggtaatattaccaacttaaaaatattaagtcttctaatctgtgaacatgggatgtctttccatttgtttgtgtctttaatttctttcagaatgtattgtattgtcagtatacaagtcctccttggttaattcccaagtatttcattctttttgatgctgttgtaaatggaattgttttcttaatttcctttccagattgttcattgttggtatatagaaatatgactgattttcatatgttgatttttgtatcctgctactgtgccaaattcaactattagttctaattgttttttggtggaatctttagggttttctacatataagagcatgttatttgcaaacagattttatttctttgttttgaatctggatgccttttatttctttttcttgcctaagtgctttggctaggacttccactactatattgcagggatccccaaaccctgggccacggaccagtaccagtctgtggcctgttaggaaccaggctgcacaggaggaggtgagtgatgggcaagtgagcagtacctaatgcctgagctccgcttcctgtcagatcagcagcagcattagattctcataggagcttgaaccttattgtgaactgcacatgtgagggatctaggttgtgcactccttatgagaatctaacacctgatgatctgaggtggaacagtttcatcctgaaatcattcccctcatcccacccccaagtcctaaaaaaattgtcttccacaaaaccggtccctggtgccagaaaggttgagaactgctgctatattgaatagaagtggtagaaatggtaagagcacgcatccttgtcttgttccttattgtagagaaatggtttcagcctctcaagattgaatgtgatattcactgttggcttttcatatatagcctttattaagttgaggtagttttccttctgttcttagcttgttgagtgtttttatcatgaaagggttttgaattctgtcaaatactttttttgcatccattgaaatgattggtgttgtatttttcccctcattctgttaatgtggtgtattacattgaatgatttttgtatgttgaaccattcttatattccaggaataaatcccacttggacatggtgtataatccctttaatgtgctgttgaattctgttgaggatttttacaaaaatattcataaaggatattgatctatagttttcttttctcatctatatgtcttcatctggctttgatagcagagtaatactggcttcacagaatgagtatggaattgttcctgcctcttcaattttttggaagagtttgagggagactggttttgattatactttaaatgtttggtagaattcacccgtgaagtcatgtaatcgtgagcttttctttgttgggaggtgttttgttttgttaattttaaaaataatggtggccgggcacagtggctcacgcctgtaatcccagcactttgggaggctgaggcgggtggatcacttgaggtcaggagttcaaaaccagcctggccaacatggtgaaaccccatctctactaaaaatacaaaaatgagccaggcgtggtggtgggcgcctgtcatcccagctactcaggagactgagataggagaatctcttgaacctgggatgtggaggttgcagtgagccgagattacaccactgcactccagcctgggccacaaagcgagactctgtctcaaaaaaaaaaaaaaaaaaaattaaaaatatggaatgccacaagaatttgcatgttatccttgcacaggggccatgctaaccttccctgtatctttctagttttagtatatgtgctgctaaagtgagcactgttggaaggtttttgattacagattcaatctctttattagttatgagtcaattcagattttctttgtttttgtgattcagtctccatgacttgtgtttctcagaatttgttcttctcatttatattattcagtttgttgatgtataattgttcatagcactgtgttaacaatcctttttatttctgtgaaattactagtaatgtctcctctttcatttctgattttagttattgagtcttgttttcttagcccatctaggaatgtcaattttgttgatcttttcaaagaacaaactcttggttctattgattttctctatttttctattctctgtgttgtctctgctccaatttttattattcatttctttctgctagctttgagtttagcttgcttttctttttttaggtcctttacagtgtaaagttaggttgttgatttgagctcttcttttttaagtatttatagttagaagtttatctcagcacagcttttgctgctatatcccgttagttttggtaatgctgtgtttccattttcatttgtttcaagatattttctaattttctttgtgatttttctttgaccaattggttgagcgtgatatttaatttccacctatttgtaggtcgtctagttttgcttctgctgttaatttttagttttattctgttttaattggaagagataaatttatttattatttttattttgagatagagcctcgttctgccacccaggctggggtgcaatggcgcgatctcagctcactgcaacctctgcctcccgggttcaagcaattctcctgcctcagcctcacaagtagctgggactataggcgcccaccaccacgcccgtgtcatttttgtatttttagtagagacggggtttcaccatgttggccaggctggtctcgaactcctgatctcaagggacctgcccatctcggcctcccaaagtgttgggattacaggcatgagccaccgcacctggctggaagagatatttttatgatttcaattttttaaaattcattaagagttgttctatggcctaaagtatgttctgtcttggagaacattagatatgtacttgagaaaatgtgtattctgctattgttgggtggagtgttctgtatatatctgttaggtccagttgatctaaagtgttgttcaagtcctctctctccttattgaaagtgagatattgaagtctccaactgttactgtagagctgtctgtttctcccttcagttctgtcagtgtttaatgtatatattgaagaagcatgtttggtgcatgtatgtttataaatgttacatcatattggtaaattgaccctttatttattgtataatgtccatctttgtctcttgtaacagttgtagagttaaagtctattttttctgatattaagatatctctgctttcttgatattctatttgcatgaaatatcttttttcatcttttccctttcaaactatgtgtgtccttagatctaaagtgaatctctcttatacagcatgtagttgtgttttgcattttttttctaccagtttgtgtcttttcattagagagtttaatccattcacatttaaagtaattactgatagggaaggacttattattgtcattttgctgtttgtttctgtatgtcctatagttttatgtcccttatttcctctattacggtcttcatttatgtttagttgattttttgtagtgacattttttattccctcctcatttccttttactcttttctctgtgtttcatggagattacacaaaacatcctacaattataacagtctattttaaactgataagatttaatttcagttggatccaaaaccactcctttacagctccactccccactttatgtggttgaaagtcacaatttacttctaaagttgagttgtgagccagtattatagtaatactattttttatatttgtccatatgttgatatttacctttatcagagaaaactttatattttcatttggtgtctaacatcctttcatttcaacttgaatgactccctttagcatttcttttttttcctttttttttttgaggcagagttttgctcttgttgcccaggctggagtgcagtgacgcagtctcggctcactgcaacgtctgcctcctgggttcaggcgattctcctgcttcagcctcgctagttgctgggattacaggcatctaccaccatgcccgactaatttttttttttttttttcctggaagcagagtctcactccaggctggaatgcagtggcaagatcttggctcactgcatcctccccctgtcgcttcaagttgttctcctgcctcagccttccaagtagctgggactacaggcacgcaccaccatgccccactaatttttgtatctttagcagagatggagtctcaccgtgtttgccaggctggtcttgaactcctgacctcaagtgatccgtccaccttggcctcccaaagtgctgggattacaggcatgagccaccacgcccagccatgcctcactaatttttgtatttttagtagagatggggtttcaccatgttggccaggctggtctcaaactcctgaccttacgtgatccacccaccttggcctccgaaagtgctgggattacaggcatgagccactgctcccagcccctttagcatttcttatagagtaggtctagtggtaatgaaccattcagtttttgtttatctgggaatatcttaatttctctcttgtttgtgaaggacagtttaccagatacagaattctcagttgacagtgtttttttcgaacccttcaatatattcccctactcccttcaaggtttctgctgagaaattcactgataattttattgaggatcctggccaggcactgtggctcatacctgtaatcccaacactgtgggaggccgaggtgggaggatcacttgaggtcaggagttcgagactagcctggccaacatgatgaaactccatctctactaaaaatacaaaaattatccgggcgtggtggcttgcgcctgtagtcctagctactccagaggctgaggcgggagaatcacttgaacccgggaggcagaggttgcagtaagccaagatggcagcattgcactccagactgggtgacagaacgagactccatccaaaaagaaaaaaacaattattgaggatcccttctgcatgatgagtcagttttctctcactactttcacagtgctatctttgtttctgtctttcagcagtttgattataatgtaactcagcataggactcttttgagtttatcctacgtggagtttgttgacctttttatatatccatgtcttccctcaaagttggggagttttggccattatttcttcaaataagctctctgcctctttctttccggtataaagattagtgtgggggtgtctccattgttcttttttttcccctcaaacttagagctggaagaaaccttagacatcctgtgggccagaatttcatattaccttccacaaaactaacttccagagaggtcttcaggaagttggcaaattttagttacgtatttttaaagtgtctttgaacttttaagaactacatctcgttaattatatgtattcgtatatattattatccaaattttaacaaattagagtgcattggtgctttaaagtgctgtcaactactctgagaatgcaaaattcttgttttaaaatgtgtatcttacaactccttccttggatgaattagatttttttagatggagaaaccaaaatcaagtacagccataccttggagacattatggtttggttttgttttaggaacccaggctggtcttgaattcctgggctcaagcagtcctcccacctcagtctcctaaagtgctaggattacaggtgtgagccgctgcacctggcccagcatgggttcttttccataccaccacaataaagcaaatattgcaataaaagaagtcacatataaaagttctgttttcactatactctggtctattaagtgtgcagtaacatgtctaaaaaatgcacgtgtcttaattagaaaatgcttcattgctttaaaaaaaaaaaatgctaatgatcgggcacagtggctcacacctgtaatcccagcactttgggaggccggggtgggtgaatcacctgaggtcaggagttcaagaccagcctgcgcaacatggtgaaaccacgtctctactaaaaatacaaaaaattagccaggcgtggtggcgggtgcctgtaatcccagctacttgggaggctgaggcaggagaattgcttgaacccaggaggctgaggttgcagtgagctgagatagtgccattacactccagcctgggcaacaagagtgaaactccatctcaaaaaaaaaaaaaaaaagctaatgattatttgagccttcaacaaattgtaatcttcttggtggtggagaatcttgcctcgatattggtggctgccgactgatcaaggtgttagctgctgaaggttggggtgcctgtggcgatttcttaaaataacactgaagtttgtcacatcaattgactcttcctttcctgtacgatttcttttagcatgtgacactgttcgatagccttttacccacacaagatagtctttgaaaattggtatccgtccttttagatcctgccactgcttcacgaactaaatttatgtaatattctaaatccattgttctcattttaacaatgttcacagcatcttcaccaggagtacattctatctcaagaaatcactttcttatctgtagaggcaactcctctttggttccagttttatcatgagatttcagcaattcagtcacatcatcaggctctacttctaattgaagttcccttactaatttgtaccacgtctgcagttacttcctccactgaagtcttgaatccatcagtaatacatgacggttggatgtaacttctttcaaagtcctcttactattgctattttcacctccttccatgagtcacactgtttttgttttgttttgtttgagacggagtttcactcttgttgcccaggctggagtgcaatggagctgtctcggctcattgcaacttccgcctcttgggttcaaatgattttcctgcctcagccttccaagtagctgagattacgcccgccaccacgctcagctaattttttgtatttttagtagagacagggtttcactgtgttggccaggctggtctcgaactgctgacctcaggcgatccaccccgcctcagcctcccaaagtgctgggattacaagcgtgagccactacacccggcctgagtcacattgttcttaatagcatctagaatggtgaatccttcccaggaggttttcagtgtactttgcccaaatccatcagaggaatggctgtctatggcagctatagccttataaagtgtatttcttaaataataaaactagaaagtcaaaattactccttgatttgcaagaattactgcctggctgcaagaatggatgttgtgttagcaggcatgaaaacaacattcatctccttatacatcttcatcagagctctgggtgacttaggtgcattgtcagtgagcagatttttgggtttttttgtttgtttgtttgttttgagacagtctccctctgttgcccaggctggagcacagtggtgcaatctcagctcaccacaacctctgcctcccaggttcaagcaattctcctgcctcagcctcccaagtagctgggactacaggcacatgccaccacacacggctgatttttgtatttttagtagagacaggatttcaccatgttggccaggctggtctcgaactcctgacctcaagtgatctgcccgccttggcctccaaaagtactgggattacagacgtgagccacagtgcccagcctagcaggagtattttgaaagaaatctcttatctgagcagtggatcccaacaatgggcttaaaatattcagtaaaacatgccataaacagctgtgctgtcatccaggctttgttattttatttctactgtcaatttatcttaattcataggggccttaggattttcagaatggtcaatgagcattggcttcaacttaaaagttgccacagctgcattagccccataggagactcaacctgtcctttgatgcttcaaagccagacattgacttctctttagctatgacagttgtagatggcattttcttccagtagaagactgctttgtctacattgaaaatctgttgtttagtgtagccacctttatagatcaattatctaagctagacttctggataacttgctgcaacttctgtatcagtacttgctaagtttgtttttcttctttttaaaatccttttgtttgtgaaatgaagaatggactgtttttttcagttcctatggttaagttggcaaacctgttcttgccctatttatgtatttatgttggtttgtttgttttgttttgtttttagttacaacgtaagtcttttcctacattgtcttcttaaatgtaattccacttgacatgaaaacttttaattatgagaatatggagaaggagaattagttattattatataggtcattcaggtcagtggttcctaaatatcttttaaactttatatggggaaaaagagatatgtatataggtttttaatgtatttatttaattagtttacttgttcataaaatcccaacttctggaaactactgagattctgagaggtgatgttacatacccaagtcacaaacacaagacatttacccaccttactggtacccttctacccttattattttcttccactaggtagaattccaccaggcaaaaagattgatcctacggaacaggggaattgttaagctttcaaaataaataaaaacatgccagtaaatttttgttcttaaatgttatatataactctactccaacctctaaaatatacttgttatcatagggatagaagcatattaaatatagtcgggcgcggtggctcacgcctgtaatcccagcagtttgggaggccgaggcaggtggatcacaaggtcaggagattgagaccatcctagctaacacagtgaaaccctgtctctactaaaaatacaaaaaattagccgggcgtggtggcgggcacctgtagtcccagctacttgggaggctgaggcaggagaatggcgtgaaccgaggaggcagagcttgcagtgagccaagatcgcaccactgcactccagcctgggcgacagagcaagactccatctcaaaaaaaaaaaaaaaaaaaaaaagaagtatattaaatattttatggctgggcgaggtggcttacacctgtaattccagcactttgggaggccgaggcagacaggagtttgagaccagcctggccaacatggctactaaaaattcaaaaattagctgggcatggtggcatgcacctgtaattccagctacttgggaggctgaggcaggagaatctcttgaacctgagagatgttgctcgcctgagcaacagagcgagactccatctcaaaaaaggtatgttaaatattttgcctcacattgagatcttgttagcatttgcttctggtgaatagacacattgcagactgtgaaagaaaactaaggaaagcaaatttagaattcttactgggtttttttgtttgtttgttttgttttggagacagagttttgctcttgttgcctgagctggagtgcaatggcgcaatctcagctcactgcaacctccgcctcccaggttcaagcgattctcctgcctcaccctcccgagtagctgagattacaggcatccgccaccacgcccggctaatttttgtatttttagtaaagacgttggccaggctggtctcgaagccctgacctcaggtgatccacccgccttagcctcccaaagtgctgggattacaggcatgagcaaccgtacccggcaggatacttactttctacatgtactttataaaaattatttttccattttattgtgagattagtttaagtgccagaaatttttttgtgtggaatattttactaactcctgacagaaaatgcagaacttcccaactgttaattaaatctttataacatcctgaggatatagaagggagctcatgatctccctagagcatctttgactccagcaggagtaaaatacccagtaggttttcctttttacaggcaatgactcaggctaaacgtatatgtgttcatgtatttacttagcctctgctttctttcatatttcttctcttaattttcatcatttccagaaaccacaagctgtgactgtccttcaagttcacttaattttttttggagacggagtcttgctctgttcacccaggctggagtgcagtggtgcaatctcggctcactgcgacctccatctcctgggttcaagtgattctcctgcctcagcctcccaagtagctgagattacaggcgtgcaccaccacgcctggctaatttttgtatttttagtagagacagggtttcaccatgttggccaggctggtctcgaactcctgacctcaagccatttaattgtgtctttgaaggtaaataatatgtggaactggatcccaaatcctgagaatgccagaactacaggtccaaaacatgatgcactattctcagcagagttcagaagggtcagaactcaaggtgttatgaggcagagaacacatgaaattcgtgcattccatttagcagcccccatgagaccagaaatacaccccaggagtctttgaagatggggataattcaactcctggttttataaatagaagaatgaggagtaccaaaaatgttatgttgaattctcttcatttttctcatacaatctgaagcctgagctatcttatcctcaactcatagcagctgatgctgcagtttaggtttgagatcagtccctctatccattcaagagtgacccgaggcatagagctctaatcaggacagctttttaacaagaaccttctagtgacatactggtttagtttataagattttaatttacaaatttaaaaagctgcatctttaactttttctcctttttcttttctttcttcacatcactcttttccttatctatatcttactctttgtcatcttttctatcctttttgctcccttctgtttcctgcccttctttcttctctacatcctgattggcaatcttgttgttgatgaagttgtgtagggcaactatggaatgtgtcagggaggcagagtaccccactgccatttggtcgttgatcttcaggtacaaggccttgacagactgctgcaggctgatgtctggcagcagattgaagacttcctgcagctaatgatctggtggttgattggcagcttgcctgtggctgttttttccaggtagctcctgatatccagaagcttggagttcagcctcctcaaaccatggacctctttgtgatcagctggtaaagactgtccactgtagcatctttgatgtcttgtaacaagtgttcagctccagctgcctcagcttcctctgctccagtttcattagccacatgctcaaatgtttttgaggttggagcaccatcatcatggacttctctcactgaaatatatgcttctgtgggcagccccagatcctttagtttcagtcagtaataccaatactgagttaggttagtgtcttttcttgagttcattgatggcaatgttactcttgtgtagtttagggcctgtgtggtaccacccaactattctttggcattaattttcttaaacattccatacatgttttccaaataatcatggtctaaaaaccagacagaatgatttttgtcatcttcatcaaaagggactccagaactgttggatacatcaagtacttttgtctgccatgaccccaaaagcacaccaacaatgcactgctggtttccaaccttgctgattcggttgaaatgatccaccacactgagcagcaccggaaggtggaccactgccttctgcactgccagctctgacatcttgacacacaccgcccactaggcctagctccctgcaacccacaaactccagcagtagcagcaactcctgtgaagactacttaattttttaatgaaaaaaatgtgtgtgcatgggcaggtatgaatttatgtatagtcatgcattgcttaatgatgggaaaatgtgagaaatgtgtggttaggggaacatcagaaagtgtactgacacaacctggatggtgtagcttactacacaacctaggctattcgtcatatagcctattgctcctaggcttcaaacttgtacagccttgaatactatactgaatactgtaggcagttgtaacgcaatggtaagtatttatgtatctaaacatagagtaaaaattcagtatagaaaatagaaatggtacatctgtataggacacttaaccatgaacggagcttgcggggctggaagttgctctgggtgagtcagtgagtcaagtaatagtgaatgtgaaggcccaagacatcactgtacattgttgtaaactttataaacactgtacacttgcactacactaaatttataaaaaacatttttcttcaataataaattaaccttatcttactgtaactttttaactttctaaaactttaaaaaatttttgaactttttgactcttgtaataaacctttagtttaaaacactatacagctgtacaaaaatattttctttctgtatatctaaactttgcctacttttaaattttttttttctttttttttttaacttttaaacttttttcttaaatgtaagatgcaaaagagaaaaaaggaaaaaaaattaatacacaaacaaacatgagcctaggcctgcacggggtcaggaccatcaatatcactgtcttccacctccacatcttgtccccctggaaggtctttgggggcagtcaaacacatgaagctgtcatctcttacgataacaatgccttcttctggtatatctcctgaaggacctgcctgaggctctttttcaattaacttatttgttgtatatgtagaaggtgaacactaaaataacgattggccaggcacagtggctcacacctgtaatcccagcactttgagaggccacggtgggtggattgaggttgggagttcgagaccagcctggccaacatggtgaaactcaatctctactaaaaaatacaaaaaaaattagctgggtgtggtggcatacacctgtaatgcaagctactcggaggctgaggcacaagaatcgctttaacccgggaggtggaagttgcagtgagatgagatcgcacgaccgcactccagcctgggcaacagagcaagattccatctcaaaaaaaccaaaatagggtgggcatggtggcttatgcctgtaatcccagcactttggaaggctgaggtgggtggatcacctgaggtcaggagttcgagaccagcctggccaacagcgaaaccctgtctctactaaaagtgcaaaaattagccaggcatggtggtacgtgcctataatcttagctactcaggaggctgaggcaggagaattgcttgaacccaagaggcggaggtttcggtgagctgaggttatgccactgcactccagcctgggctacagagtgagactctgtctttaaaaaaaaaaaaacagcctaacaaacaaaataataataaaataacgattaaaaactatagtatagtaaatatgtaaaccagtaacatagttgtttattattattatcaaatacgggttgagcatccaaggtctgaaaaatctaaaatttgaaaatctaaacctttttgagcactgatatgatgctccaaggaaatgcttattggagcatttttggtttcaggatttttggatttggagtactcaacttataagcatatacagtgcaaatattccaaaatctgcaaaaatctgaaatccaaaacactccttctcccaagcatttcagataagggatactcagcctgcattgtgtactccacataatcgtgtgtgctatactttgatacgactggcaacacagtaggtttgtttacaccaacatcaccacaaacacatgagtaatgcattggactatggatattatgatggctatgaagtcattaggtgataggaattttttagcccaattataatcttactgggccaccatcatatatgtagcctgttgttgaccaaacattgttatgtggcatatgtcaagatttctggtagatagctgtttttcagggaattatttgtgagccttaaaattggtttcccttattccttgttattcatctggttatgctaagaaatgttatatttgtttggacgattcttaatagacagtttctgtcccttttttctttgcatattttcaacaaatatgagcatctcctagtttccagaccttgtgctaggccttgaggatacagctgtgaacaaaacaaagttcctgtcttcatagagtttgtataagaaagataggcaatgaacaaatatatgtcaaatactgatgagtactgtgattaaatcagggtaagggataaaaagtgatatacctaaaatgtagctttttcatgtacaccttcacaaaaaaccgtatcagcatagcatgatctcaaatatgtaagaaaaaaataccaggaataaaggctgttaaagaagtatgctgaaatattcataagggttatttctgatagtgagatttagggatgatttttaaattatacttttatatatttttccaaagcattcattacctttattctttggggaaaggcggtactaatgaggtcataagtgcagctaaagcccagttctgctggctcatagcccctgtgtacaccaagaggaagaaagtcacctgcatggtttctctaaaagtgtttctggaactccccccagcaggtatcttacgcgtgatctgaacaagttgaactcattgagtcctgctttctgaacgggcctctgcctcaaatcaaccatgatcagtatctgagaaagttatttgtcattcatctaagatttgtctttctgcagtgtttagactagtgctaaataggtcatttatgaggaaagtgtagaaaaactctttagtaaggtactatatattcttcatatagaagtgtcctttttaaaattaattttgttcacaatatatgcttcacaatattccagtcaaatctgacctaactgaggctattgcacacatgttgtgacttgtaaaggctgtgggacaggacagagaaaaggcatgaagcaaattttcagtcccacaagtgaaatgagcccaactctttttcccttgtcagcagtcagggagagcatcttcaccccactcaggctgtgccttagctacctcagcatcagaaataacaggagccgggcacgtggcctataatcccagcactttgggaggcttaggccggcagattgcttgaggtcagaggtttgagaccagcctggccaacatagtgaaaccccgtctctactaaaaatacaaagaaagaattagccaggtgtggtggcacacacctgtattcccagctacgtgggaggctgaggcacgagaatcacttgaatctgggaggcagaggttgcagtgagccgagatcgtgccactgcactccagcctgggtgacacaggcgagactccatctccaaaaaaaaaaaaaaagaaacaaaaaagaaaaataacaggaaaaggacagaaagaagggaaaccctgaaactacctatgatgaggctgggccctaggctgaggattcagcagatatgtatcaatgaaaaggccatcttttatagctagaattataggatttcctataaccctgaacttccaacatcctcttcaggatcagagttgctggtatatccctaaaggcctgatttctctatgcttccacccactcctttttcccacttgggctaccctttgcctacagctgtcttggtgacgaaatgtttggtgacaaagcaaacaaaaatagtgtatcttctttgctcctctttttatgtccaagatatactcatttttagagatacgggcacactttacacattcaaatgggcggataggcacacttttgttctaagaatagtttgaggataacttttctttttttattttattttattttttttgagacggagtcttgctctgtcgcccaggctggagtgcagtggcgcaatctcagcttactgcagcctccaccttccaggttcaagtgattctcctgcctcagcctcctgagtagctgagattacaggcgtgtgccaccatgcccgtctaatttttgtatttttagtagagacggggtttcaccgtgttggccaggctggtctcaaactcctgacctcaggtgatctgcccgcctcggcctcccaaagtgccgggattacaggcgtgagccactgtgcccggcctgaggagaacttttctgtgcctctttgtcttgccttctcttttgcagttctttccttgccttcctttccaactgtttgctttgtttctttccatcttcctgtatcaggcagcaattcctataaacattctttgacgttattggtagcccttacacctgaatgggtgaagcctatctcagagtagatcattcattccagctgaaaatgttagtctgcttggtaagtgcaatgtgatggaagaaacaacttctcaggcctgtgaaacattgattaaatatactttgtttgtttgtttgttggagacagacacgctctgtcgcccaggctggagtgcagtgtcatgatctcagctcactgcaacctccgcctcctgggttcaagcgattctcctgcctcagcttcccaagcagctgatattacaggcacgcaccaccacgcccagctaattttttgtatttttagtagagagagggtttcgctgtgttggccaggctggtctcgaaatcctggcctcaagtgatctgcccacctatgtttcccaaagtgctgggattacaggcgtgagccactgcacctggcctgttaaatatacttttgtagttactgttccttctgcctggtagcctggtttctcttccccgtgtttatctatttggtaaactccatttcttactcaaaagattttatttaaaagctgaatgtaatggcttctttgctccgtttccagattcacccaggcagttagtgactcccactacaggtttttcatacctctttcataacccatataagactgttttattattatttgtttacatatcttttactagactgaactttttcaagggtagaaatttgtatcattttattttctcagacttggtatatggtcaacaaatgtttgttgactgtccattctttggataggacttattgcctgttttcaaggaccttaccatctaataaaggtgatcaattacaggtaaccatggtacaaactagaatgccattagtgccgcagagaaggaaaaaattacttcttgctgtgggaagtagtgacacctaagttactccagggtttgttgatgaggtagcatttgaaatatgtcttgaaggatgagtgtgaaatgtggcattaatggtattatattagctttttgtacttcttgatgtctttattagcagtgatttaagttcataggagctatattatttgaaatgtgttccaaagccttacctataaatcatctagttgttcctttacctgtactttacctataaatcattactttatttgctattactttacctataaatcattcatcagttgatttatacaaaggaatacatcttgtggggttatcagtatacagtctgtctttgtgggtgtcagtcataaattcaggaattaatatttgagattgtatgttttcaactgtctgaatgtgattaaccaaaagaaaacatgaaatttgatgccttggctgggtttggtggctcatgcctataattccagcactctgggaggctgaggcaggaggatcacttgaacccaggagtttgggatcagcctggacaacatggcaaaaccccatatctacaaaaaacacaaaaattagtcaggcatggtggtgcatacccgtagtcccagctactcaggaggctgaggtgggaggatcacttgagcctgggagattgaggctgcagtgagccatgatcgtaccactgctcttgaggctgggtggacagagtgagactctgtctcaaaaaaaaaaaatgtcttactgtcctgtttcatttattttctttattcattttagccacagacccctttgcttctgtttttgggaatgaatcatttggaggtggatttgctgacttcagcacattgtcaaaggtaatctacagtaattaatgggaagggaaaacatactgtgtttccaccaaaagaacaatcctcctttcaattatatagtcctctcacaaagttgcaacttgatttcagtaaatcacagcaaatgttgatttcagatagaaatgaaagataacatatagttaaagtagacatatttctttatataactagactgtattgatggtagaggtaattataattttctgttggcatgtttgcttaacaacttcatatttagtcttctgtctttttaaacatgtttctcccaattgaaccacattttccccctgttgactgtctgggtcaataggtgtaaaatctgggtttttatttcgtcctctctgtattggttacttgattttatgttctgaggttgttagggccagtattaaggtaattaatacacaaagtccagtactaaatgtccactatttactttccactgtggctgtgatattgattcgggctaagagaaaaggaggattagattgttggttccttggttctcaactgagggttattttgccaccagaggaacatttggcaatgtctagagacctttttggttttcacaattgaataggagatgctacttacatctagtggatagagatgagggatgctatttaatacagtccactctctagccccccacaatatgcaattacgtccagcctgaaatgtcaatgttgagcattacctaaataaatgtaaaattgtgaagtctgattcattatagaaaagttaatcttttgttacatatttgaaagggtcttcagacacacattaagatttatcattccagccaggcgcggtggctcatgcctgttatcccagcactttgagaggccaaggcaggtggattgtctgagctcaggagttcaagaccagcctgggcaatgtggtgaaacctcgtcttgaccaaaaaacacaaaaaattggtcaggcatgccggcacgcacctgtaatcccagctgctcaggaggctgaggcgggaggatcacatgagcccaagaggcagaggttgcagtgagcctagattgcgccactgtactccaaccttagagtgagaccttgtctcaaaaaaaaaaattatccttttatgggatcagtttgcttcaaaaaattgactttcaggctgggtgcagtaactcaagcctgtaatcccagcatcttgggaggctgagatgggaggattgcttgagcccaggagttcgagaccagcctgggcaacataacgaaactccatctctacaaaataaaaattaaaaaaataactaggcgtggtggtacacacctgtagtcctagctattcgagaggctgaggcaggaggatccctagagcccaggggttcaaggctgcagtgagctatgattgtgccactgctctccagcttgggagactcctgccttttaaattaaaaaaaaaaaaaattgactttcaagttgtccttatagtttgtcaagatgccattttccttgcattagtattaaatcttatatttaagttcattaggacgtatggaatccattttttttcctttgattaccatttagatcagatattcgtttgcggaaaggcatacagtccctttaaaatgggcctcaggtggtttttgcattgaatatttcctgaagcttgacaaacctttaatctagattgagctgtttttggtttgatctgttaatcttaataagtaatgatgttagaatcactcctcatatagaataacttttttttcagaaatttctcccattggaccctgaatgcaaaggttaaaatttcagtgttctcagaattaaaataaataaaactgtataatactgaaatcattattctgaatgctacatgactaccacaatttgcttggtatagccatgtataaccatttctttttaaacaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctggtatgagagttggtacttttcttcagtcaactgcatggcttttctctttctgaaaagtattgtgcggaacttacttatataaatggctttaagtgaaacaagtcaaacatatgtcagaagcctgctgctgtcattcattctgacctaactgctgaattacagacatgcacttaagaagtcagcatgtataaatttcatgagctgtctttctgctaagaccttttttcttttcttttttttaacttaatcatttcagagaggcaatcaatggaaaagggaaagtgtcaagaaaatctttttgccttttggaaactcattgattatccatttgaatagcagtttcctgtactttggtgttttaattataatttatttaagagaagattgtttcaaagtccttttcctgtaaagtataaagtcttccttaaatcctttaatgtgagaatatatggcctctttagtatccagaattcagcaatacagtgatttgaaacaaagtattggttttcttgaaggaaaatggtattttagctaacttaaaatattcctcttttttttttttttttttgagatggaatctcgctctgttgcccaggctggagtacagtggcatgatctcagctcactgtaacctcagcctcccggattcaagggattctcctgcctcagcctcccgagtagttgggattataggcatgatccaccatgcctggctaatttttgtatttttagcagagatggggtttcaccatgttggccacgctggtctctacctcctgacctcaagtgatctgtccacctcggcctcccaaagtgctgggattacaggtgtgagccactgcacctggccaagactcttttctaatagtgatttgtttcttatttttgtttgtttctatgtataattagtatgtgtgtgtatgtatatgtttagcactatacaaaggaaagtttgttttgtttttaggtcataataagtggctaaaaggataattccttgagtagttgtagtgctgttggggtattatgtgagaagacacatcttagtatatttttttttaaatcatacctcattccttgggaaattttcagtctcagtagttacagattaatattgccttttcatcataacctttccatggtcttgagcagataggttttttttctttgactgaaagaattgcatgtacaattgtaaatatccgataatctgttgaaaaatcaggtaaatgagttaagtgattccttctaaggaaaggtagcttatgtcatatatttctagaagtgaggttatcagaatatatttaaaaataaataatggttaatttgcacatttaagtttttacaacttgcatgatgccaatagtgaggttgtttttttaaatcttaagtaaaataatatgctagtgtttttgctcaatctaagaatcttcatccaagtaattgtatatcattgtaaaaagattaaggaaaagactggtttgttggaaagagcactaaactgggagtctaaatatctgggttctgtttctggatgttccctgactaactatgatcttaagtgtataatttcatatatctgacccttggctattaaatgttggcagtaattctaattttgcctactttcacaggattattggaagaatccattgagatatgagcatcttttctaagcagctacagtgatggaatctgttgttatgattgctattaccagcttatgcattttaggaaaaaaatatatttggagatattttgacccctatttttattatcttttcttcaagaagtactaagtttaagtaagacttagagaacttgtttgaaaatggtaatgaattagtgagtgactaataggacagaatactattgtttggtcagagattatttgatcagcaaccgcaaagatttaggccctgggcttcaaaacattttttcttcattttgaaatacagtaaataacaaaaaattggcagcattttactacggtaatttaaaaattttatgctcttaggtattgtatgtagaactagagaaaaatcagaagaattttcccagttttcagaggtcatttgctcttactgccactagtggataactgttatcaggctgagggctgtaacagcagaggcaggccatttctgtctttattctttattattctccttctgtttaatccattcgtctctccttttgggaacatgctgcttgggtgtggctaggggatggtgggattcagtctttggacaaaaatatgattcctggcccatccttactttgctatttgtttcattagctgcacatagctggaatctatttgagagatcatgtgtgaagaatttgaggacaaattgttggtgtagctatttaagacaatattcagaatgtgttttaggtactcaatcatcctctacccacagtactttaatgctatctgtgtacatgttcttgtgtgcttgtatttgctgtatttactggttgaattaattgtaatgattttgatccagggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgctgtaagtactgtgaatgagctgtttgggggagaaatctttaaagagttttcagagattattttggagtctgccaagtttgcatcattttaactaaatttaccaagatactaaaaatgatctttcattcttcccccaagcaaaacctctgtttgatcctgttttgacagttctacggttgttccatcgcacagatgattttagtagtcccagttcttgtcatatacacaagttgttttgtaaatctttctcttagtcttggtaatgtaagtaaaatcctaacagttattattttgtggatggttatgggtgatggtgatttaatgaacaattacagagtcattgctctctgcccactagatgaataatgccagtaataagtttgtgtatttgcagctgtgtatgtgtgtttgtgtataaagttttaatgatttctggagaccagtcagcaaatattatatgagaggatagagccagagattctttgaatagaaagtaaaactattaaacttacacagtagctttttaaaaatgtaaatgccagttttatgaaataaataaataaatggttgtcaggatttaaacaatctttatttggagggccctaattcactaacttctcatgtttactctgcgttctttcagagatgtctaaaataggaagatcgttagaaacagtggaagggtgccatgataacagcataagcagggcctataaaatcacagaaatggggcaaccaaccatggaggtatcagtctagagagacataaagcaatgtcatatattccatcattattcagtaaaaaaagttattttttaataaaattcttagaccgggtaacaaattttcagtttcacagttttttcaggcaaaataaccttcgttatcattgcctgttctataaaacagagattttcttctatttatcaccttatgcccttgagatgattttggaaatagatctagtggccaggtaactctgcctaatatttccctcctcagtgtagcattgggccattcaaccaattgctttattcctgcagctgtttctagttagaagggaggtagtcaagaatctgcatgcaggccgggcgtggtggctcacgcctgtaatctcagcattttaagaggccaaagtgctttaagcacctgtagtcccagctacttggggggctgaggtggtggaggttgcagtgagctgtgatcatgccactgtacttcagcctgggtgacagagccagaccctgtctccaaaaaaaaaaagaatctgcatgcaactaagacgactgagctcccagcttttgaatctgtactctaagttctggtggcttctcttgactatgaaggagcaaaataggaatcaatattttgaatattgtaaaaatggagtgccagaattatactgatttttttttttttttgagatgagttttgctcttattgcccaggctggaggcgcgatcttggctcaccacaaccttcacctcccaggttcaagcaattctcctgcctcagcctcccgagtagctgggattgcaggcatacccaccacacctggctaattttgtatttttagtagagacggggtttctccatgttggtcaggctggtcttgtactcctgatctcaggcgatccaccggcctcagcctctcaaagtgttgggattacaggtgtgagccatcgcgcccagccttacttaactttccttttttttttttttttttttaaagacagagtcttgctctgtcgccaggctggagtgcagtggcgtaatctcagctcactgcaacctccacctcccaggttcaagcaattctcctgcctcagcctcccaagtagctgggactacaggcacgcaccaccacacctagccaatttttgtgtttttagtagagacggggtttcaccatgttggccgggatggtctcgatcccttgatcttgcaatgtgcatgccttggcctcccaaagtgatgggattacaggggtgagccaccgcatccagcccgacttaactttcattagatggaatttgatttgtttcaagcagagaatcaaaaattggcctttttagaaggttataattctcttagtgtaaaataaccctctggtagtttgtggcatttaatatcttaagtatggttttagcaagtcaaactcttgttggggccagacggggtggctcacacctgtaatcccagcactttggaaggccgaagcgggcggatcacttgaggtcaggagtgtgagaccagcctggccaacatggtgaaaccccgtctctactaaaaatacaaaaattagccaggcatggtggcgcatgcctgtaatcccagctagggaggctgaggtgggaggatcacttaagccccagaggcagaggttgcgggagctgatatagtgccactgtcctcaagctgagttacagagcgagactccgcctcaaaaaaaaaaaaaaaaacaaaaaaaaacaaatctggttggaaggagtcttgaacaacagctgaggcattttgctccaaaatctcaatatagtataataaaaaacagcttataataagaacatcttcttttttcattgtgaaagatgtggttaagcattacacgtttcaaagttttgcttaattccctagggaaaaaaactaccatttcaaaagcctgacagtgtattttatttcatcctttcatgaaggattttctatgtaacaagacttgaaaccaattagaatttttaatttagtatttgccaaggttgctgtttggggtagataaaaatatttccccaacataataattatgagtgttaagattttatttagactggtctaaaagttcccaaagcctggagaaatcttcataatgctttttgttttatttttattttttttggctcactccgtcgatctggctggagagcggtggtatgatcacagctcactgcagcctcaacttcccaggctcaggtgatcctcccaggtagctggaactacagatgtgcaccaccacacctggctaattttttttgtaaaaacagagttttgccatgttgccaagatgaacttcttgaacttctgagctcaagcaattggcccacacccacagaactaggattacagatgtcagccaccatgcctggctcaaaatgctttttataaaatatgattaggttcttgggaggccgagatgggcggatcacctgaggtcaggagttcgagatcagcctaaccaacatgaagaaaccctatctctactaaaaatacaggattagccgggcgtggtggtgcatgcttgtaattccagctactcgggaggctgaggcaagagaatcgcttgaacccgggaggcggaggttgtggtgagccaagattgctccatagcacccagcctgggcaacaagagcgaaaactctgtctcaaaaaaaaaaaaaaaagattaggtttaaatcacatcttgcttagtatacccaatactttaatatgatgtatagcaaaatcagcttttttttttttttcttgcttcttagcttttttacacattaagggttaggaaactaccagtgggattaaattaaaaatgatttgttgtgtgagggtctcagtaaagttgaagtggtaaatattttacattacattaggtcaaaaaggctagccctgtcctgtttttaaatcttctaatctactataagcatttctactttttttagtgagatatatatatatatatatcacatttaaaaaaaaaaaatatatatatatatatatatatatatatatatatatattttttttttttttcagagggaatctcactttgtcacccaggctggagtgcaggggtgcattttcggctcactgcaacctctgcctcctgggttcaagtgattcatgtgcctcaccctcccaagtagctgggattacaggcaccaccaccatgcccagctaatttttgtatttttagttgagagcgagttttgccatgttggccaagctggtctcgaactcctgacctcaggtgatccacctgcctcagcctccaaagtgctgggattacaggcatgagccaccacatctagcctagtggcatttttaacatttagttttatagactttctatctatagattgaattaattttttaaattaaactatagcttaataactggttaatattaaacatgttttcagggggaaaaaaaaaagaattaacaagtaaccagactatttccagagtccttcaggtgtccttttgtaaaaactatttttccttctttttacttgctttactcatttatttattcgtttgttcatcgatcttttaaatggcagtatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactattatttttggttatcatgtcgtgcttttatgaaagaaatgaaatgtatatgcataaagacagtgcctaaaacataagaatttgtaggcaggacacagtggctcgcgcctgtaatcccagcactttgggaggccaaggtgggcagatcacctgaggtcaggagttcgagaacaacctggtgaacatggtgaaaccccgtctctactaaaaatacgaaaaaattagcaggcatagtggctcgctcctgtagtcccagctactcgggaggctgaaacaggagaattgcttgaacccaggaggcagaggttgcagtgagccgagatcacactactggactccagcctgggtgacagagtgagactccgtctcaaaaagaaaaaagaatttgtcactgggcacagtggctcatgcctgtaatcccagcactttgggaggctgaggtgggaggatcccttgagcccaggagtttgagaccagcctggggcaacatggtgagaccccgtctctacaaaaaaaatacaaaaattagccaggtgcggtggtgcgtgtctgtagtcccagctactgggggctgaggtgggaggatcggttgagcccagtgaggctgcaagaagctgggattgtgccactgtactacaacctaggcaacagagcaagaccctgtctcaaaaaaaaaaaacattgtgcttgtaatcccagcactttgggagttcaaggtgggtggatctcctgaggtcaggagttcaagaccaacctggccaacatggtgaaacccctgtctaataaaaaatacaaaaattagccgggcatggtggtgggtgcctgtattcccagctacttgggaggctgaggcaggagaattgcttgagcttgggaggtggaggttgcagtgagccaagactgtgccactgcaccccagcctgggcaacagagtaagactctgtatcaaaaaaaaaaaaattgtgacatggacttttggaaggcactgtgttctgaaaaactcatacagtactgggactgaatctctttctgccatttttg

SEQ ID NO: 16555 - DNA, 9678 bp, Human
tttcactaatccttctcagcacagaccctttacgggtgtcacgctgtgagggacggtcaggtctttcccttcccacgaggccatatttcagactatcacatggggagaaaccttggacaatacctggctttcctaggcagaggtccctgtgggcttccgcagtgtttgtgtccctcggtacttgagattagggagtggtgatgactcttaacgagcatgctgccttcaagcatctgtttaacaaagcacatcttgcaccgcccttaatccatttaaccctgagtggacacagcacatgtttcagagagcagggggttgggggtggggttacagattaacagcatctcaaggcagaagaatttttctcagtacagaacaaaatggagtctcctatgtctacttctttctacacagacacagtaacaatctgatctctcttttccccacaggataggagtccaggtaacttgttccatggcaggcagtagtcttttttttttttttttttttttttttgagaaaggttctcgctatgctacccaggctggtctcatctcaggctcatgcgatcctcctgcctctgcagtggctgggataagacacaactgccaccaggccctgcccctaggcagtagtcttaatgcctgatggtggggggttggggaaggaaggggttgagtatcagggtaaatgctgcagagctgtgttaaggacttaggccctggagtcaaatgcctctgctcacatcccactctgcaagactttgggcaacttaagcagcagcctctgtttccatcgcagtggctcttgcctataatcccagcactttgggaggctgaggcgggaggatcacttgcgcccaagagttcgagaccaccccatctctacaaaaaaatccaaaaagtaatctgcttcctcatgtgaatgtcgttgtaaggagtgagataacacatagagtgcaatgagcaagtcccagcacagaagactcatttcataaaatacgtgtttattattaccataggcctacagtccccggtattcttaacacatcttgcctgagaagtatcacactcatgcctatcaaccagctcacacatttaatcaaaggaatttggcagctgtagggttgtcttttcatccatatcgtccctggaattaactgtcctgctataccagtcagattgagcagcatctgtcaagagtttcagtcccacttgcagaggaaaggctctctggcttcggtccgtggctctccgtaggtgccgtgtctggacccagcctaccttcatctctgttaggcttaggggtctttctccacactgtgtcttgtccaatcacaagacttcaacggagcgggcggtctggcctaggctcttatgcgtgggatgtctgcaggccaacaatcccagtcgggattcgaagccgcgcgcagtgcccggaatgacccctccacattgatgccactgtagagcccggaaggaaaagcaagcagcctcggccccgcacagcccaggattaaatgtttgcgccagggcccctctggctacctggtggtggccccgagcggcctcggaggccgcggcgtagctcctgggtgaaggcgtctctaaatcgctcagcgcggcggcacagggagcccacgggcccagccgcgaggtcctgcaggcggcgggccgcgtcctggccccgcagctgggcctgcagcagtgcgaaggccgtgagctgcgccgcacgtcggataggccgcgactctgacagacgttccaccagctgcgggctgtgcagcagggcggccagcagccgccgcagcaccatcttctccaagcgcccggaacccgacctcgccgccctcgtcttccgccccgcggcgcccgacccggacgtctatgcccccgcgcagcttgatgacgacactgccgccctcggattgggtccaatgagatgctcgcctccgcgcgtttccgcttccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagaggtttgagcggtggtggtggtggcggctcccgtttccacggttgtgcctccgcagacgactacgtagcaagggggaggggtgcccttctctctcccagagtaggcagaggcgccttcctgatgcagatgcggggctttttgctttgttttttaaatcggcgaagcagtgcccttcggcgattcgggccccttctctgggaggatggtgttacggaagctgtacgcggtgcgtgggagacacaagtggagtcctcactccgccctcggggaagcttcggagtggggaggtggacccgccaagctcggcactttgagggtgttcggatgtaaagatcggagaattgctggatttcagaagagggaaatttttagtccggactatatcacagtatattttgtggaaaaaggggaggcagcagatattcaaagtagacttttcagtatcagcggaggtagggatggaatacggttgggggttggcggggcgggactcattaacccaattatttagtaaacgtttatcgagtgctgtcgccaaatccttgtgctaaaccctagagggagagggaagacagtttctgcgctctgcgagctcataatcccctgtagtgaggattcagaaaagggaaaaatccccttgtgactgggaaaggaaggggcgcatatagcagaaggtaagtgtggagaatgtgtgaaatgtgttactagagtagggaaagggaaattttgtttgacgctaaattagggaagctcttacatttatttagtcaaggctgggaacggtggctcacgcctgtaatcccagcactttgggaggctgaggcgggtggatcacgaggttaggagttcaagactagcctggccaagatggtgaaaccccgtcttactaaaaatacaaaaattaggcgggcgtggtggcaggcgcttgtaatcccagctattcgggaggctgaggcaggagaatcgcttgaaccggggaggtggaggttgctgtgagatcgcgccactgcactccagcctgggcaacagagcgatattccttctcaaaaaaaaaaaatttattcagttaatgtattttattttttgagacagagtctcgctttattgcctaggctgaagtgcagtggcgcaatcacggctcacgcagcctcaacctcctgagcctaagtgatcctacccacctcaggcctcctgagaagctgggaccacaggctcgcgccaccacatccagctaattttttgtagagacagggtctccctgtgttgctcaggccagtctcgaactctgggactcaagcgatccacctgcctggggcttcccaaagtgctgggatgcctaagtgccaggcatgatttgcacttctaccacttttagttactactttagacagttccacatcctgaccattttgaacttaaagcatcctgtgagatgaaaactggaaccttctgactttgtctattattcatctcctcagtctaaacctgtagctttttttagatgctaatgccatactgtcatgtggaatttctagcattctgtgaatggaatccatattaatatactttaagcacttacaccacagttatcttaaactgtaggctatttatttggatcttacttacatgtgtgagaaaagtagaaaaagaagatgcctcctttccatgttcacaaatcagtaacagcagtaaaatgaaaggaatttactttctctaatgtctcactccaaagttccgaaaacctctttttaacatacaatgactattgtcctgtggacttttttttttttgagatagagtttcactcttgttgtccaggctcaagtgcagtggtgcaatctcagctccctgcaacctccacctcccaggttcaagcgattctcctgcttcagcctcccgagtagctgggattacaggcgcccgctgctaccatgcccagctaatttttgtatttttagtagagacagggtttcattcactatgttagccaggctggtctcaaactcttgacctcaggcgatccactcgcctcagcctcccaaagtgctgggattacaggcatgagccaccgcgcctgaccccgatgagccattttggacccagggctttgtctgtcaggtgtgttggatgaagcccagttatatgcttaagtctctggcttcatcctgtcatcccaatttggaagcccattaagaaagtgagctctgttttgtttttagtgatcactacattttcccctaaactcagagaaagatctatgagcacgtaaagcatcaaggttgtggctttcaacagtctctagggggttattaaagaggaactctctctctctctgaaaacccacttatttttcactacgaaggataaaagggccctttgtcatatattgggtcaaggtccagagtctacacttgggtttaaaggatgcactgctgaggatatggtgtgtgcagggaaaagggaagccgcttgcgtggcagtcgggcgtagaagtgactttgttgtatgtggtataacttttgagccctgtctctactaagagtctggacttcgcataagtgcttcacagaaggtcgacatccccctttttgggcaagggatttctggtaggctgggatgagagaagttgatttccaaaccagaattaatgaatgtctctaccgtacttagaaatactatttaagcaaggctctgaagttgcttaacttttgtctctatttgaaattctagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggagtatccttcccatggatctaatgtagctgctgaaccagggtagagctgagagtggtagctcacaagcgtccctgcactcgtccctacgttttccttcatctccctcctactttccacccagtgtgtctctgcccttatactgtaaagctgatactatttatattctcttctgaaatccatgctttatggttctttaacaaaaagtttttcaagaatgtttgcccttcacgtaaaaaaaaaaattccaaagaatgtggtgaaaatacaaaaatctcgtactgttctaaacccctaatgccctttgccagaggcagtcagttagcagtttcttgggcgtctttcaagaagtaaccctgtgggtgtgcggtagtgtatttcatgtgctgtttttaaaatcatttttttattttttattgttccatttcagcatatgtaggtctttttttaaaatagctgtacagctggccatggtggctggtgtttgtagtgccagctgctcaggaagctgaggcaggaggatcagttgagcccaagatttcaaggctgcactgagttgtgactgtgttccagcgggggtgacgggttaagaccccatctttaaagaaaaaaacttttaagtaaatagctgtatagtatttcattatatagatgtatataacctgactgtataggtacaaaccaaaactatttactttgatcatttaattcccttactcagactcttttaagtattggacctcttggatttatcctatgttctttttactgtatgttttggtcattcaatttaatattctgagaaattttgcaggcccaatttaatgtatcttttgaattttttcctgtgccctgaattatgtttgtttcggttgaaatttttccttaagtgtctggtgatccctggatttctgctcataattaaggaaaagaatgctgactcactggacccaggcagggcttctctcccagattgcaggcttgcctcggggatacacgggtttcccaaatgctagaatgaaaagagattttattttggcttgctaacatcaaagatactagtttctccagatggtttattcagaacactgttgtcttatttttatttgtctgagattaaatgtcttcccctttaattaaagggaggtctctgatgaagtaggtttgggaactgctaccttggtgacagcttgagtctttcctttagtgaagtgcagcacaattccacgtgcacggtgaccttctcttgattagggtgccttggaatgtacagaacctaacttgaatatacagcactggtttcttggataagaagtgtacagtgatctaaacttgcaaaccaaaatacagagatgatgggaccaaaaattatcaacaggaatgtccaagaaatatgatcagtgtagccatggatacgtgtcatatttgactctatgtgcttccaaaccaatcgcaaacaggcctgggcaagctgaattactgtctttgaactccatctggttggattagctcttgtactttttaacaactcagcttcatttacatgttgttcccctatttccagaaatgtttggaaaaatgctagtgttccttaatacttaagatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggtatgcaagaagggtctctgggctcagccattgcctgggattccagtcacaatgacaggtgttttggcaatttgtatttactcttttgtaaataactttgtgtctataaccttggcttgaagtggatctgaaaaccacccaacggtttgggtgaattttttttttaaaccgtgaaatggtatgttctgtacgtttctaacaagcaaccattcttgaacttctgctagggctaggtatcttccacctgcaggaacatctaaaatgaaagcaaaacgcactgaagtgagctgaagtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactggcacagaaccagtgagtggtgagagctctgtcagtgacaaacactcctttggcctgttgaatttgctgaagaacatcacctaaagtctgcacacgagcccatttttaccaagatttgatcagtgtctttactgagctggaagcctctgaaagttattaaaggacagaatccaaaagaatgcctttaattcttgtctgagaatcttggccatgtgtcagattatcagaacaattttgttaccaggtcagaaattgtgttctttgacaacagattggatctgtaatgttgattagtctttagccataaccactacacttttagaaagacagaaaaatgtaagaatttgtttttaccataatgagtcttaagtaggttcatgatctacattggggcctgggattatttttttaattttaagtttgcatgagatagcctaataaatggaggtggggccaggcatggtggctcacacgtgtaatcccaacactttgggaggctgaggaggaaggatagcttgaggccaggagtttgagactagactgggcaacatagcaagaccccgtctctacaaagcaaaacgaaaaacaacaaatggagttgtgctatgttgtattgctttgcacaaaattaggaacaggtgtttgacaattgaatttgttttctgtgaattctaacctctaaaggcatgcttagaggtcaaggaccttcctgtgtagttggtgcaaaagcaatctccacaggacagcactgcttccatgcttcatacatcaggaaatgaggccagaacttgagtatttactaacacgtttttcaaaagatgtcagtgttatacctaaagctaaaaaaaagcaagggtttgtcatagagggaacctctaaataatttcaggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacaggggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcctgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttatttggattgtcttctgtaataggtttcaataaagctggatgaacttatcgttgttgctgcctgtttcctggcctataaagagggttgtgttctggaattcctgtactctggatacacatgaatgagttccagggggattctatgaatagtgtggacaattcgcgtgtccattttgattgactgacagttggaaataactattgctgcgtgtgaagagagcgcacagattttcttgtgaaagtgatcaaataggcaccaagcaacctctactgatggaagaataggttagttttccaaaaaacatgctctggatgattgcaagggaagggaaattgtgggtggattaagaacatcttatgtttgctgggctagagaacactaaatgtgagtctctttactgcaccattctttcctatttctcatggatagcatctgacctgtttctcactttaatcggagaaaagtgaaaattcaaacgtacagatgaaggcatcactattaatacatgttagtgaagtgtgagaattaaacattcagtttctcagtcaagctaagatgaagatatagaacatttccgttgtagaaaattcgagtgatg

SEQ ID NO: 16556 - DNA, 5848 bp, Human
cttcttgcaactgaatttttgtattcaatgttatggctttgatactagtccaagttgaaatatagatatctactttattcgatttaaattctgtttagtattttattatattttgttaatccatttgtcccaattcatatacttatctctctttctgtgaatattcaggttagttttttcttcctaattttgcattctgattggcttttattccctgaattataaatgactattctatgatgattctggtaaatactcaatttcaccacacaatctttgacttcatactaacaaacagttgacttcaaatggacaatttcaatgaaggctgacttcatatttagctcctttaagcttccttaggcatcagctctctacaattctcacatggagaatatgtgtattttgttagctcaaaccttgttagacatgttaaatgtttagaaatataaatttaacctaccccttgaggtaggtcttgagaggtttgtgagcctaaaaagacatggaggaaccacttattgccacaagcacattgttctaaattatttggaatcagttaattcttccccatctcctacccatgcctgacaccaaagaggagcctctaaatttacagggaatacaaggaagtctactgttctctgctcctctctgggttattagggcacatgggagccctcagttgttttctgctgagcaagagcaaagtccaccttggacttagacagcttgccaaattttttgccagaaggggacctgagttgtgaccactcccagtgtgtgccgggaaaaggctcatactggtgccagaatctcttactgtcaatgctcccaaaactcaccgcttgcccccaccccttttgcttaaatgacgtggttcttatctcagatcctgatataaagctcctacagctacctggcctgagaagccaactcagactcagccaacaggtaagtgggcattacaggagaagggcgtctctaacatgcactgtagatctaaaatcttcgggaagatacagcatgagtttctgtccaagaggttttagctgtaaggaagcctcagtgggatccaaagttgtttttcagttactgagtctgtataatccccactctcaagagaaacatttgaaggtgtgggtgtctcagaggaccttcctggtctcagaaattctgagaggaggttttaaggaaggtaataggtgctttgctctccatctctcagaacccccttctctgtgttctcctatagagattgttgatttgcctcttaagcaagagattcattgcagctcagcatggctcagaccagctcatacttcatgctgatctcctgcctgatgtttctgtctcagagccaaggtaagatctcttttccaccaaccaactctttctagccctgaagacttcactctatccccaagcatacgggtctacttgaaaaaaaaaaaaaagcagagtcactgttaagggttgttttgtggtgtttagtgatctttattgctgatctcttcacatttatatacatccacacctcattaaggagttggagctagaatttaaaatgaccccttataagcaactgctgcagttggcatgagtttatctgattaaatttatacgtgatggtggatttggggatgtctgtgtgtagacagtcactaatggggtggagaactgaagagagccttgtgttcagggaaaccaagtcaggcttgagaaagtagaaggctgagtccttcaaggtagaagagcctgagctccagacataaaagggaaactggagacttgtttctttggcctattcattctgttttttttcccctgatcaaagaaaccaaagacagaagatgtaggatgcaggagcaatagtgagcagtcatcccataatagactggattcttctgtttctataaaggaacctcagaagctcttacctcaccttcaagccttttccttaccctgagagcctcctttaattgtctcttctttttcaggccaagaggcccagacagagttgccccaggcccggatcagctgcccagaaggcaccaatgcctatcgctcctactgctactactttaatgaagaccgtgagacctgggttgatgcagatgtgagtgaggagagcagtgtgggaagggagactcatgaagggaggggaagctgccactctccagtgtgttcagtggctgcaatgagatgagactgaaccccttgctatactatcatcagccccaaactttccaatctactttatcccattattcagcacattcccagcacaaagaacctggtggtcagtgacagcatcatcacggacattactctgctgtcctttttctgacccgtcctcttggaggactcagtatatccgtcacaacttcctcctccactgagtgctccattttcttctgcaacagctctattgccagaacatgaattcgggcaacctggtgtctgtgctcacccaggccgagggtgcctttgtggcctcactgattaaggagagtggcactgatgacttcaatgtctggattggcctccatgaccccaaaaaggtaggctgcagccttctttatctcctaatgatcaggtttgagaagtaagaaggaggttcaagttctggtctcttaagtaccagcttttatcgctttccagaaatcaggctgtttacagatgctctaatgtcctgtgtagcaaggtgcactgtagatgattggagatataagtggaaggctgaatttcctaggtgttcttgtcattcatgaataaacttattctgttttcagtcaacaaagcatctttatgcaccaacttcttacctattttgttactgtcagagtcacaagagagactagattgccgactatataggaaaggagacttgtggtaaaaatctgctgctgtactgctggcatttgggaacctggtagtatactaaataatataatatatcaacaactaatggtcagccaatgctatgctggatatgagggtcctgggccacaaagacaaaaaatcaggaaccactttttaagtgagatactttgggtctctgtcaaattcataacacttatttcttggtggaatacagttaatgagttggacagttcaggaaagaagtttagagcaatagcaaaggaaaggaaacaatatttagcaaggtttattcttcctttgtgtcttagcatgtttctgagtgtgcacacaggcccagtgattccatgtatttttgagtgaccactgcctctgttctggcccttccccatctagaaccgccgctggcactggagcagtgggtccctggtctcctacaagtcctggggcattggagccccaagcagtgttaatcctggctactgtgtgagcctgacctcaagcacaggtgagaggcagagaatccatccacctgtttctgttctctcctgcttagctccagggatggaactgggactgggatagaggaaaggtgaactcctcattaaggaaatggatgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccctaaataataaaaataaacatgtttccactattgtgctgtcttactgtgtctgctatttccacagctgatgcctgggtggttgagatgagagtgattacaacaaagcttgctctggcctatccacttcttaaaagtccatccgcataccatgcatattggaattcagtatttatgaacatatgtggctttgcttatgacaaggttaacaagatggagattgaccaaaaactcacatgctggcatatctcaaagatttttgcattcagttccagatcactgtaataagggtaatgtcacagaaaagcaagttacacaggtttttttttttttgcttccctttgcatataaatgttttactgtagtctattatacgagcaatagcattatatctaaacagaaatatacatactttaatgaaatagtattttattgctaaaaaatgctaacaatcatcagcgtcttcagcaagtagtattcttttgctcgtgaatggtattgcctcaatgttgatggctgctgcctgagcagggcagtagttgctgaaggttagggtggctgtggaagtttcttaaaataagactacaatgaagttggccacattgatttgattcttcctttcatgaatgatttctttatagcatgtagtattgtttgatagcatttttcccacagtacaacttcttttaaattggagtcggcctctccaaaccctgctgcttctttatcaactaagtttatatgttgttctaaaccctatgttgtcattttaacaatgttcacagcacctttgtcaagagtggattccatttcaggaaaccactttctctgctcatccataagaagctgctccttatcctttcaagttttatcataagattgcagcggttcagacacctcttcatgctgcatttctaattttagttctcttgatatttccactacattcacagttacttccttcatggaaatcttgatcctttcaaagttatccatgaagttggaatcagcgtcttccaatctccagtgaataatgatatattgacctcctcccttaaataaaaaatgttcttaatggtatctagaatggtgtattctttccagatggttttcaatttactttgcccagatccttcagaggaatcactatgtatggcagctatagctttgtgacatgtatttgttaaataataagaattgaaaggtgaaattactttttgatccctaggctgcaaaacagattttgtattagaagcaggcatgaaaaagtcctaaatcttcttgcatatatctgtgttcctaggtgacaaggtgcatcatcaatgagcagtaatatttttgaaaaatcttttttctcatacataggtcttaacaagtaggattaaaatattcaataaactatgctataaacagatgctctcatccaggctttagtgtcgccgcctttattatcttagctagatcttctggataacttgctaaagcttctccatcagcacttgctgctttaccttgaacttttatgttatggagacagcttctttcctgaaacctcataaagcagcttctgctagcttcagacttttcttaggcagtttcctcaactctctcagccttcacagaatgttgctgactttctccaagtcagcaataaggacgtgctttttaaattatttgtgtgttcactggagtaacacttttaactttcttcaagaacttctcctttttattcacgacttggctgtttgggacaagtggcctcatttttagcctatctcagtttggacatgccttcctcactaagctcaatcatttctagctcttaatttaactcaaatgatgtgcaattcttccgttcacgcgaagaattagaggccatgggaaagttattaattggcctaatttcaatattattgtgtttctgggaatagggaggccagagaaaagggagagagctggggaagtgaccagtgagtagtcagaacacacgcatttattgattaagtttataattttatatgtttcattgaagc

SEQ ID NO: 16557 - DNA, 6963 bp, Human
tcccttcttgttaaagaataaatcataagtgttagaaataatagtttattttaaagacgaacttccttcaagccccctcgctttacgctaataactctttgttaagccctatcttatatagctgttgaacagtcacaggcacgtagtacattccatgtccttgtaccttaaccaagatatttgtgttggacgtgctcataggtatgtcctagttcacagcctgtgccccttccttatttggaaatattattatttttgtacctattttaaaaagttttaaattattagccaatcaggttttaatttagattgtgaggtctggctccagccaatggagacaggacacagcaatagggacctcatgcgtaaggaataaatattctggtgtctcttcattctgtgtatgcccttgccattgttccatctgtgaggggcatcctttctgcagaaattaaaaattgcctcgctgagagaactttttgtctgaatgctgacttttccttgcagaactgagaaacaaacattttgcatttctaatgagtatgaaaattttttgtatagtgttttattacggatttattttactttaaactacatgtgaatagataaaaaaatataaataattagcttttttaaagcacatataaatattattagtttgtaaatttttgcaacttttaaaattcattttgtttatatatgcttttgaaatgagctcatgtttatataaatatatttagtttatttaatttaactcctgttagtatttcaaaatatattattttgtcatttatcccaattgatatagccatctctatttctgtgaacattttggttagtttttcaactgaattttaaattccagatttgctcttgttccctgattctgaatgggtatttaatgggaatttcagtaagcttttaatttcacatcactatctgtaacttcacaacaacagacaattgacttcaaaccaacaacttcatattccattactttgagcttacttaggcatcagctccctgcagttcccacctgcttggactttgagaacatctgtatcatgctagctacttatgctgaaaccttgctggaaacgctggcttaaatttacgtaactactaaaccttgtgatgtggtgtggctctgtgtccccacccaaatctcatctcaaattgtaatcctcataatccccatgtgtggattgaggaacctagtgggaggtgattggatcacgggagtagtttcccccatgctgttctcttgatagtgagtgcattctcacaagatctgatggttttataaagggctcttccctctccactctctcttgctcacctgccaccatgtaagacatgctttgcttccccttcgtctccatgattgtaagtttcctgaggcctccccatcctcaggaaagtctgtgagtcaattaaactatgagtcaattaaacctctttcctttttaagttacccagtctctggtattatctttatagcagtatgaaaaggactaatacaccttgccttctgaagtaggtcttgagaggttcctgaacctgaaagggaatggagaaatgacttaaagccaccagctaattgggcttaatcatttggactcagttgactcttcccctacccctacccatgcctaaaccaaagaaaggatcatcccacatttacctagcacaaagaaatctactcttctgctctttctaggactgctaaaggccatgggaactggacacctggatgctgcagaggaagagcaaagctcaacatcaacttggacagtttgccaacctgtttgtggtaagttgatgtcatttgtgaccactcctaatgtgtgccaggaataagctattcctgatgccagaatctcttactgtcagtgccctctgtaggccttctgatccttactccttgctccacccattgtttatatcatgtagttctctctcagaccctgatataaagctcctactctgtctgacctgacaagccacctcaagtggacaaggcacttaccaacaggtaaaggggcattacaggagaagagcatgtctaacgtgggattttctcttttcattttgaggtagatacagggtgattttctgaataaaagatcccagtagtaatgaaacttaagcaagaccaaagctgatttcgggtaatttggcctctgttatccccaaaccaaaagagaaatatctgggagtgtagctatctcagtggacctttcggctcacaggaattcagagaggagaggatgttagaaagataacaggtgctctgctctcttcttcaaaccctcttccctgtgttctcctacagagattgctgatttgctccttaagcaagagattcactgccgctaagcatggctcagaccaactcgttcttcatgctgatctcctccctgatgttcctgtctctgagccaaggtgagattttcccccacacttcccacaaccccaactctgaattcttccctccatcctcatgtataaggttcacttgaaaaaaagcagagtcaacatcagggtttttttatgttgttcagtgatcattatggctgattttatcccattcaaaaacaccctcacctcattcatgggtttgagacagaatttaataggaccacttataggtgaccattgtggttgagtttatctgattgaatctatatgcgatggcagtttgggggatgtttttatgtagtcattgctaggatggagagctaaggcaaacgtgtgcagggaaaccgagagaaacttgagaaaggaggaagcctgggtctttaaaggcagaagcctcagcctcagaattaaaggaaaacgaggactcatttatttagcctattcattgtgagctcttgtcttgagcagaggaaactagagagaaaagagataggatgcaggagggcagaagtgagcaatcgccccagtattcactgtatccatatgttcttataaaggacaccaagaagcccctaattcaccttccagccttttccttgccctgcgattctttcttaattatctccttttttttttccccaggccaggagtcccagacagagctgcctaatccccgaatcagctgcccagaaggcaccaatgcctatcgctcctactgctactactttaatgaagaccctgagacctgggttgatgcagatgtgagtgaggagagcagcaggggaagggaggcttatgaaggtagaggcagctgctaatttgcagtgtgttctgtggctgcaatgagataagattgatcccttccctattccaccactggtcccaaacttcccaatctactttatcccatcatttgacacattcccagcacagagatgctggtggtcagtgacagcatcatcagggacatttctgtgctgtcctttttctgttacatcctctggaaggtctcagtatatccctcacaccttccttctccactgagtgctccattttcttctccaacagctctattgccagaacatgaattcaggcaacctggtgtctgtgctcacccaggcggagggtgccttcgtggcctcactgattaaggagagtagcactgatgacagcaatgtctggattggcctccatgacccaaaaaaggtcagtctgcagccacctctatctccttataaacatttttgagaggtaagagggacgtttaaggtctggcaccgcaatcaccaacttttatctttttgtttgtttaaataaaagcaacctctttatagatcctataatgtatgagttgtgaagttcagtgtaggtagttagagacatgagctgaaggctgaattttctgggctctgggaattcatgcacccactcattgtgtctacttctagaaatgcatctttatgtacaactttttccctattttgctattgtctgtcttggaagaggtccctctgtagactatatagaaaatgagtagtggaggagaatctactgctggcatttgttatacattttatacaagtgtataaaactgtacagtatattatttagtttaacactataaactaaataatatatcaacaactactctacagccaatgttatgctggatatgagagttctgagattcaggaaaaaaatcagaaaccactctctgtaatgggcttttatgggtctctgtatcaaattctgaacacttattatttgctggaagaggaggaggaattcggacattctagagaaggagaagcttagagcaaaagcagaggaaatgatatgatattcatggtgacaacaatgtttattctttctgctataacttggcctgtttctgagtgtgcacacaggcctggttattctattgatttttgagtgaccatggcccctgttctggcccttctccatctagaaccgccgctggcactggagtagtgggtccctggtctcctacaagtcctgggacactggatccccgagcagtgctaatgctggctactgtgcaagcctgacttcatgctcaggtgagaggcagacaatctatccacctgttgccatttccttcccacttatctctggggatgaacatggggactgggatagaggaaaggtaagctccttatctggaaaataaagaagtatttcctctagttttttgttctgagtcctaggttgaggaggggctacactccttctgatcctctatgtctgacacttctcattgtactataggattcaagaaatggaaggatgaatcttgtgagaagaagttctcctttgtttgcaagttcaaaaactagaggaagctgaaaaatggatgtctagaactggtcctgcaattactatgaagtcaaaaattaaactagactatgtctccaactcagttcagaccatctcctccctaatgagtttgcatcgctgatcttcagtaccttcacctgtctcagtctctagagccctgaaaaataaaaacaaacttatttttatccagtgttctgtcttctgcatttgctctttctacagcccatgcttgggtggttggggtgggaatgattgtcacactccagagcttgccatggcccatccacttgttaaaaccccactcacattttatgtatgtcaggcttatgaacatgtggtggccttgtttatgacaagataaaaagattaagatttcatccacaacacatgttagcatgaacctagtgtgaattacacaaataattaaattgttgatccagtctgactggagtatttaatattccagaagaattcgcatagttggggtctgaggagaacacatctgttcttggttatgcaatttgaagtcatgactgaaatgataacttaaggagaattgtcaggtctacggtcctgagtgcattagtggtacatttttggaggccagcctgcaaagtttgttaaatgctactccttggatgaatgaataagtgaatgatcaattatgtaaattaaatatacaggcatacttaatcatctctttaaatatcctaactctcaataaagttaaattctgaaatattactcttaggactttcacaaattaattgtgcagggacacagttcagcccataacatcaatcatatcaataatagagttaaatgtgatttgataacaaaggaaacaaattgtcagcctggattaaagtaacaacaatgaaaacaagattcaactgtatgctatgtatgagagacatgagttaaattaagacacaaatagcttgaaaataaaaggaaggaaatagacatatcttgcaaacagaaaccataagaacactggtttctgtactgttacccagtgtaatgcctatatgagattgctgaatttctaccctgtctgaactctgcttatctttaagaaacagaatgcctgtggtaaaaagtttcctttataactagtccagctgatactggttagaatcaagatcaccatcaaaggacctcagaaagacatctggttcattataatctcatttccatgctaaatgacactcctaccagcacaatgacagctgacaatcaccatgacaatggccagaagaagcaataaaggtacaaaaaggaagcacactctggttcctaggaagttcacaacctatttccagaaaagacatgaatattcctccctttgtttttaatgcccagtcctttcattggagaaaccctatattttaaccactttacccctcactagcagagaagccaatttgtgagtcatgttcctgcttctcaattccatggccatcaaataaatcctgcagtgcttgacactcactttctgtttcatgtattggctttgtgacaccaaatagggaaagactccatcttttgggggactggttttgtctgcaatgatactaatatcagacatatttgactttaaagcaaaaatgttacttgagaagaaaaggagtattttataataataaagtagttaattcttcaggaagatgtctcaaaatacctgaaacaggtggaacccactgcagtgtgacaaagccgctataaccagactgcccctccggattcctcctctctggggaggacatctctgaaagaaaggcagcagcctcagtcaggggcttatagataaactcccatctccctgggacagagcacctgggggaaggggcagctgtgggccaagcttcagcagacttaacctttcctgtctgctggctctgaagagagcagcgggtctcctcgcacagcacgcaagctctgctaaaggacagattgccttctcaagtgggtcccttactccagtgcctgatgactgggagatacctcccagcaggagttgacagacacctcatacaggagagctccagctggcatctggccagtgcctctctgggacaaagattccagaggaagaagcaggcagcaatatttgctgttctgcagcctccgctggtgagacacaggcaaacagggtccggagtggacctccaacaaactcca

SEQ ID NO: 16558 - DNA, 67157 bp, Human
cccagtttccagctgtagggccatgtattcaatggcatagtgactaaagggctgttcagagaaccctgaccaagattaatttacctaaagttggaacagaaggacatagtcaagtttaaaatcaaatgctttgtgtggtggcagaagggagtgcctttgacggtttgcaaatgcagagaggcaaggattctccaaaagttcagaaaatcgtatgagatctgagtcaggaaaggattcaagaatccaccaccacatattgaatcatataggagccgagcactttatgagtatgctttttgtttgtttttgagacaaggtcttgctgtgttgcccaggctggagtgcagtggcacaatcatggctcactgcagcctcgacctcctgggctcaggcagtcctcccacctcagcctccctagtagctgggactgcaggtgcacaccaccacacctggtaaaaacaaaaccaaacacaactatagagacatgtctctgttgcccagactagtctcaaactcctgggctcaagtgatcctcccgccacagactcccaaagtgttgagattacaggcataagccactgcgctagggcttatgtgtgtacttaatttaaccctcatcctttaaggtagatattagtacccctattttttaaaaaaattatttatttatttttaaggcagagtctcgctctgtcgcccaagctggagtgcagtggtacgatctcagctcactgcaacctccgcctcccaggttcaagcgattctctgcctcagcctcctgagttgctgggattacagtcatgcgctaccacactcagctaagtttttatatttttggtagagccggcgtttcacccatgttgaccaggctggtctgaaacttctgacctcaagtgatccggctgcctcggcctccccaagtgctgggattacaggcgcgagccaccccgcctggctagtacccctatttttgtaatgaagaagctgaggtacaaagaggttaaacaacctgctcaaaattacgaagtagaagcctgaggtggggtatggtaatttgtgattctacatttatccaccatattaagtcaactgtgttaaatcatgttgaaggaagatgatgcgctgtgatctgtaatattggtgcagttcagcattaccgtggtgcagtgtcaagttccaaaagacacaaaactgtctgatcggcctgtagcgcatcaccgcccaccagcagtacctgaagacgctttcagtcccctgctagtgccgtacggagtccgggctggtccatttacattgaaaacaaactgatcctagcatctaagtcacccagacatcttttaggcggcaagcttttcagacagtttaacacatttattcttgttttttcaaaaagagcaaacacgtggcgttacaaaggtcctccgtttcgcacgcaccggtgtcccggcagcgcgctgcgcgtcgggaggcccagtctgtcgtcccgtggggccgggggtcaggaggtcgggcaggcgggatttggggtttcgcgtgttccggaccggacacttcgccatcttaacgagctaccgcccgggttaaggggcacccagggcaggtgcccggccgggggtggggtgtccgagccgccggtgcctggacgtggacccctgcaggaagggtccgcgcgggaagcgagctctccacgagtccatgacagcaggcccgcgggggcagggagcctgcgccaggcagtctttctagatcctggcccagcctggccgctttcgcgcccgtgctccttttcggggatcctagagcgacgcgcagagcggaccaagggttcccccagcgcgttctcgccgcctggcagctcgctggccacgcccctccgcttccaccctgccaccggcccccgccgccgcaaatgtcgcgagaccttcgtccatcctcccggcgtggtcccgctgcccacggcgtccagagcgcgcacgcaagccccgggagcgcgggacagacagggcacgctgggtcggcggagctgaggctcccagctgtgggcctcgctggcccggccgcccagtctcgcgagagttgggagtaaacagccccgaatggagtgcccaggcgtgttcgccgcggaggcgccgtcatcccgggcccgccggccctgagctcccggcggcgcaggtacgtcagccgcccgcgcgcggcctccccgacccgctccgcctagcggtggcggcccgctcgctcaggtgtgccggttgcgtccgaggccccgaggcgagggctgcgggggccgggccgggtcgggggaggtgggcgcggggcctccggcgcttgtttggacacagcgtgcctgtaccgcggccctgcgggggtctgcgcgctccggcagcttgttccgttgcctggttttctttacgtgaaatgagcattcaccgagtgaaacaatacgccctgctctggcccggagcctccagacagactcaattctaggtgcgcttccggggcagtgctggcgtcaggtttaaaagacgtcgattctttgccttatctcggtctgtgcatattgcgctgctggtttttggaaatgcggggattctgttcggcgaactctcagaaccagattgccttttaaacctgtagcttcttaaaaatcttgcctcgccttggcatggttgcgctacctaagaccgttgtggatcgtcagtatttttattaagatgtttacctttcatattgggttgagcccctgagaatcttggcctatttgtctacacaaattaagttattagattctgattgacacttcgaaattacgtggagtggaatacgacctgcgttgaattctggagactcatcctttagtctgaactgtgtaggtaagccctcctaacgtcaaggtctccaattgtatgtctacgaaaaggagggcttgcagaagagaagtaattcctctcattttttttttttcaatctggagaatccgcttttattatttatacttattttttaatgtaagagcttcattgaagtagaatttacataccataaaatccacctgttttaagtgtactattcagtggtttttagtaaatttacagcagcacagccaccaccaaatccacttttagaacatttccgttaccccaagacctctgatgcccagttgtagtcaatgcccatttccaggccccgccacaggcaacctttcatctactttgtctttctagatttgcctttaatgactatttcgtatattcagatggaaacatatgatatgcggccttttgtgtcaggcttctttcacttagcatgttttcacagttcatccatgttgtagcatgaatcaggatttcattccttttatgaccaaataatattcagttgtatggctataccacattttgtttaagcatttatgcagaacacttttgacaaataaaagtttattttatgctctaatgtgtgatgcggatgacagcaaaactgttgattgagaatgggagctgggacctgacccagacacgtgtcaaacgactgcactccccaggcaccccgtataatcaagagttggtcctttctatataaaaagggaaaaatccaatgcagagcttgcggaacctttgaagcacctagggaagaagtgggagctcttctagtcaggaggttaacaagaactaggaaggctgggccgggcgcggtggctcacgcctgtaatcccacaatttgggaggccgaggcgggcggatcacaaggtcaggtgttcaagaccagcctggccaacgtggtgaaatcccgtctctactgaaaatacaaaaattagctgggcgcaatggcaggcgcctgtaatcccagctactcgggaggctgaggcaggagaatcccttgaacccaggcggcggaggttgtagtgagccaagatcacgccgctgcattccagcctgggcgacagagtgagactatgtctcaaaaaacaaaaaacaaaaaaaaacttggaagactgaaggctaaggtgaactgtacattgctgccatcagtgctgcggaattctgcttgaggaaacgctttatttatttttatttttttgagacagagtctcgctctgtcgcccaggctggagtgcagtggtggatctcggctcactgcaacttctgcctcccgggttcaagcgattctcctgcctcagcctcccgagtagccgggactgcaggtgcccgccaccacacccggctaatttttgtatttttagtagagacgggtttttaccatgttggtcaggctggtttcagactccttgacctcatgatccgcccgcgtcggcctccccaaagtgctgggattacaggcgtgagctaccgcgcccagctgaggaaaggcattttaaagtaaaataaggaagttagaagtttggaggtgccctatgtgtggccagctaatactgcatgactaaggggtaagaataaaaggagacaagagtgatgtgtgtgaaacagtaggcagtgaagacaccacagaccaaggtttctcactcttgactgtagtgatacattgggatgaattttttttctttttaatacaagaccacctgatggatggagtgtgccagaataaatggttgcatcggatgtaagaatacacccgaatacacctttgtcgaccgggcgtgatggctcacgcctgtaatcccagcactttgggaggccgaggcgggcagatcacgaggtcaggagattgagaccatcctggctaacacagtgaaaccccgtctctaaaatacaaaaaaattagccgggcgtggtggcatgcgcctgtagtcccagctacttgggaggctgaggcaggagaatcgcttgaaccccggaggcagaggttgcagtgagctgagatcgcgccattgcactccaccctggcggcagagcgagactccgtctcaaaaaaagaaaaaaaaaaaaaaaaaaaagggaagacacctttgttttaccatagtttggtctggcatgacttaattgttagcctgttaaacaatggtaatatagccaagtatgcaattagttctgaaggtggtagtttttcagccgacttttaattggactggatagtaacctttcgtggtctaaacacaattcagtctcctttggagctattttagtaaactagtttattacaaagcaaggcatagctgcataattagatgattgtcgggtgatacaagtcattttcactcacctaaattatgttctaattatttttaaagagataatttcagatgtattttagttatgcccagaattataatctttgtgatattcttttattgtgaaaattgtaagtgggagactccaagagctgcaaagaatgctagccaccagctaggccagttgcttgcgcaagtaatacatttcttctactgagtctcccttctactcaaatcccattaaatactattttctatttctataatttgaacggtgtctttttcagttagtacttgatgtcaaaaatttttaattatacgtgtattagaggtgtaatcattctcatgaaaaacccataggtacgggaataccatctttgaacgttatgcctttatatggaaagataaccaggtcttctgcataaagaatttatagaaattaaatccagttaacatttagtggatacagtaacagccctaagtaggctctctaagttaagtgatattacaaatgataataagcctttcagaatgaactagccaaaagtttaatattttcaaaggctatcttttccttaggctggcaagtagctgtagacagatctttgagaacaatttgtaggagatagatcccttttaagctctagtatatatacaaataaaattaaatctagcatatatatttgaatttttgtgccactctcttaccagaaagtatgatttattcttttttttttttttttttttgagatggcatctcgctctgtctcccaggctggagtgcagtggcttgatctcagctcactgcaacctctgtctcccaggttcaagcgattctcccacctcaacctcctgagtagctgggattacaggtgtgtgccaccacacccagctaatttttgtatttttagtagagatggggtttcaccatgttggccaggctggtcttgaactcctgacctcgggtgatctgcccgtctcggcctcccacagtgctggggttatagctgtgagccaccgagcccggcgtattctttttttgttttttttttttttttttgagaccgagtctcgctctgttgcccgggctggagtgcagtggcgtgatctcagctccctggaagctccgcctcccagattcacgccattctcatgtctcagcctcctgagtatctgggactacaggagcccaccaccacgcccagctaattttttttgtattttttagtggaaacggggtttcagtgtgttagccaggatggtctcgatctcctgacctcatgatccgcctgcctcggcctcccaaagtgccgggattacaggagtgaaccaatttatttgaaaagtttttaaaaatactaaaatatgttttatctaagtataaaagtaacatatgctccctataaacaaataaattaaagcagaaattaactatctgtaatcatacaattgaaaggtagaaccactgtaaccattttggtatgtgtctttcagtggttttttttgttgtcattgtttccatttgagacagtctctccattgcccaggctggaatgcagtggctttatctccgcccactgcaacctccacctccttggttcaagcgattctcctgcctcagcctcctgagtagctgggattacaggcatgtgtcaccatgcacagctaattttttgtatttttagtagagacagggttttgctatgttggccaggctggtcttgaactcctggcctcaagtgatccgcctgccttggcttcccaaagtgctgggattacaggaatgagccaccgcacccagctgcatttttttttttttttgctcatagacacattttaaaattgaaatgtaaaaatttggattatgtggtgcatgaactgttttacttaacatttcattagcatttccccatatttctattgtaacaaatgaccacaaacagtggcctagaacaacatgaatttactgtctcacagttctggatatcagaagtccagaatccgcctcactgagctcaagtcaaagtttcagcagggttgtctccgtctggaggctctgtggagagaatcagtttccttttgtttttcagtttctacaggccacctgcgttccttggctcctgacttcttcctcaaattatctcaacctcttgattgctttcttttttcttttttttttttgagatggagtctctctctgttgcccaggctggagtgcagtggcacagtcttggctcactgcaacctctgcctcccgggttcaagtgattctcctgcctcagccttccgggtagctaggattacaggcacccaccaccattacctagctaatttttgtattttttgtagagacggggtttcaccatgttggccaggctggtctcgaacgcctgacctcaggtgatctgcccgacttggcctcccacagtgctgggattacaggcgtgagccactgtgcccagccagcctgttgctttcatcatcacatctattactacctgttgtcatctcctgcctctctcttatagacacccttgtgatgacacctggcccacctggatcaccgaggatactgtctcagtgccttcatttagtcacagctgcaaagtccctttggcctgtatgcttttgtgtgtaaagtaacattcccaggttctaggaatgaggatgtgagcatctttgtggggaccatttttcagcctactgcaggaggagcatttgaaattgctgcgtggcgttctgtggtgtgcaccgaccataattattgagccagtctccttgtttatgcacattcagatggtctccagcttttcctgctcataatcttgcagtgtgtatctttggacataaagccttatgtgcttccagattcatacttcttggattgaatccctaggggagattttaggaaagcaggcgacctgcctctgaagagtgtggcctctggagccaggctgaccacctgagttctcagcccagctgttctacttgctggtgttgtggccccaggcaagttgcttagctactctgggtctcagttctcatctgaaagtgggggtagtaacgggttgttgggaggattaaattagttaatatttgcagactacttagaatggcacctgctacatcataaatgctcagtgagtgtttttcttattttggatttgttagacgaaaagtttttaatgttcatttttaagcgttttaatacatatgtgaaaattgccattctaaaaggttgtttttttttaatattcaccagcaacatatgagagtacttattttattggatttgttaacttaataaacataatttttattctagagggggtgcctcaggtttttctgtcaaaatgttacttgatttgtttaatgtaaatcatagaaacacaggttaatgttagcagaaatttaccatgaatcctttcaggaattctgtcaatttcctagaatgagatatgcttttagtttccctttaactagctcagtcccatctttggatgtccttctacgtaacaattgatgagtgtaaatctgtctgacgtgtgtggtctggttatgtatgcagtgatcagcactgactgaatctgaataagaggcttagaatgtgcctgtcaccacatttaaaatagcccagcctcatgcgtccttggcaggtgagggtaaataaagaacttattttttctgcctgttttggaaacaggctgaacctaacaggaaggttgcacgaacagtatgaaaccattttttctctaaagcatatgagagtaaattgcagacctgatactccattatcccccggtgttttagtgggtgtattttccaagcaaggaccttcttacataatcacagcacagttgtcaaaatcaggaaattagtcttgatacatcactaccatctgatccacgggcaggcttacttgggttttgccagttgtccctgagtgcctgttacagcagatggatccagtttggattcatgagttgcactgactctggagtctccttcaatctggggcagtagctcagtcattcttgcctttcattaccttggtgcttaggaaaattctaggccagttgattctgtagaatgtccctcaatttgggttggtctgatgtttctcatgatttgatttcaggttgtgcatctttgtcaggaacctcccagaagtgatgccggctcttctcagtgcatctgctctcgtagacctggctccgtgtgtcccattactgcttcccttggacaacttggtggagcttctccactgtaaaatgacttttccctttgaaaagagatattttgttggcagttgggcattttgacatgatgtaaatatctcattctttttcaaacttcatgtcattgtggactcctgttttcctgttttattccacgggttgggatctgttattatttatcgtgatgctcagattgtcccggattttgttagtgggggccccaccaaactggcttccatgttccttggacacttccccatcattctgtgagcctttcctcattgagtgacactgttccaaacccatcttgttcttaccgtacccagactggaactagttctttgtccaaagagcctaggttcttttagtggagagtgatatttagaaccaattgtgggcagtaggtgggctccttgctgttgggatttcactgctgccacacccttttggagatagctaggaaatgtgtgtagcacgtacacgtgcacttagatttctttctttctacatctgttagtctatgtattgaaaaccttaaattcagaccagcatttatcattttgttctgatactgaatggttcatttattttttctctttcatatttctaactttcttctctgacagtaagaaagccgcatcccattatatgtaaaatatttatttgatcaaacagttttaccttcactgctatcaccccactgcctgcctggtgccttcttcacttgccaggctctgaccccctcacctggtgcctctcccttcacataccttcctcactccgctcagactcttaagaccctgtagtgggcttctgccattctcccatgaacgcctgccttcttgtcttcagcagaattcttcaggaagggaagaagaaaaggcagagttagcactctttagaaagtgcttttcttgggctgggcgcagtggctcacacctgtaatcccagcactttgggaggctgaggcaggtgctggatcacctgaggtcaggagttcgagaccagcctggccagcatggcaaaatcctgtctctactaaaaatacaaaaattagctgggtgtggtggcgtgtgcctgtaattccagctactcaggaggctgaggcaggagaatcgcttcagctgggagttggaggttgcagtgagcagaggtcgtgccattgcactccagcctgggcagcaaagtgagactccatctaaaaagaagaaaacagtgcttttccttaggtttgtgtgtctgtatctgtgtgtgcatgctctgtctgcctgtcctgctgctgcttgtctgcttacctctcagtggtgagcccatcttgggaagtgtgcccatcgggtttgcattgtatagtgagaaccaggagggaccattcgtcacagctgaatagatgtattagaccctggaaagtgcagtctgtgcttgcaaagcgtcactgacttgtctagtgagtctgtggggacaagatctctttaggcccaggccagacacagtggctcatgcctataatcccaacactctgagaggctgaggcaggaggatatcttgagcctgggagtttgagaccagcctgggcaacaaggtgagacccccatctctacaaaaaaaaaaaaaaaaaattagctggacatagtgccgtattgtagtccgtgcaacttggtaggctgaggtaggaggatcacttgagcctcagaggttgaggctgcagtgaaccatgattgtgccactgtcctccaccctgggtgaccaagcgggaccctgtctcaaaaaaaaaaaaaataggcccaggagttcgggggttggtaataagctcagccttggggaccccagtccctctgccatcatttactggtctcttgcccccgttatggcatttttgttttccttaaaggaaatttatattttgaaaccaccttattctaggattgggaaactatagaaacctcaggatctgttgccatattttttgagccataaatcctttgaaatagtcttgatagagcctggattttagctcaccttttaggaacgcaagcaagtccacgagatccaaacacagcaagggggtgtgtccttgtccctgtcatttccagccttatcattcatccccatgggatttttacacttgaaggcaccttccttccagccactggtggcttggtgactagagcaggtgggctggagttgacaggcttggtaaggtacagtctggcggccaggctcacccgctcactagtgtggcccttttctggaaggggccagttactaagctagtggtctctgtctcttcagcttgcccaccttccttttgcaaattatttcccactgattttggtttccttctgactttcctgtgccctctgtcttttgccatctctgaaagaaaaggtactggattgcccgggattctgccctaagccgtgcccttgaccctgaggctcatccgaaattgaacatgctcagagctcagctcctgctggtgtctcccaagtcagctttcctgctgtcttccccatctcaattaggggcaagcaccactggtccagtcgggcaaccagccttggtgttgccttgaatcctcacttgtgtgcccccacatctggtggacagcccatctgtcacttctgccttcgtatctgtaatgtcatcgcctcttatcacctcccctgcccgccctggtccaagccagcatcttctctcccttggctcttgtacggaagtcctccagatgctccctgcctcagcctgtgcccccttccacaccgaagccagagcgatctggctaaaacacaagccacacgtgctcaggactgcctcatgctttctcttcccagtcagaatcaaagctgaagtcctttctgtgacctgcaggccttccctgggctgtctcccggtttcctcagatttcatctttggctttcccttgcttcccgctggcctctttgcctttctttcctcacacacacaccaggaatggtccttgccccagggccttttcacttgctttcccactgcctggatcctgtttccccagacccttggccagcttcctgcatccttcaggccttcactgaaaagaccccttctcagcagctgctgtaggtagtgctgtagcagaaacccagccctctcctgacttgtcatattccttttctttgtgttttcttatttatttattattattattattttgagatggagttttgctcttgttgcccaggctggagtgtagtggcacgatctcaactcactgcaacctctgcctcctgggttcaagtgattcttctgcctgagcctactgagtagctggagctacaggcgcctgtcgccacgcacgactaatttttttgtttttagtagaggtggggtttcaccattttggccaggatggtctcgaattcctggcctcaggtgatccacccgccttggcctcccaaagtgctgagattacaggtgtgacccatcgtgcctagctgttttctctccttcccaaatgtagtttttatcaccagctaaatactgtatgttttacttgtcttagttacggtctgtctccctgcactggaaggtaagctccgtgaggtcagagatttctatggtattttgttcattactctatccctactcctagaacagtgcctggcttttagtagtttctcactagatgagttggatgggtgaacacaggagctcagcagtctcgtcgttgggctgtgttttatctctgtgctcttcactgccattggatggaagaggtccgtatttccggctgttggctggggtgtacctgcttgaggtcctctcttcccccctcgtctttcagcctcgctagacggacacctccttgcctccctcctcaggctgggcagtgctgatccttgtgcacatctgtgtcttcctgtggttccagtgttgccacgcttgggatgctctgctcctccctccctcacgcccatctttcagtgctactgagctcagattcttccagagctgctgcagtgccccctccccagcagaagccgcctcttcacagcccggagagaactgtgtgtcagttcagcatctgtggcctggatgcctgcctctcctttcacattttcatttcctgcattttgtttagttgtccttaaatttaactagatcacacttggaaggttgtgccctgactagctaatagtccgtgtttgttctgtagtacctgatagtatcttaacttggtaagtattctaaaattgcctgatctaatgaatgagttaaggtaaaatgtcttatgataataattgccttctctgttttccacataccccacatttattattatttttaatttggggaagaactgattaccttagagagtttttttcatttatttattttttttttttgagacagagtctcgctgtcacccaggcgggactgctgcagtgtcccaatctcagctcactgcaacctctgcctcctgggttcaaacgattatcctgcctcaccctccggagtagttgggattacaggcatgcaccacaatgcccaactaatttttgtatttttttttttgggtcggttggttggtttttagtagatatggggtttcaccatgttggccaggctggtctctaactcctggcctcaagtgatccgccggcctcagcctcctaaagtggaatcacacccaggattacaggtgtgagccaccgcgcctggcctttttttcatttgaaaaccgccaaatcctttcttttcatttcttttaaaggcaagtacctgcctaagttgtaagagaacatcagccatctcttctgcatgggctgtgttaaaatttcttacctaagagtctttacctttgagtgaattattttagaacaggttgaattaaagttgatttaacccagttaggtctaagattttctcagtactattacttaattatatttgtgttatatggagcccacatgtgtcatagattctttagcttgaggcagaaaagttttaagaggcttttttgtttgtttgtttgttttttaagtggagagagagtctcactgtgtcacccaggctggaatgtagtggtgcactcttggcccactgcaaccctccaggctaaagcaatcttcctgagtagctgggactataggcgcgccaccatgcctagctaatttttaatgttttttttgtagagatgaggtttctccacgttgcccaggctggtctcaaacctctgggctcaaatgattgttccttcctttttaacaacaacaacaaaaagcctgccttgagtgagaaacgcatttaataaatatcttttaaatatatattcatttactgtgatatgagaactgttattactggcttttatcttcttcggccagtagtctttaattaagctagatacatgcttcatgtcattattttctttggtactccattgctggatgtatcaagcataaagaaactaagaagtaggggcttactcctgagcaaacttctgtcaaacctgttagggtggctttaggtgccctctgcttttctgatctttctgtttggctctttgtttttgctcttgcagttggcattgttattgttgttcttgtcgaggtggatgtaactgctttaaactttgactcatttctgatgagttccacgccccttagttgccagtgccagtgccagagatgggcttgtttttcaggatcagttgttagtacagcagtgaaagtccctctttagtaaaagtaaaaacgttttttggatattttaacccctcacggtactttatcaatgtttttctactcgtagaagcacatattgatatttccagaaaccaaaaactcagaagcaccagtttctgccagaagaatgagttttacagcttgaagtaccttttgtaatagatgacttaactccttgtccttaatgttttctttttaaaaacaagtagtgggcggacatggcggctcttgtctgtaatctcaacactttgggaggccaaggtggctggatcacctgagtttgagaccagcctggacaaaatgccgagactgcttctctatattaaaatccaaaaattagctgggtgtggtgatgcatgcctatagtcccagctactcgggaggctgaggcgggaggattgcttgagcccaggaagttgaggctgcagtgaactgtgcagagattgcgccacccactccagcctgggtgtcagagtgagacccttcctcaaaaaaaaaaaaataataataataataataaaatcctaagtagcactggaaggcctctcttgcttcatttacccatcccctaccctgctggattatttacgccccgggtatggtctgtgcaactgtttttctggttatgctacagccagcattgttctttactatcgctctgttttcattgtgaagaatggcagtttttcttacaattcagatgttttggaagatatctgtgcgcatgcttaatttaatattcaggtgacatttttctttagcagtagtttccctcacaaactgtcttctcatgtcactccagtaaagagataatctggttttataacacatttagcaggttacatttctttaagtgtgaggtttcaggtaaaataaatttcaggacagtaaacccttttatgcccttttcatagaattggtagaaaatatttcaaactatgtaatattaaagcatagtgtttcttaaagaaggtgttaaatatcactgatagggaaattactttgctgttaggtattaatgttacagcagaaagtaaggctttataccaagcttttgcctgaaaaattgatgaaatttgtgggaagtaaaagtgccaactggggaaatgctctggggattgagttgcaaatgataggaaatacagaatctgaaacagaacaaaggatcatcctgatgccttcttctctttggctgctagaatgctcaggtccagtgtgcttaatatttttggtgttattttgttgtccttagttttttccatttttctcattgattttattgttttatttttgaagatgcctaaaaaaaattttcccgtgaaagcagtgagtaataagtaaataaaaatgaaataatatgtttcatggttgtatggcacattaatttgtcttaaaaccaggatatctcttttaccctcttatttattttattattttattattttagacatagggtctcactttgttgctcaggctggactcagactcctgggctcaagtgatcttcccacctcagcctcccaagcagctgatctacaggcacctgccaccttgcctggctgacccacttgcttaaattataaatacaactaaatcatacctggctatgtcagtttgctactaatgtctgtgtgcactgttttttgtttcatagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgattagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatggtaatgatgttgtcttaagtattaggaactcccatcctatttttttaaagcttacttaatataaaattagctattgctgaataacatgttcctcttttctacagtaaatttctttcttttttttttttttgagacagagtctcactctgtcacccaggctggagtgcagtggcatgatctcggctcactgtaacctccacctcctggattcaagcaattctcatgcctcagcctcccaagtagctgggattataggtgactgccaccgtccctggctaattttttgttttgatttgttctgttttgttttgttttgtttttgagatggagtctcactctgttgctgaggctggagtgcaatggcacgatctcggttcactgcaacttccacctcccaggttcaagcagttctcctgcctcagcctcctgagcagctgggactacaggcacccgccacaactcccagttaattttttctatttttagtagagatggggtttcaccacattggccaggctggtctcgagctcctgacctcgtgatccgcctgccttggcctcccagagtgttgggactacaggcatgaactatcgtgccaggcctttttttttttttttttttgtatttttagtagagacggggtttcagcatgttagccaggctggtcttgaactcctgacctcaagtgatcaccctccttggcctcccaaagtgctgggattacaggcatgagccaccgtgcctggccttctgtagtaaatttccaatgggttgagtgcacagcacatgaatgttaactttgcttaagtttgttttcccagtagagtaagcttatatgataaaaggaaattgacatgaattatttacctacaccttcttttctttttcttttggagacagagttttgctcttgtcgcccaggctggagtgcagtggtgccatctcagctcattgcagccttggcctcccaggcacaagtggtctcccacttcagcctcctgagtagctgggactacaggcacctgccaccgtgcccagctaatttttttatttttgttttttcttttttcttttttgagatggagattcactcttgttgcccaggctggagtgcaatggcaccatctcagctcaccgcaacctccacctcccaggttcaagcgattctcctgcctcagcctcccgagtagctgggattacaggcatgtgccaccatgcccggctaattttgtctttttagtagagactgcgtttctccatgttggtcaggctggtcttgcactcttgacctcaggtgatcctcctgcattggcctcccaaagtgttgggattacaggcatgagccactgtgcccggcctgcccagctaatttttttattttttgtttcaccatgttgcccaggctggtcttaaactcctgagctcaagcaatccatccacttcgacctcccagaatgctgggattataggcatgagccactgtgcccagcctacaccttgattctttggaacaggtgccattgtaattggtgaaggtggggagctgggaggtgcagaatgtttatgttctaaagtttgagtgaccagatgtgaagaactgagcaaatagtctcacataatccactctggaattttgttactgttttcgttttaagaaacactaactgagcattcagttctctgaatttctttttcctacttgataaaaattatatacatttctttgttgtgtattcaaacttctgtaggtatttgctttttaaaaaaatatcacgggtatctggtttcgaatgatgtattctttgtggttaggtgattcatagagatctttttttttttttttttgagacggaggcttgctctgtcaccaggcaggagtgcagtggtgcaatctctgcttactgcaatctccgcctcccaggttcaagtgattctcctgccttagcctcccaggattataggcgcccaccaccacacccagctaattttttgtatttttagtagagatggggtttcactatgttggccaggctggtctcaaactcctcacctcgtaatctgcccacgtcagcctcccaaagtgctgggattacaggcgtgagccaccgcgcccagccccatatagatcatttttcctcaaagctctgcagacagctgtctaggtacttaaactagtctttgtgttttctctcgtctgctgtgggctttaagataatttttcttttgccagattttagattagatacaatatagtatatgttataatgtatgtgcgtaaatcttatttttgtttgtggtgattggtttcagaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatgtgagtattgtgactgtaggcaaatttctctctgctgtttactttgaaaatctcaaactgcagagtagttgaaaaatagtacagtgagtatccgcatccttccatctagtttgctaattgtgaacattttcctggtaggaattttttagtttagttttgtttagtgcgcagggtcggtgttgggggggcagaattattttttaaaaagagacttcgtactgttctggtagaagaaaatctgagggtttgcagtagtagatggtagtgatctttgtttctgttggaagcgattttcgccagcttcatctcaaagccttcagacttcaaggctgcggccgccttctcgtgctgaaagacgcgtccttgtgtctgcttcttccttgcatttcgcttctctcagtgtgtgttttattttttcttttcctttttatttatttatttttttgagacggagtttcgctcttgttgcccaggctggagtgcagtggcgcgatcttggctcacctcaacctccacccaggttcaagtgattctcctgccttagcctcccaagtagctgggattacaggcatgcgccaccatgcctggctaattttgtatttttagtagagacagggtttctccatattggtcaggctggtcttgaactcctgacctcaggtgatctgcctgcctcagcctcccaaagtgctgggattacaggcgtgagtcactgcacccagcccgatttttaaaggcactcttgcaaaacatgttttcctggggtttcgttttgtttttgtcaaagcctcctgaccaggaatggtcatgcatcagctgggttcgttgaagtcatcagctgtgcaggtgtgagcatggaagcaacttggcttttccttttcttctccagggcttagtctttcctacttcattacaattgggcttgtcaaaatagagtttagtctcaaatagtaaattgcatatttattaaatgatattttccaaagatatgtgttaccaaaggaaaagggttttttttccctgtttatcttaaatcaggttaacaaatttctagttctgttattatttacgatcatttctttcatcagaaggaagaagaaattaaaattttactcttctttgtctatcatattttaggcctaagagcctctgaggttttgctgcattaaacacacacacaaacacacacacacacacacacacacacacacacacgaagagaagtttaattttcatagtaaaaccaggtgtaaacttaaggcgtctgactttttcagagccttttctgctactccagatgttatgtattattctccttaaaaagcagtaacacttcaaaataatccaggaagataaaagccaatcaaacctgatacagttagccaaatgtatacattgcggtattttagttgactttattttttacttcagttatcttaaagagctctagaatgctttaggagacacggagttgcctaattttagcacaagaatcctagactctctggagatgggattcccatggacaccatctccactgcgtgtgttccgggtgcctgacacccctgtgaggggagacttgcccactgcgttcccatgccccttgaagttagctgtgaccttcagcagtaagcgtcttttccatcttgaagcctcagtttttctcattcataaaatggagatgatactccctacctcgtggggctgtcatgaagataacatgaaataatgcatatgaagaaagcttagtagagtgttcaagatgttgtaagtaaccaaatgttaacagtttctctggctgttactcgtagaaggttttgctttattttgggctgacaccattctcactctgcatcccacccatttggttctatcccatgggccataagacaaagcctatctgttttctacgtgacagtagttaaagatgtggtgaagatagctgtctttttgatatttgaagatacccatggtgtgtcccttttggcaattttttctctccaggctaatcctcagttcttgccatagttactcaggtgacttgatttcaagtcccctcatcattttaagtgttttcctttgaatgtactaatttttctaaattgtttgaaagctgtgaagccctgaactgagtataatactggaggtggagtctggcctgtgcagggtcaagcagagcaggcccattcctggtctcagtgttgctcttcagtcagcacctgcagcattgtcccatgctgttgacttaaagatcagactcagcagaggaatttcaattaagaaccgtttcagttggactgtgcaaatatttacttaccagaattgacgtgactgtatgtgtttccaggtccctgtacttaacatgggtgtaggttggtaaggctagaataaaaatgacagtgatttgctttagaaagagaactgtattggtattacagattttctcttcttaaaactgatttgaaatatgacttgttcattataacatggtctttgaaaggtaaagggaaaacccttaggccatttctgtggtactgcctttttcctccgctttttaaaaataaagagacttacagatagtaaaattcgtcctttttagagtatagtttggcaagttttggcaaaagtataccatcaaatatccaccaacaaaatcaagatatggaataattccatcaccctcagaaattccctgtctctcactcctgtgtagtccttttgtttttgaaaggtgaaattctagcagataagaatattgagaatattgagcaatatacagttgttttaagtcctgttgatatttgatggcttttgcctgcccaagaaatctagtgaaacttatagtaaaaataaaactcaatgaatgcttagggtcattttctttaacttttcccccttctggttcagtgagaacaagttgctgatgaaaatcaggtttttctttatttttattatcacaattagctttttaaaattattattatttaatttaatcagtctttctttgccttaccttggttagaaaatttcaagtagagaactatttgggagtaatatgacagctaaataacgtcctataattataattgcattgagactgtccttccagaaaaagaagataatcccactttccttcaaacagagtggcaaatggtaatcctccctgtgtttaggatagttttgcctggcgggtatcgtgtagttcgttttgctcttctgttctgatctttctctcccttgcctgtagctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgtgtgctattacccagggaaggtgcttatgggatatacaggtgtgtgctattacccagggaaggcgcggaaagtccagacatgcaggaattccatgttcgggactgcctagtgctaaagccctgcagccttccacatctaaccttcttactatttgtttagctggaggtagccaagtactcctcatctttgactcctgtgatgccaggcatctgtttctgtggctttcctaattgtcaccatttgtgtcttatttttgttaccatttctgaggttagaagggaaggctgtggagcacttctctcctattgacacatacacaaacgagcacagcgctgccggccactggcgctgaccgacaggcctgcagaagtctgtcacttcttggggaaagatggtccctgatctgggcaattccacggaaattagtttatcacttgagtttggtgtcctgaatgcagagtgactaagtaattgactatcacacctgctgatgatttgtttcagaacaggaagcagtgttaatgatcatgtcctgtgaaataaaattcagaacaataaggatttttcccttgctgattcatcatgaccaaaccttcatgttttatctaatgtgaagatttttaccttgacttctaaatgtaagccagtttcacctgctcccaggacagcgcagtttgcctcggtgtctttcgtatatccttgacttagggacccttacctctcctttgatctccttggcgccctgccctccaaaatatctgagatacttcaacttttaatacccggtggactggcatttcattaaaatgtgtgtctccccatggttttacctttttatgagaactccttgacaaaacaaattttctagtcatgagaaataattttttattccccccaaaccaaatgatttctgattttgtgtgtgcattttttaaaagtagcattgatttttatatttatctcagtttaatagattatttaacatagtattgatatgtacacagcccttttgccagaaagacattaccctctttacattggttagctgttaagtcatataggtattctgtattttttttctagatgctttctagaatttttggtcagacaggccagttgtatttcacattggtgttgatggctttggccagtatctggaatagacttactattatagaaaagtgcacactgcagtgatttttcttaggtgtgattagccgcatgtggtgttaattgttccttgcggcagagtttgctgtattataaatgagcagcattgaataaattgctgtccttattgggaataggaatggttcccccttttcccatttttgtgtcccgctccttgggtgtgtggtttgtgagtgttttgcagggcctccgagaaggtggggggtggagacctgtgataaattgccagaaggggagtatcagtaggtgccagcctggagccttgagaagcccgctaggagtggaaggggtggttctatcctgagtgctggtggcaattgaggagggtctagaaggattttctgcttatccttaaatcttatttggcggcagatgatggcattgctcctgctgtcctcttttcttagccttggctcagccagctgaccctgggagcagctgacctaacttatttgctctgagcagctttggccttccacaatatgtcattttctgtgggtcccaggaaggaatgtattttataggcaaaatccaaaatgatgatttcttcaaacataattgtgtttgctttcttttccgaataaggtgctaatgtaagagttgctgtttttgacactgggctgagcgagaagcatccccacttcaaaaatgtgaaggagagaaccaactggaccaacgagcgaacgctggacgatggtgggtctcagcagcagtgagaacgtggtcatgtgatcgactgagagtgtgtttagtgcatgattccacagtctgtccagcaattattcagacaagcccaaggtgttattgtgctttttgttgtggcagaaactgctctgaatacctcataggatgtcgggaggtagcacttcaggagagagtgggcatgcctggtgtgggggcagctccctgtcccggagagcgtggagtggctagacctggaaggggtgcttgtgccagtgacgtctaaggggatcgtagagcagcagcagaggccctcctctatccagcacttggaaatggaaggccgtggaactcatggcctggaatgttgcgtcctggcacttgctattcagtgtgttttatgggattgttttctttatggactgcagggttgggccatggcacattcgtggcaggtgtgatagccagcatgagggagtgccaaggatttgctccagatgcagaacttcacattttcagggtctttaccaataatcaggtaggtgttttgaggactcctgaaacttgaggaattcatactgaaatgtaaaaagcagaatcactggactgtacacacttgtgtaaaaggagtgcacgtcagtgacgctgagccattcatactgcagcacgcatgctcagtttactgttcctctgcctcctgggtggctccgcccttctcccaccaaccactgtgtcgacctaagttgaaccctgaagaccctgccgaggctactacttacgacgattctttgatttcccttgtttcttctctacctccaggcttccccaggcctctgtaccctgggtcggttgtctgcatgatagaacagaacaattgcagatagaataagtgtgcttgcctccctgattgggttcctaccaccttgagctgttttatttacctctgtgtcccgacacctggcattgtgttgggtaatgggagtttacaagccttgttccttcactcttcatttggaaactatagaaaagggagagggtcctagtatttgtttcttttttcgttatttattttttaaggttaatttttgaataggtaatgcatagctcagaaatgtcagaaggtaacacagtgagacccccacccctgtccccgtccagcaggttctttcctcactggcccgtgtgtcctgtgtgatgatgttcctttcttatacctcctcgtagaatttctttggtgtatatgagaaaatataagtacctggtcttttaaaaacctttaaaaacataatcttaatcattacattgcttctcttcctaccataaacttaattttatattttttaaaaaagcaacagctaaaggtgatccacaaagtaatgaagcttttgtaaggaacataggagcacttgaacatcagaagactaatactgtgaaataactgttactgctgccatttgtccttcagtctgtttaggaatgaagaaggttagatagataagttgaactattccaaaatgcttaacttaatagaagtgccttgggataagtccttttgtaggagaggggcggttgggagcttgggtgttatctaggaaggcattctttgtgtagagagctgtgcatttcacctagagagataggccacctgcagaacacagctgcctcttccttaggttcagctccaaggacttagaacttctaggtgttgtattttactctccagagcattatgcatgctcaggattcatttctggttttaagtaaaaaaaaattaagagaactacttgtaattttaaaagagccttagaaataaaaactgtcctagcactttaaaacttgattgaaacactaagcagactgttataatatttaactaggtatcttacacatcttggtttttggacgccttcaactatgccattttaaagaagatcgacgtgttaaacctcagcatcggcggcccggacttcatggatcatccgtttgttgacaaggtttgtggagtcactgcacacggggtttgggtgacagctcctgctctttcgcagcccaactttgcatcatatctagtgtgttggtggcttttcatccaggtggtgacagctttgtgagaacagatggctaatgacgtgagcttcagtgatttgcatgtcataaattgagtgggttagaggcctcagagtaggtgttgataaggagcacatggtgccttgctgatttttttttttttttttttttgagatggagttttgttcttgttggccaggctggagtacaatggcacagtcttggctcactgcaacctccgcctcccaggttcaagcggttctcctgcctcagcctcccaagtagccgggattacaggtgcacaccaccatgcccggctaattttgctatttttagtagagacggggtttcaccgaattggccaggctggtctccaactcctgacctcaggtgatccacccacctcagcctttcaaagtgctgggattacaggcgtgagccaccatgccctgccaattttttcttacctaaacatgcaattcgtgttttcctcaaagtgactagaaagtcagcatctgctctgtgcactgcgtgcttctccgtcccgggtggtatcctctaaaaatgcaagttgccagcacatccgcctttataatgggccagtgctgcttttttagaactgtttttagacgttgtgtatggttttttttttttttttgacagttatatgtttaatgaaagggatactttcattaaataaatgctccttttgtaggtgtgggaattaacagctaacaatgtaatcatggtttctgctattggcaatgacggacctctttatgggtaagtagccccagcagggatgacctcggggattttttcccccttaaataactgaaaaattgttatctgtttgtgtatctacctatggttacttgtttatgtctgtctaaaacttgtcttaaggatgttttcctcatgtaaaaaaatactataggatgtagatgaacacccaggtactcaccactcacctcagcagttgtcacctcaaggccggtcttccttctatttatatatttttaaaattttgttacaaatagtaatttagaggcctaaagtttttattctaactactttttttccccaaaaatcaatcagaaaagtgaatctattagggattctgcagtgttgatgagatctgtgtgcaaagcatccgggtaaagaggcaaacggaagaggtttctgcctctctctgaaagagcaggtgcgagcacagtgacactcattcacaggggaagtgctggcgggcctaacggcaacatggccggtgctttgggagttgatgagagggatcatttaggagggaggcagggaggacagtgtcacaggggggcctttgtgctaaacttaagcagcgtgagatgcgaaacatttgccactgaatcccagccagtacgctcctgtctggttagaggtctcagttttctttccaccagcagcttcattttattctctagataatgtttataagtcatttcttgtgctcgaagtttctgtaggatgctttacacaaatccagggcataagacaaggtgaagctatgtgaagttcatgtttgcatatcagaaaacgtgaatattggcattcataggactctagcctaatagttgagtaaatgatcgtgaaccttgttagaggtccagggttctggattttgctgtcgcatcagtgatacgtatcatgagccatagatgtaagtggcatgaacataccctcgctatagctctgccatgacaaacaccagttattaagtcatctcgtcaggtgttcttgtctcccttttaaatgttcctcccatttctgatgtccccactcaaggctggcactcatcggttcagagtcaccaggtgtcagtgtttcctagcctgttttccaatcttgagtcttttcccaccccagctcttccagcatggacatgggtgaaactaggtgtggaagcagacaggtccgacctgccacttacggctgaggcaccgtcacttctctgagcctcagctccctcacctgtgatgggagtagagagcagcctgcagagtacctatgagactgaaatcagacagcagggggagagcaccatgaatgctgatgatgctctttgaatggaagctgctctttttcttttttgtgcgtatttctactgttcaaacatatattgtagcagttttctaatcaagaatctgcagcagtttattattgcctaatagatgaaatccacatttttcttttgtttttcaaggtcttcagtattctaggctgaattgcaaactttttctgtaaagggtcagataataaatattttaggcgttattgtgtgaaagcagctgcgggtgatatatgtgtaaatgaacatgactgtgttccaggaacgctgtatttgcaaaaacaggtgtgggcctggtttggcccatgggccgtagttggccaactccagccacaatctcagttcaccttgatcttccacttccccatgtacaccttcctggaatgagtgtcctccttctgtttctctcaggtcttccgcaccccatccctctgcccatcctcctggccatacctgtctggattcccagctctttcgcatgctgttcggactgttttgtcacacgctggctgccgttctgaaaccctgtggcttttgtgggtggttgcactccgtagcttcttaccagagttgtgagtttatggtgtgttgaaggagcagagccttgccaggaaggccccatctccaccttgtgtgtacgctcatgctgcctcacacagacctggccacctgctggctgttgaagtgacagaacgtggcatgtgatcacggcagcccagcttgtggtgggtgtggttttttctgcttgggcatctggtgggactgcttccagggctggtctgaggacagtaacatgcatacgtcagcccctctgggaatgaggcacacatcctccggtcccctttgctgtggtctctttgtctgggtcctgtgcccttggtgctcctagactctgtggtgccagcaagcctgcagcctcacgtccctccttttcaataccagcaatgatttcttgatgcgttcccttattttttaagggtttaaagtacactaagcattatagggcttagcaggtagaggagggtgggaaggtggtatttttttggtcaacttcagtgggagtttctgtcagtgacttctgtaccagcctctgctccttgagttcctgggaatgtgtaaacatctagcatcagtcatcagaaaatcattattcgttcctctgaatgaccagctggtaggatattggtggccagtgggctgaggaggcagtaccactttttctcggtgtgttgggaattgtcagttaaaaacacactctagaaggagaacttcatgctgctattatctcttaagccacttggaatcagttgtatgtagttgttgatttgtcaaagagttcattttttttggtagtggagccataataaagcttagcaatgcagttttataactgagtgtctcatattttcaaatggttcatctttatcttgactttacggtttacacatttttgccattatttatttcactataatttctttgcagatctagtgcacttaaggtattggagagactctaaggagctcaagattacagagtaatgatagtccttctacagttccctatgaggagggtagaacaccaccacaggtcaatcgaaaacttaccacttcctgaccttggcagatgtaaatgtgtggttatggtttcttccaggagaagtgtgtgatttagctggggagttaagatgaatgtgctgggaacaatttgaaagtgatgtgagaatgtgtcgttaggtgataaattgtgattgtgttaagtgttgtgaggttcaaggcaagtacagatgcttaaggcttggattgctggagggaaaacgtgagccttgagccccagtgtgccaagttgacagggaggagaagaaaggaggggcgttgcaggtgagagggcgtaatgtgagcacagcatgaacgtggcaggatcatgcgtttcacaggacagccgtgaggagctgcacacgtcttcccacagaagcagctcatacagtgttagattgttctgggagtattcgccctggtttgaatcatccattttaaattatttctcttgtttttttctttttcttttcttttttttttttttggtctcaatatagcactctgaataaccctgctgatcaaatggatgtgattggagtaggcggcattgactttgaagataacatcgcccgcttttcttcaaggggaatgactacctgggtacgctcttctttgctaaataattgtatttagctggacaaactactgtggctagtggcaccggttgttgacgagccttggggtgtatttgtaagtgcacagacaccctcacattcacatgggaatagccggggctgtgagtgcctgcccagccgtgaggacgagagatctgggccccgtcagcatctgccacttcactctggcaagtccacagctgctgtgatgagcaccggctgattctaagcggtgtttcccagtttaacttattaattgatttctgaggaactcacctttaggtgaattggggtcctgcccgtttaccctatctagtagtggtaagcagtcctcctcagtggtaggtgagatgatattttttgggggaggggagccttaagaagttggagaaaccattgagaacagcttaatatcaactctgctaacacagaaacaattgtatttagctggacaaattcaaaataactgctacagttaataattcagctgtttggggtttaattatgcagcacattcacccacctttacctgtcaaagtttgatgaaaaattagacgctcgtgcagaacagcagttgggcacctttgccctcgctgtggccgaggggagcatctgcccttctcattcttcagggtcagagcatctcttggtgtttaacgtcacatgccacactcggaggcctcagataagtccctggaaagattcccaactgcctgggaacactgtgggcctcgtccacactgtagccactttacaggatagccttctgcctgagcctttgtcctgtgacagcgtcagcccccagcgtccccgccactcagccccaccaggggtccccgcctcccacactcacgtgcctcttcctggagctgacctgttggctggggaccattctctcatgtgacagtctgtgcagggcaggctgcgtgtcctcccatccacgctccctcagcatgttccttgtgctgccggataatgggaaactgcatccaccactttgtccccagctccctgtgtaaatgctctcaccgaactgtggtgagatgtcatccactttgtccccagctccccgtgtaaacgctttcaccaaaccgtgatgagatgtcacgtccatggccttcatcaccagccagctttttaatggcatttgagaaatgtccttccatcatcacagctgcagtggaggatgcctttactcggtatcccagtatgtgcatccatggtccttgggtttgatggtcagaaaagggcttcccttcaaattgggctcctgttttctgacagaatatgagatcctattctaattttcgttttgccccaattcttaagaagcttaagcaagtacttattaaaacgttatcccaagttagtcgtgtggttatcttgttccttctcagtggtttcttatttcctcttttacaaccgtttgaaacatccactcataccgtgtacttttttccttgtaaagaaacatgtttgggtttttttacattttaattttctaatttttctaacatatttctaattttaacttatctagagataaagcagtttccagtttctggtcttggtgataagccagtgtccactttccagtctggcatgtcagcaaaattaaaatacttatcttttaattgctttatgcctttgccattgttctggttgttataaaatatatttttaaaaatttactttctacattatcgtttaagcttattttctgtattgtagtgaatttctttgtttttttctctttttttgggggggggggcgggtgcggggctgagggggacaggatctcactgtgttgcccaggctggagtgcagtggcacaatcacggctccctgcagccttgacctcccgggctcaggtgatcctcctgagtagccgggactacaggcttgtgccactacatctggctaatttttgtattttttgtggagatgggggtcttactgtgtagcccaggctagtctggaactcctgggctcaagcagtccacctgcctcggcctcccagagtgttgggattacaggtgtgagccttgcgcctggcctggagtgaatttcagactaaaaccagtaccttcctaaggttatacagtttttaactaacccatatctctgttctgatttgattcactcatgattgcatgcggctgtatgccaatgtgcgagatgtagcaaccaagctgcttttattcataggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgaggtgagtgctgccccctagagaccagtagctcccacgtcaggacaggagcactcggtgccagcagagcaggagtcgtgtcttgcttctgccctgtcttgggtttgagagcttaggcccttcacagccttgctctgtctctccttcttcatctctgcaaagaggtaggagtcacttcttttatagttagatgaagtgaatgtgaacacactttataagcctaagtaaacaaagtgctgataggcaaaataacctgtttctttatgtttgtgttctgttttctaatatcccatttatgtgctagaactgtgatttttatatccaagcaagcataaatatcaggcagggaacaaatagtaagatatttccctgccatatatcctccatttccttggggattcactttaaaaaagaaaaacaaaaaacaaatcctactgcgtatatgtaagatatacagcatgatgttatggaatacatatagatagtaaaaaggaggttactctagtgaaacgaatgaacacatccatcttctcacagtgttacccatttgttgtttttgtgaaggggactcaccttttaatgttctctatagcaaaggatgtcagagccaccagggactgacagtcaccactctgctttgtctcactgaatctcatgcagttggaatggagcttagtgactggcccttaatcttgcagataatgaaactggaagaaagttctcaaggaggccgggtgcggtggctcacacctgtaatcccagcattttgggaggctgaggcagcaggtcacctgaggtcaggagttcaagaccagcctgatcaacatggtgaaaccctgtctctactaaaaattacaagttagccaggtgtggtggtgggcggctgtaatcccagctactcaggagattgaggcaggaaaattgcttgaacccgggaggaggaggctgcagtgaactgagatcgtgccactgcactccagcctgggtgacagagcaacactctgtctcaatcagccaatcaatcaataaagttctccaagcgagtagaccagagttgatgttcacatgttctcactttcatcggtggcccgtgtttctttactctcagttgtaaaaggatgtctttggggctggcatttatcttgttactgtattttccccaaaaataaattgtacttcttctatctagatgaagttttagttgagtgttgtgataacacacaaaactctgcgtatttggaagttattctatgctaatttaaaaattaattaatataggcaaatagtattaaatgtctttatattttaagttctctttaagtaaattgaatattgatttcagcttctgatgccagatattattttgttagtaatccttaataaagctagatacttggctggttgtggtagctcacacctgtaatcccagcactttgggaggccaaggcaggaggattgtttgaggctagtagtttgagagcagctggggcaacatagtgagaccccatctctaccaaaaaaaaaaaaggggtagatatccatctctttcctcctttctctgttcttcccttacagtttgcagccaaattcttgagaatgttgacattggccagactggcctttggagaataaccatgtgcttgctggaaacactgtcttctcttgccgttgttttcctctctccagtgttatatcaagtgaggaacagagtggagggaaggtggatagtgggctacctggcctgtttgcacacttgtatttgccaggtggagagaattcagttagggctgcagcttctaatgttgttgattctggaaacagaaaatactggttcatttctcctaaacgccatgattgttagcaggaagtgagggctctgccttcactgttgagcccgtcagctctctgctgttgagtaagcgggcagccgaggggttgttccttttcccagcagcttctttaagtacagatattttcagcaacaaggaagcctttcagtctcctcatctccctgcagcagatgaaactgccgttgtgatctctgtgtgtgacagtcgctcataatggaagccgagcagcagtggcgggcctcccgagctccagcctgatgatgctgtgaaaggcagtggaacgcaacccttgagttcactttataggcaggaagaggaggaagattgttgacccatagctttgagcacttcttttcttctgtcattaagaatctactttatctcctctacttatgtcagatttcccatttagaaaacctgcctagactccaacaccaaacatcatcacatacgaatatttaggaacttaggagagttaagttttccttttttgtgtactgatattcccacctcaattttaggaattaaaattcacttgtatttataatacataaatacacaaaaatggatgttgtaacgctagtatcaccaggctaagttcctagccaggtcacactgtgtgttaaagcttgttcagatgcattctcatggtgaaactgaaggtggccttaggtctatgtcgttctgaaaggcatcatccatcagggtggctcatcccagacaagcctcccaatctggaaacaaaaaggcaaggattggctttggaggcggcggtcctcactcagacctgtgcctcctgctagtcctgtgtcgtggcccctccccaggatctgaatgtgctcctccttctcccagccaggcggtgtcccatggcatcttcttcctgtgaccagcaggcttcctctccccagaggagtcagtacctcctatacattcatgccttctgcagcctatgtggttgtttagttgaattatcacaaaaatatgtgttactgatgcatttagcataagtgggtcccgtagaaggttgcggagtggtcagtcctggattgggtacagagatgagtgtgcactcattctctcatgcaggctgtgccagacaagcacctgttggatactaaacaagactgcaggcctcttgtgtgcacgtttgtaggttaggttttagtggtccaatttccattcttttactgagagaaaataggcaattcttgatttttcctccagcacagtccagaagcgtgagctggtgaatcccgccagtatgaagcaggccctgatcgcgtcagcccggaggctccccggggtcaacatgtttgagcaaggccacggcaagctcgatctgcttagagcctatcagatcctcaacagctacaagccacaggcaaggtcagtgcaccgccctgccgatgggtctttctctccttcactgggctctgggcgaattttccctctgcacaaaatacaagcctcaaaacagaaaatgatgactaagcacagaattctcggggtgcttggagaggttttgctgctgcttctacagggtgctgctggcagaactggtagctgctttcgcttactgatgtgatctttaatataaatggttaaaagtaatgatttctgagtggtttttttgcttttgttgtttactttcttagactcttgaaataatcttaggtttacagaaattttgcagaaataggagagagttgtcctacaaggttgcccagtttcccctgatgccaccatttcagatgagtggagtacagctgttaaaactgtcatacaaacactgacactgtgctgtaattcacctgcagaccacatacatctcgccagctcctgtggtactcccgtccggcctgggccctgctttgttttcacccttattttgaaatgattttagatttacagcaaagtttcacaaatagttcatgagaacccctgagtccttcacccagctttccctcaccttagtatcttccataacctcagtatgagcgtcagagtctggaaatgaaccttgatgtagcactgctgactgacctgcaggcttcacgcagattccgcccattgtcccacaggtcccttctctgggatccagtccaggatcccacattggatttcattgtcctgtcttcttggtttcctctaatcacagacggttcctccgttttccttcatcttgttattgggggtattcattttcatcatttgattaatgtggtctgtcagtctgggtcctccaagaagcagacgtcaagctaggattacatgttcaaaagatatgtggggagtgagggcctctgaaggataaagggaagggtgtgggaataggcaggaactgcagtgctgatctgacaccgaaaagttaggaggactggggaggaagaggctcgcacaggcctgaaaaagttttggctgatgggaaatccttgaaccagattgcctgttggaggagtcctgtgtccccccagaatgggcctgccctagtgcctcctgtgtgcttagtcattggctgggagcagccccaggggaagcgtggccttggcacagacgtgtgaggacctgagggtggcagctgcgggtgtcagccagcagtgtcctgcagaggagacctgagctgctggccctgtggggccagaggtggctcctgccaggtgtctccactgtgcagcccgtgtttcctttgtgacttctcagtgtcttgtgggggcatgtttcgagatggccttgtttcgtcacatacttccactcactcatgttagcatgccttgatggttcttgcctttggtgattactcctgacaactttgacacgtgatgattttctttttccttcattccatttacattgattaattggaactctcctggaaggaagagctgtcctttctgtcccatttatttattcagttctttacatcagtgtggacacatagatatttattttactctgtggattataattaatatcatttagtgggtcgttcaaattgtccccgagttggctgttgggagctccatctagttggcttatgtgtgttttcagcatgtgtccagccttttctgagcactttctgtcttcctggcagcacaggatgtcctgtcatgcacctctgtgctctagccttggtatcagttctgtctccaagcagctctttgctgatggcctcttctaaagaaatcaagacctgggcactcggggtgctccaagctgctgtgctcacagtggttactgcgctcttcggacagagctaggcaacgtgtggacacgtgcacagacacacacgcctgcttctgtatctgcctatctgtgtatgtactggaaacatgagttcatgccacctccaggttccagccagtatctcagtgttcattccagcctttccctatccttgtttctatttatttatttatttcttatttacagagatggtcatgttacctctgtttctaactccattctccaacagtgagaagcctggctctcattatccacaatatgttggcttatttgcttagttgtagtgtatacgtactgagcagctttggaactgctagcccatgtccttgtgagttttttgaatatagtatttgtgacagtgcgtcattatctttggccctacagaatacagttatagtgtttttttcagttacttaggttaattctttccttggtgtctttttaatacagttggactcatttattcgtgtttgtattcctttttagatttcccccacatcctggttgattataacttgttattgggtgtgtgaaacatgactgtggttctaaggatgtgttcgtttgttcttgcactgctataaaaaaatacctgagactgggtaatttataaagaaaagaggttcagttggctcctggttctgcaggctgtacaggaagcatagcaccagcacctgcttctggggaggcctcagggagcttccaatcatggcagaaggtgaaggggagccagcacatcacatggcaagagagggagcaagagagcggggaggtcccagactgttaaacacccagatcttgcctgagctgagtgagaactcagttaccaccagagggatggtgctaaaccacccatgaggggtctcccccaggacccagtccctcccactaggcccacctccaacatgggggattacacgtcagcgtgagattgggagggggcgagcatccaaaccatgtcagttcccactcgcccattctttctaccaggcttccgcacacgccttaggtaaccatgacatcaggtttgggtttctccttccccctgcccccaccaccccacaaatgagcacatacatagaaggatagcatcgctgtggatattgttttggattctgcttttttcacttaacgtcctggaaatctctccacgtcagtgcgtagagattctcctttttcacagccgtatcctgtgaatgtacaatcgtttaagccactacttgtctacatatgggcttttaagttgtttccagtattttgtaattataaacttgcagtgaataacctcaggcctgtgtgtcttagttttgttggaggtgttccttcagggtaaattcctaaaaatttaccctgctcagcattgagagcgtctggtagctctgttaggtaaggtggcactgctggtctgggttgagagcatcgggtagctctgttaggtaaggtggcactgctggtctgggttgagagcatcgggtagctctgttaggtaaggtggcactgctggtctgggttgagagcatcgggtagctctgttaggtaaggtggcactgctggtctgggttgagagcatcgggtagctctgttaggtaaggtggcactgctggtccgggttgagagcgtcaggtaacttaggtaaggtggcactgctggtccgggtcgagagcgcccggtagctctgttaggtaaggtagcactgctggtcagcgttgagagcatcgggtagctctgttaggcattgctttgtttctctgtgaaagggttgtgccttttggtattgcgtgagcagtgtgcgtgagtgccggtttccccaaagcctcactgacagagtgctctgtcttgttatttttacaaatctgattggtaagaaatggtatttcagtattgtttaatttgtgtttctctatttatgagtgagtttgaacacctaagtccatgtttaagagctttttttttttaagctttcttgtgaattgtctgttcatttctttttcaatggggtttttggtccctctttagagttctcgatatatgagtgttagtaaccctccgtcagggatgcatgttgcggatttttctgccactttgtcagttgtcttttgacttagtgtaaggtgtttttgccatgcagttgttttttaatagtcacatttgttactcttcagctgatgcctctgtattttgagtccttagaaagtctttttctgcactgagggaggtaaaagagaaattcacctgtgttttcttctaatatttgtttgctttcttttatttacttgaaattccttgatccatttggagttaatttttgtgtattgtttggaggtagggatgtaattttttcttttgccaaatggccacccatttgttaaagctcttgtgattaaaaagtccatctttgccccagtgatttgagatactgtctttattatgtactaagttttcatatgtattatgtctatccctgagctttccattctgttccactggtctgtctgtccatgtactggtaccacactgttttgattataaagactttatagcatgttttaatgtctgttagtgctagttccccttgtaattttttttttcggtgttttcttgggtattcttttctttctttcttttcttttctctctctctctctctttttttttttttttcttttttaatgcagcagggtcttgctctgtggctcaggctggagtgtagttgcatgatctcagctcactgtaacctctgccatctgggctcaggtgactgtcccgtctcagcctcccaagtaggtggactgcaggtacatacccccgtgccccgctaatttttctatttttagtagagacagggttttgccatgttgcccaggctggtcttcaactcctgggctcaagccgtcctcccgcctcggcctcccaaagtgctgggatgacacgcgtgagtcacttcacccggcccttcttggctattcttgcatgtttgttttcttcatatgaattttcatatcatcttacttaattctatgaaagaagcttgttggaatttttgttgcaattgcatcaaattttaaatgaacttagaagtaatatttttataatgctgttattttgtctaagagcaaaggatatgtttccatttgctcttgtgtgtcttccaggaggttttacagttgtcttcatataggttttacacatttcttggtaagtttaagtatttaatctttttgttgctgctgtagatggggctttctcttcttgtatattctctaactggttgattttatttctatatgttaattttatatgctgctacctatctgaattattgtttgagttagttttattattgcttctctagggttttccaggtgtactaacctaccatatggaaataaagatagttttacatcttccttgccaattcttaaggcttcattgattattttctgtctagttgcatgggctggtatatctagcacagtgttgaacagcaggggagagagtggctatccttacgttgttcctaatcttaatggaaatgcctcttgtatttctccgttaagtaagatgctggatttatccctaaggtgtgtatatctatatatatatgtatatattttttattgtgttagattatctgtctagtgctgtttttctgagcgttttcatgaggactgtggattgaattttgtatgttttttcagcatctagaaaggtaatcatatgaatactttagacctattaatatatatggtttatgatattaatgagtttcccaatattgaaccaatctgtaataaatgccactggtcttgctattttgttttcttaatatgatgttgaattctgtttgctaataatggtttcctagttaaatcatgttgaattagtagtcgaattaaactgattacagagcacaattaccagcaaagtttacaaacacatttcaagtagaacagatacctttgctgatgcatacaattgtagtcacatggccgatccattcaggatttttaaaactaggtagtacctatttccttttctttttctttttttggtgaacttcagacttgtgaaggtggtatctgttgagataacttaactgtgatatgtgttgattataactgcctgtgaaagtcacagtatccctaaagatattccatttggtttcttaaatagcaattcagttggcccagatacatctttgttattacaaactaataaaaagtactccttataccgtagttgctgtttgagaaaggctggcatctcctgtaatgaggtgaagcagttgcgcagagccgcccgcccactgcacgtgggtgcagcttgagaagcaggatccacgtatgcctggtgctctcagggaggccatcgtgggtcacgtcttgtctgaaacatttgtctgttcctgtcttttcacctgttcgggcgtagctgacaccgctgctgcactaggagtgatgtgaacccaacacaaactcagttcagataaggggaaaccatgaaaccaacataattgccagagcacttgtgtcagcacttctgacacaaattatgtcagggtccccagcacctctcccaggctcggtgctttagggctcacgggactcagcctgtggtcatactcccagctaagattcattatagtggcacagcaaggatgcacagcggctctgtaagggaaaaagatgcctcacacggagaaagcctggagaaatccaggcgcagcttcctaagctctcccctctctcctgccaggcagggtctcacagagctggcccctttcctagcagcaagctgcattgacatgtgtacgtgtttttgcccagggaagccctctagagactcaagtccaagtttccattagggctggtcacgtactcattctctgccagtgacaactcccaaagctccagacttgcaaaagcagaggtgtccctgcacatcacactgtctgtatagacagcaggctggcacagaggccttatctgtgcaggagcattccagagccaagttcccagatgccagcctagggcagcgctgtaagcaagcccttctgaagctaggtctgctttgttaactctgtcttgtacagttgtgttgcttcattgtagttttctcatatgatctactctaacactgtattctttatttcagtttgagccccagctacatagatctgactgagtgtccctacatgtggccctactgctcccagcccatctactatggaggaatgccgacagttgttaatgtcaccatcctcaacggcatgggagtcacaggaagaattgtagataaggtgaaacttctctctgacttggtctctgacttgatggtgaacttagacacagcccagacctttaggccatagttacttctgctgaagttaaaaaaggaaaagttctaggccgaggagagaggatcacttgagcccaggactttaagaccagcctgagcaacaaagtgagacctgtctctacaaataataaagaaattagccagggatggtggtgtgtgcccgtggtcccagatacacaggaggctgacgtgggaggatcacttgagtctaggaggttgaggctgcagtgagccaagatcatgccattgcactccagcctggatgacagagcaagaccttgtctgggaaaaaaaaaaaaaggaaatagccctgtctagggtaccagggctattggaagtagtgatttgttatatgctaagtctgttacagaataagtcagggtataaattaatgaaaccaattttacttttttgctttggcatcttgagtttggctcctgagtcagctaattacatttgatttttcatctatacaattttgcgcctataattaaaggcccagttgtagtatttcattctttatttttttttgagacagagtgtcactcttgttgcccaggctggagggcaatggcatgatcttggctcactgcaacctccgcctcccaggttcaagcgattctactggctcagcctcccaggtatctgggattacaggtgcctgccaccacgtctggctaattttttgcatttttagtggagacagggtttcaccatgttggccaggctggtctcgaattcctgacttcaggtgatccacctacctcagcctcccagagtcctgggattacaggtgtgagccaccgcaccagccagtattttatcctttaatgtgtttggaagatacggtcttttttttttaatattgttttgtaaatttttaaaaatcttaactatgtagacactatcacaataataaaaaatagggaaaaaccatagaaaactcgcttccagcctcagcatactaacttggccactgttttttaaatattcttttccagcccttatctgcaatacttattttttttgttatcattgtgcacttggcaaaaattcacaacttttttggtggttctcattatatcataaatattgaaaaattcagctgccaggcgtgttggctcaagcctgtaatcccagcactttgagaggctgaggcaggaggatcacgaggtcaagagatcgagaccatcctggcaaacatggtgaaaccccgtctctactaaaaatacaaaaatcagctgggcgtggtgacacacgcttgtaatcccagctactcgggaggctgaagcaggagaatcgcttgaacctgggaggcggaggttgcagtgggccgagatcatgccactgtactccaacctggtgacagagcaacactccatctcaaaaagaaaagaaaaattcaactatatgcatggcaccagtatacttcttaatggttgtttatatagaaatagtaaattataatttgtttgctattttcctttgaactgttaggtagttttcaattataaacatttcactgaatattattgcatatatggttttcttttattttgaattatttccttaacataaactccctggatttgctccctgaatcagagggtgtgaacagtcaaggatggctcttggcacatcctaccaaattctgtccagtggagttatgtcagcttagactgctgccagtggggttcaggagaagatggctccaccacaccttcactgggtgatttgcctttttttttctgagacggagtctcgctctctcccaggcttgagtgcagtggcacgatctcggctcactgcaagctccgtctcccgggttcacgccattttcctgcctcagcctcccgagtagctgggactacaggcgcccaccaccatgcccggctaattttttgtatttttagtagagacgggtttcaccatgttagccaggatggtctcgatctcctcacctcatgaccctcccgccttgccctcccaaagtgctgggattacaggtgtgagccatcgcgcctgacctgatttgccttttaaagtgtttttattccattagtgttttaaaaaattgagataaaatccacgtatcgtgaaattcacccttttaggtcgcacagtttggtgggttttagtatattcagaaggctgtgccaacatctccttcaggaacattccctaaaagaaaccttatacccattatcagccactccttcttccttccaccagcccttggcaaccagcctgctttctgtctctgtgggcttgcctgttctggacttctcacatcaatggaatcctatagcatctgtccttttgtgcccggcttccttccctcagcctcaggttttcacagtttgtccacgccgtagtgctgtcagtgccgcgctgcttcctgtgttggagtagtgctccactgggcgggtcggccacatggcgtttctccgttcatctcttgctgggcatttggctattctaggtggtacatctttcagctttcagcttagatgggggtaaaacgggcgccttgtgtaatgtgcacttcagttctttgtggggtgggtatctttggttgtgtttacgaattctgtttcctcttgtatgagttacacgttgatttcgttggcccatttttctcctggaattgggattttctctatcaatcctaacatgatcgccctgtcatagagaaattcaccattgctgtgtgttcagcaaaatgttcctccaggtgatgctcttttccctttaatattacttactgtggtggggatttttttccttctgtaaaagttttacatttcatgtagttgaatttttatgttttatgacttttattgttttgcagatggaaacatcattccagagagataataaaatttccattttatttttctactaatttttatgtatatgattgttaaatatttaattgtttcatctgtgttaatttgatgtgttacaagagatgggcgaaagtttttcacttgggaaccagtggctccaagagcattctttaaaaatcccttttcttcctcattatttgggacaccgtatcctacagatatttttctttttcatacttttttcttaacccactggcttacttgggaagtaagttctggctgtgtggattgtggagggaaatgagtaatttagattcgtctgaaataccggttagttgcaagctctcattgacgtctcttccagatggcctctgctcacgcttccctttctgcttttctcccacctggagggtagaagggtggtcatctcgcagctgagccagtcctccctccggccacctctttccagcttcagaatgtgactcgggacagctggtgtccctgtcatgttactgctttcaattaatgggatttttttaaagcatacaactaattgggaaataaccttaaatctgagagttttcatctatataagttctcttagtcagatgaagtttttcatcaaagaacttttgacaaaagttcccgttttataatagaaaaaaaatgtctccgtaaaattggaagctgtcagaaatagtggtttctagacttttctagtgatacgtccgaggcagtccataggctactttggttgtagttacttagtatctgtgtataaattttatttttccctatttagtgaagtatttctcagaaccagttttggtaagaattgagtttttctggtttccacgtgttttctcctggagcttttcactttagcctttgtctgatttctttttcctgcagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagaggtagggatatgcgggaaagtggcttgttttcttagctgtttgacatcacctttcagggagggacaggccaaatgcctggggtctccattggaagtacagttgacagataggcttatcctcgatggccacaattgatggttccagggcctccggagcagctggagtttgaagaagtagctcagtcagtgagtgctagggcttgccgttctgtggccacacaacagcagagaagactgttttctaccagatttcaagctcaaaaggagtgcaccaaaaatatacattctctaaaaggaaatgtagggttaatcctatgaggctctagtagtttttattgatagaatatgccttaaattttaactgttaaactctttaagtgtttgaatggacttagttatgatacatgaatctttcatcagacatttgttattggaaattcttgtgttcaaattatttaggttaagttgataaatagaaatgatgttttcaaacctgaaagtttctttctgcacaatgagggcgtttcaagtttcttttctttttttttagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggtaagcacctcacaggatgcacttcacctccccagcctccgtggtgggaggaggcaccactgttcccgcaactcttggaaagatgttgctcagcttctcgtggagcctggactctgatgacgctgagatgttcaggcttttgccatgcacttagggcagcctgacttctcttttgaaactttcacaagtatgattatgcagtaaaaagcttgaagttctcttttccttccttctcccattgcgccagtcagcaaagctgtcagtcttaccctcaaactgcatcctggatccttccatctctggccttctccctgctcccaccctagtccatgccattgtcatctcttgcctggaccacatcagcagctcctgagtgccactgctgttgctgttgttgccctaaattccactcctcttctggcaaccttggtaatcttgttaaaacaaattctaacacagtttgcctcaagctctccagtgactgcctattctgacttcctcacccggccaagccccctggtgtgacccatgcagcccttcagaagctggcactgcttcccccgcagtccccatagccgctctccctgtgcctgttccctgcagggcagctgggctgactttctcttggtgcattagccaagctcatttctgcttttatgtttggactacgtttgaactccatgctgaaagtaggggaaggggaagcattgaaagatgtgaccaggatagttacagagtcagacttgccttttaaaataagatgtctctggcagccagattggaggggctcagaccagagacgggtagacaggaagtggtgggaagttcatagaccaaggcaagcccgttggcctgcaggagaggacctggagtctgtgctgctgggaggtgagaatgaggtgacccctagagggtgtatacagtgtcccataggaaagtgagctcatttgggagggacggggatggaaagttgaccagtggcagtgatatcagttagctgtgccgctgtcttagcaccgtggccctgcgtggcttgttccagcgtccctgcactcccgcggctatttgctaagctcttctgtcagacacagatggttgccagcaatttacttgaacgcgactgctacagtgatggtccaggacacattaaacatgtctttggccatttcttctggtcattttgtctctttcatgcacctgccaggcacatggtttcttcttatcagccatttccgtgtgtccagaccagagcacacaggtctcctaagctgatgcctgtgccagtgggccagccatccaggccttctctgtgggccatggcatggtgctcttgcagaggcggccctgtggccagatatgcctttattgccagtaaagatcgatcattttaatgctgtggcctattgtttttcaggaatggtgatcacatccacaccaatttcagggatatgtaccagcatctgagaagcatgggctactttgtagaggtcctcggggcccccttcacgtgttttgatgccagtcagtatggtaagtggcactgctgtgctagccagatggtctttccgcccactttggatgtttgttaaatgtctgagaagtgaatcccagttttcagtgatagctaccaagggagtatgcgccgtgggccccacagctgggtgagcctggggcgaggctctgaaacaggtggtggcggtgtgacattcagctgaaatacaagacaggctgattggagacagggacattcgtactcttttttctttaagttaaaagcagctctgctatatattttgctccttctcaagtgaatgaaaatctttatcctgagcaccacaagtgaaatcagatcacagttagtcgctgtgtattgctggatcctggtcctctactttttagtcccttttaaagtggtacagggtggcacaaaccagactgttaggtgtcagtaacctgagacatgtacctggtgacactgtttctgccgtggtggtgtcctgtcattcagaagtgacagttcccagctttggttctttgttcatcaggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggtactgttgatacgcattggtatttggataaaaaatgtgacttttggggaatcaaattctacccagcaaatacttaagtgatgatttgacctgttggtggtctttccagttggcacagacacattcagagagcttgattagaaaaaaagccctttcgactgagtgcggttgctcacgcctgtaatcccagcactttggaaggctgagttgggcagatcggttgaacctgggaggccaaggctgcagtgagctgagatcaagccactgtactccagcctgggtgtcagagagaccctatctcaaagagaaaaaataaaacacaaaaaagaaaatagtcctttatacagtagagaggttcttgaaagttgctcatagagtaagatgtttattgagtatgagtactgttaataatatagagggttcattgtctttccttgttaatcttagatatgagatacttcagctttaaacttctgtttaattcttttccactctctgttactgagtatatataaatttaaatgcaccaaaggaactgtttcttaaagaatatttcgagtaaattattgtatatttaaatattgtatatttacaataattaatttacttatatttatagtaattaatttactcaaagggaataatgtcctcccctttattgggatcaaggactcccaatgtattataaacataatcacctttatgttttgaatcggtttctttagaatctgtgactgaacatttctatgcttctttctcatctccttctccttcactgaaccttgctgggtctaggctaagcagttatctctggtgcatttcggtaaagtactgattttcatttcataaaataaattttgctttaattaattctacacatcagccgaagcacttaaatttgcagttttacccaaacccagacagttggtttcagttgaagccttagtgtggaaggactggattgtggcaggagaaattgagttttgtcacagagactaaataactgtgtatggagtgtcttcattccctgttccctgtgtgtctgttaccactttcccaggcagtggtggatgccggataccggaggagctaacatcccagctctgaatgagctgctgtctgtgtggaacatggggttcagcgatggcctgtatgaaggggagttcaccctggccaaccatgacagtaaggctctgtttcctgagggcgtggtcttaggtgtgagagcagaagctctacacctctgaagtctagatttcttgagaaagagaatggtgatccctcagttagctggagtctgtggaaagaactcaccagtattttcaaaagtacatctgtgaggctctagttttgtccagattttttttaaatgaaaatattttatgtagccattcctaattttagtgccacctattagagtctttatgtagtagtcccaaataggaactacctcacagcttcttaattatttacaaagtgctattcatgaaataactttgtgtttcccgtgtaggaagttcccccacaggtaaggttttggtagctggttttgagaacaacgtcgtaagcattcttactacccattctgcaggtctggacagcttgttttgagcctttcactgctctgagttataacatctattcagaaacctaatgttaatagtatttttctttgattataaaatgtattcagaaacctgatgttagtagtgttttttacttgaattttgaggagattacttgtactttatgtgtgacaaggcaatagcagctcctccctcaagattaaaaacaattaaaaaaatacatagcatctgaagaatgtattttgggtaaacgagtagctattatttattaaagtgttcggcgttcctgtgttcccttgactttgaacactctttcctagtgtattatgcgtcagggtgcagcatcgcgaagtttccagaagatggcgtcgtgataacacagactttcaaggaccaaggtaaaggatgccattcatgggccttttgcttcttctttctctcgctcccttttcccccgcttctctctctgtctctcatctctgtctcttttttaataaaagctttattgcatataatttacataccataacagttgcccttttaaagtgtacaattcggtggtttttagtgtatttacaaaattgtggaaccatcaccattgtctacttccagaacaattttatcaccgcaataagaaatcccatgcccattcgacattttggtttcttttaaaatttattgcaatattacttgaatggtacccaccactttgagaggctgaggcaggcagatcatgaggtcaggagatcgagaccatcctggctaacacagtgaaaccctgtctctactaaaaatacaaaaatttagccgggcatgatggcacgcgcctgtagtcccagctactcaggaggctgaggcaggagaatcgcttgaacctgggaggcagaggttgcagttacccaagatcatgccactgcactccagcctgggcaacagagggagaccatctcaaaaaaaaaaaaaaaactaccttcaaggttacttgatgaatttttttgttaccctttataaattgttctgcttctgtgattgccagattaccaaggttttagaaaaatgaaaatgtacaagattcgtttctgtcatgcaagtttgatactgtgtatttcagaatgagaggccccctcccttctaaagttgccattttctgtacgtggacgttaaggatagttttattagttgaaaacgatgaaaagagaggatttctcaccttatctacttgcaactggaatatagaacttatttttatattacctggaagggattttttccttttatcaaaagcaagtttgatcagtaactggatctgtgtttaataggttatatttcacctttaggcacataatgattgttttcacagtcacttggccatgggttagtgattctttctaaaagcatttctcatagacagtatcacttcaggttctagctgtaaacaagggatcaaagcggtggtctcattggcttgtaccctctgggagatccttgtttttggtaggtgggtggggagaatcagaagtagatttaaggatatgtgctttctttaggtgttctactacagtgtgaaaacgaaattttttaaaggggcattttattcccataaagactttaagttgaataatcttttgggtacaaaataagaatttgaaaataggaatttgggttatgcctgatcagaaaagaccctgatggcagaaataaaactcccatcaaataccacaaggcaaatggcggtgaatgtgttccagtttttcctgactgcttccctcttccaaagaatggcctattttttcttctactcagctcctagtaggattcctgcacagagagcagggaatgtcacgtttatagagctacagacatttcagatgttatcaacacggacaatactagattctgctgaagacgtacatcatgttctagtgctgaggaaagcaattgaattaggggcagagactcctagattatctggtggtgccactgatgatgctgcctgtggcatttatacatttttgacttcttgattcattacaaattttaaattatgtcatctgggcaaagataggaggctgtgctattggaacatgtgtctttgtgaaattaatgtaaccgatgtcttaaacctaaatataaatatgtggacatacttttaaaaattagttacatttgtcctagcttttcataataaaacgtgaaacctgggtattagtatatatgactgtattcatagagaaacctgtgtgtttagcaagatctgctggctgccctttgtgtaggtgtctgaaaacataggcctttcaggataataagaggggacacaatttaggttttttttttaagatagaggcagcacctttgcaattgtaaatattatgtactgccatggcaagtaaaaatgaaagtggatagatacggaaatacacacaaagtgaattttgctaaaacaaatcaatggcacttaagacatttctattctaaaaggcttattcttaaggcttttctattctaaaaatttgcaatgttttaattgaatattagattttgtaaatgtggtttatttgtcacgtggatgaaatatcaggaaataactcactgctcagtggaaactctcatggctgttgttttttgttgtgttgtttcaggattggaggttttaaagcaggaaacagcagttgttgaaaacgtccccattttgggactttatcagattccagctgagggtggaggccggattgtactgtatggggactccaattgcttggatgacagtcaccgacagaagggtaggaaaaacgcagatggactttgtgacttcggcactcagatcctttcttccctttgtctctggaaaggcgcccgtgagatgctggcagatcagccgacatctgttcacttgagccaggctcagctggagatgttgcagtcactttgattgcttggaatattttgataggtgtctgagtgtgcacacatttaataagcaaaacaaagctacttgttggggccatgatgcctcttctccatcttcaccttcctgaggccagcggaggcgggactcccgcgttgtggtggagagtcccttccctgacttccttggggcctgcccctcccaggcttcctacgccgtgctgcctggactttgtgggcactgccacgagggggcgcccttctctggtctgactcactcttttactggagggctggctcttggctgtccttccagacctggaattcgggcttttcttagcctttatcagtgaagagcgtttgttatctcgaggcgtgaaggggaggcaaataggcatgccagtcctcttccctccgcgtctttatgtcagtctctcgatgcatccgttggatttgggggcttgaggttgggcacagactatttttctcattttgtaaaggggagaaagaatggtaaaagtgctccatgtttttacctggtgagatgataatgacaccaggactgaaaggcaaccttctaatgcgctgtgaccactggggaactcgaggcacagggcgggtggtgagtgacaagaatgaggcactaacagcgtgcactgagaggtgtgtgtgtgcccctccgtttcaggctgaagttgactacattcctggcatttatgtaaatccctagactgggatgggtctttttaaaaatcaaaaatgggccgggcgtggtggctcacgcctgtgatcccagcactttggtaggccgaggtgagtgggtcacaaggtcaggagttcatgaccagcctggccaacacagtgaaaccgcgtctctactaaaaatacaaaaattagccaggcgtggtggcgtgtgcctgtagtcccagctgcttgggaggctgaggtgggagagttgcttgaacccgggaggcagaggttgcagtgagccgagatcgtgccactgcactccagcctgggtgacagagcaagacactgttttaaaaaataataataaaataaaattaaaattaaaagtgagggttaaagtcacacttaaaggaggttaatgttttatttccacagagattttaagacctgagatctcctggtaagagtctttattaaattgtaaatgcctgagagggtggtcctaggccttacatttaaaatggcagcttttttcatctttcaggggcattaagcacttgaccagaagtgccctttaatgagaggaaagtacttaatggcatttttctcacacggatcttgtctagtccaggttgatgttaatggaacttgaaggggcagacacaggagaaacaagatggaaacagaagctccaggtttcaataccaggttgcgccttccctctcagaaaggatcctttgtgaacgggagctgttgctagcccagtgcctcgactctgaggtgtccctgaaaacaaattgccctttctctgctgtcacacttccagtggtcagggccctgccgactcgaagcccagctcaagtgaacagatgctgcatgggtgttgagccttgcctccaccccctggggtgtcagtacagttccttctccccaggagagcctctgggacgcagcaggagccatggccctccgttctcctctccctgttgcccctgagaccccgctctcaggcccttcttttctcagtgggtgtcacatggtctcactgtctctgaatgagctccattctgcccccatccatgaggagctgagtgtggcactcaggcagttggtgcaacctggtggacagtggtgctgaccacctggaaccctggggcactgggagtggagccctggtcaggtcatggctgtgtgtgcttatctggctgggctgggccactgagaatgcatatcttatgagaataggggaatctggaacatgttggatttactttgacctaaactcgtgacttctgaactcccatttcccccacttttggggactaacttaaaaaaaaattcctttagagatttcttcttaaaagctaaattccgggccacgtgtggtggctcacacctataatcccagcactttgggaggctgaggcaagaagatcacttgagcccaggagtttgagaccagccagacccatttctgcaaaaaataaaaaattagccgggcatgctgtcatgtgccttcagtctcagctacttgggaggctgaggcaggaggatcacttgagcccaggagctcaaggctgcagtgagctatgattgcgccactgcactgggtgacaagagcgtgactctgtctggaaaaaaaaaaaggaattcctaaacaggcttgttgacttcgcagactgcttttggcttctggatgccctcctccagtacacatcgtatggggtgacaccgcctagcctcagtcactctgggaaccgccagcgccctcccagtggagcaggctcagtcactccagagaggatggaaggtgagtggatgggcaggatgccttggggagggaattggatccagctgaacatgatgctacttcagccagtggctgtgcctgccagcaagtggggccagtttgtgtgcgccgctgagtggttttcgtaatggctgcgggtagagcagcactcagcggctctaacctgccgagaggccatccttagtccccagagggccatgatcgaggacccagtgtgcagctgctttcccacgtgcaccccgaccctcacgccactctgagtgtgtttaccgtcccgctctcacaggtgaggacagtggctcctacagatcttcaggaagaatcaccaacattctagagcacttgccaggtcccatgcagcaggctgggatgctcccatggattacctcactgtcccctctcagtaatcctgtgaaaatagatgttattattcccagtttccagatgaggaaatgagagctgagagaaattagataactgcctgagatcgcctgggcggtatgtggtggtggagcctcaacccgcctctggggcctgtgctggtgccgtggggccgccagctgcttggcacttagtggggtgggtatcagtgcgtctaagtccctggtgtgctggtccttacagcgctgcccgtagaaggctcatgggaaccacaggcatcatttaaaattttccaggagctgcgtttaaaaagtaaaaagaaacacagatgaaactattttaataatatacttgagcccaagacatgaagaatattagaatttaaacacgtgataccttatttcacttgctcagtagctacgtgtggttggcacaatggtgcagatctaagaaatagaaagaattttgaaaatgcagagtggttttttatttggccagagaattaaatattttagaagagaagtattttttccatgaaaccggtctgtagcttagatttcgcaggtgtagccttgcgtgtgtcagtggtggtcagcaaagtttgaccagccagtgctgtgcacacatctgcccatcttcaagggaacggttctgattttctcacccaccttcagcaatggaaacacacattgtccgggaggaaccaatcaggcgtggctcctgcggctcatggaggatagcttaatagagcaccggggctctgtgctgtgttgtgggaaagcagacagactcataataaggccctcctttttcctttgcattttagtaatagagatgattttcttttttgttgatgttgctgctaaccacaggaaaccatcttcatcggtactccaaggttctggaggcccatttgggagacccaaaacctcggcctctaccagcctgtccacgcttgtcttgggccaagccacagcctttaaacgagacggcgcccaggttagtgtccgcctgtgcccttccactctttccacggggcttgtgagtcattgcttttcttataggagagaatggaattttactgacatcactatcgaattgtcagatcttcaagcttgtcatttgcgacagttatttagtgaacctcgtattggcctttggaaataggctctttggtggtatcctgcataaaaagtgctttggataattagcattttgttacatttggttaattcttttttaaaaagctgggatccaacagagtgatttcatgggagctggagctctaagtcctgtggttggggagttaagagctgccggctgcagtgtgttccctgtttcagacattgatgataagatacagatagttcccttcttctgtcatccccgggggccgcggttgcagcctgtccaagaagagcatgcttctgtgtcattacatcctgtgctgactgtgactgggggtgaaagcacccgcctccgatggcaggctgtgacctctgctgctgtctccacactcctgtgtgcagtgccgcctggatcccttctccagctcactaactcggcttcttcatttgcatcgtttcctttccgtacccagtgtttgaggtggacctgctgtttccctctgtggctaggaccagctcggcatggctggtcccctttttctccagatgccacccccttactttttctgtgacgtccctggcccaaacaggacaatataagaagaaagggggagcttctcctgagaaaggggatgaagccagggacagctgtcagagctgtgtccgtggccgggcaggcacacctcccaccccatcaagcaggagtcttgccctccgaggccccctggccgcctggtacccggcccctctccccagcccctcaggcaggaggctaccctcttgacaggccccctgcctgccttcttttcctccagtgatggtatggggccagggacggaggccaccttccgtcctgtaaggcgaagaggagagtgcccgtgtgaaggtggcgaggctgccttccgcctttactcctcatcataaaccgaaagtgctgaacacaccacgcactgactgtatgtcttcatttcgaatatgcttaatagaacacaggaaaatggtagaatcatcacattgtctcatcagtagctttcttcctgaaccttaatcactgggtacttttccattccagttcacatctcatcatttaaacatttctgataagtttccatttttgcatcttatttatttataaccttctattagcctagcattcaaaccagcatttatattccagccatggtcagcaattcatactcagtgaacagtgttagctgaatttccagaaacccaattattctccacagtgttgttcaggacttgaagcagataacaatatcctttctatccttggctatctacctgttcacatcaaataatccatcacatactgaaccggcccatccagcatgttgataatggacagctcctggaatttgattttcacaatcactcagtaattccttcttctcagtacgctgctgggttttacatttatcttgcttttcatatcttgttgaaaattattctcggtccccagagacctagatcgacgcatattctgagtctccaaaagagatttgagaccaggagacagctccagatgctgtcagcccagtgctgggggcaggcttccatctgtgaagtggagaggcgctttgggcttcttcgttggcatcaggtgcccatacctagggcagctgtggaagtgtcagcgtcctccctgagaggaactcctgctccggtggctcctcagtccttccgtcagtatgctgtaaagcagccacatggtaatgggtgtggactgttaccatgactgctccactagaaagtgccatcaccaaagaatgagattctggaacaggatatcactgttagaatggaaatatagcccatagatattcagctacaaagtcataaagcctaaatgtcattgattccgtaacttaacactgtcagtttaactttcagactgattaagcctgaagtgtaaaattaaatcctataaaatagggcgggttataatgagtgctcattggcattcaggcagttgccgagctgggagtatcgagtgggagtctctctcttgcctgcctagggaacctctactcagaccagcccttgcccgccagcttggcgttgactttcagcctaattgctgataggactggacgtctttgctttcacttgcccaaagtgaaagagacaggctgacagtttccaaatgaataaataacagaaaaatagagaaattttaatttgcaaacttactgtattcttccccctcacttaagccagagtagtgtttttcccatcgcgatcttcgctctagctccggtgtcctcccaagctctgtgctgctgttgccagcgtatcaacctctctgtcttcttcgggtctaagttgtattggcctgaacgagtttttcagatcccagagttaataatgatactgtgcaccacagagtgcaggaagcgcacacgttcatttgatcgtcccccgcctgcaggcaaggcagatggggaccccacgttttgctgctcagactctctcccactgttggttccttgtatgtttcgtattctccctggagacagtggtttcttcagagacaaagatgctgtctggttcccggcaccagtttgcccacttccttatatgcagtggttctggaatcaccattgcctccgactgctccaggccttagggagaggacctcgatagccccaggctcaggtccactcagcaggcttcagctcctccccctgacaggctccttccagggcctcgcttggagtgtcctcccgaggcgcttggtcatgtttagctttatgcaaaaacaggctcctgctggtcatattgtaaactcagtagaatctcatgaacagggacttgattttgatctttctccctcgggacgtggaaacggccaccatagttgctgtcagtggcatttaggtggccgtggacgcaaatggcatttcacatctccccgtagatcacttgctctgtcttgagtttcagttgaacttcctagactagtacctagactagtacaatggcttatttttgttttgttttaatccattttcctgaagtaacctttggaaacatcagaagctactctccattgacctggacaaggtggtgttacccaactttcgatcgaatcgccctcaagtgaggcccttgtcccctggagagagcggcgcctgggacattcctggaggtgagttctcggctgctttgtgattgtgctcagtcatcctgtattttgttcaaaggagtctccctccctcccccaggaggcgggccagactctccctgtctctgccttcctgggagctgtggtggccttggctcttggcttcttttgtggcacaaaccagcatgagcaagggcaggcctgacagattaagagattgttgtttcccttagaaaatgctacctagattttcacatttgaatttattttacaacggctgggtgatctacttaaacatgttcaaagtaacttgcacgctctttatgaaagttctgccagccacctattaacgtcccttacaggatgcctgtctgctggtttgggtcccagccaatggcagcagccgccctggctcccagccctcagcccagaaggccccttcagttctctgccctgcccccctgggagggacttgactgagctggggtgtgtcccttaggtggtctcatcctgtctgtctctccagggatcctgactggctacatagactgcctagggcaggttcttctccactacccaaggcaattggtaccaggcctttccagccgagcctgggcagttcttttgctctagagtcccctgtactcttccaaagagtttatagctaccaagaggagtttctctgggttccaggaattgtccagaaatgggatcaggaaggggcacccctgtctgtgcagtccagccctggacaccacgtggtggtgccagggtcctgagggccttgcgcataggtcacggggtgcgctgaaggtaaattccagagcccttggccttgcccagtcgtattgacattctgaaccagggtcctctgatggcctctcctggctttcagccacacgtcccctccatgaagggctttcccagaggcggggcactgccagcggtgcttcttccgccacgccccctttctcctcctcccactcagctggaaccacaggcccctccttctcccctggatagagacgtgcccatcttcccttgtgtttagagaaacacagagcgcctctgggcctcccttcggtaggttgtgacagaagcatagctgggcctgatcgtccgtctgcggggatcccagggaggaagggcagcagagatccaccgagcctccaccccacaggaagtggctgctctttgctctcatccactctttattaatagcctgggttactttagctaaggcttaaaaatgatgtatgccctgcaagcccagctagtgaaattagctcgcatttagtttctgatgaatccagccgtcatagaaaaaggccgtcatggtagctctgtggcgttcctgcctgttcaaccggctgtcctcttacagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcaacctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagcttaaagatactgtgtaacggactctttccacttgtcccatttctctttgatgacggtctggaatgggttctgaatcaacctgctaattttgtgttcactgagacgtaattcacataacattctccactttatagtgtagagcgcagtggtttttggtgtattcacaaggctgtgcaggttccggaacatttccatcaccctagagcaaaaccccactcccaccagcagtcacccacgttcatcacctgcccctaggctgctggcggccgggctgctctgtggatcggcctgttctggacatgtcctttcaatgggatcgcacagtacgagtgggtccttggcgtccaactcttttcactcagtgtcgtcttttcagggttcattgaccagcgctgtagcaggtatcaagactcattcctgcatgtggctgagcagtgtcctgtggtgtggctagaccagttgtgtttctgtcttcctcagctggtgggcgtttgtggtggtcccactttttggctgttgtgaacagcactgctctgagtatttgggtatggggtttgtgcgacgtagttttttttttcgttttttttttttttttctgttgggagtgtacctatgtgtgaaataccgctttgtgtttaagtttttgaggagttgccagactttttttctaaagccgctgcaccatcttgcattcctgccagcagcgtgcaagagcccccctttctcctcatcctcgtcagtacctgcagttccccgtcttacaaatgctagccatcctggtgggtgtgcagcactgtctcactgcagctttcacttgcacctccctgaagactcacgacattgagtgtctttccatgtgtctgttgcccgtttgtcttctttggagaaatgtctgttcagagcctttgtccatattttaattgggttgtctttttattgaattgtaggagttcttaggcgagtcccttatcagcgatggaacttgcagatattgtctcttgttctttgggctgtcctttcactctcttgatgccatcctttgaaatagaaaaggttttcatcttgaagtccattttttctgtttttttttttttcttcggttgcttgtgcattaggggtcatattggaaaaagcattgcctgatcccaggcagcctgttcatcgtcgatccccacctgaacagggtgttgtatgctgactggccgagcaccagcccacacagcaaaggcgagggtgactgggaaggagggcagaggccgtgcggggactgacaagggtgctgctgaggtcacgggcagaaaacatctcggcccacgcaggggaggagccactgggccgactgtcccttgcagttcttttcgtccgcggcaggtcatgtgctcatcttgcagctctcactgcactctgcccacattgcttcgagaatccgaatgtgttgctgaggtcccctgaggcattcgttgctgtcccaagggtgtagggcgtcacacgcagcccgggggcgcgagcatctgccactcaggagccctgctgtccctagcaggtggctgcggctctgagccgctctccttacccacatggggccttgcagctctccttacccacatgcggccttgcagctctccttacccacatgcggccttgcagctctccttacccacatacgggccttgcagctctccttacccacatggggccttgcagctctccttacgcacatgcgggccttgtagctctccttacccacatgcgggccttgccgctctccttacccacatgcggccttgcagctctccttacgcacatgcgggccttgccgctctccttacgcacatgcgggccttgcagctctccttacccacatgcggccttgcagctctccttacccacatgcggccttgcagctctccttacgcacatgcgggccttgccgctctccttacccacatgcgggccttgccgctctccttacccacatggggccttgccgctctccttaccca

SEQ ID NO: 16559 - DNA, 7645 bp, Human
aaaagtcttttaagaaaactgagatactggcatctagtaggtagaagtcagagatgctgcccaacgtcctacaatatacagggtgccccctccaccaccaacaataaagaacgacttgactcaaatgccagtattgcagctcttgagaaactctgctctaagctcaaaaaactcagagaattctagaatggtgagaaaaaaggagaagatgcagagtcaggaagtcctgcgtctcttacttccttaatttgatgaccttgttccagtttcttaacgcctctgcatctgttttctcaaaaatgtaaaattatgataattatatcacagggtcttctgaggattaacttaaaacactgagatatttttatttcaagtagtcgggtaaagcactagccaaataccagttgacaacagccaattacaaaaaagttgtgtatacttacacagaaaggaagatctctctataggaaaggatgaggtgtgaagggtgaggggcaaaggtgtgagtgagggggaaggggtggtaaagggagttgaagtctcatgcctcaaggccaactggattccgggtttgttagagacactggtgggtctggcagaggcgtttgaacaagagcaactccatctcgaataggagctgggtaaactgaggctgagaactactgggctgcattcccagacagttaaaggattctaagtcacaggatgggataggaggtcagcacaaggtacaggtcataaagaccttgctgataaaacagcttgcggtaaagaagccggccaaaacccaccaaaaccaagatggcaataagagtgaaccctgcttgtcttcattgctacactcccattaccgctatgacagtttacaaatgccatggcaacgtcaagaagttacgctatatagtctaaaaaggggaggcatgaatcacccacccctggtttagcatataatcaagaaataactataaaaatgagcaaccagcagccctcagggctctgtctatggagtaaccattcttttattccttcattttcttaaacttgctttcactttacagactcgccctgaattctttcttgcatgagatccaagaaccccctctcttggggtctggatcaggaccctttcccgtaacagctctaacaccttacagcctctccctagctaaagtcaaactggagctgacccctcacatagcacagtccttaaatgagatgtgtgaaagtttccagaacatgccaggcccgcagtcaaggactctcctatccccttgccatgagacccaatcctaaagaccacctgtggggttggaacttgaggttccaaatcagcagtgcccacctccttcaacacccaaacccacagtctaaccctgatgccggaagccttccccactcaacagcaggcattgcgtggagtgaaagaagccaggcatgatggacagcttcctgtctgaatcccctcatatgaacctgacgggcacaatgaacctactgggctaaactccagacgctggccaccttcatagggtggagatgacagaacaggacaggagccatggggctcccggggcgggtaggggtgggtcatgttccttggcttgggggcagttacaagggtacagtggggcttgttgaagggcaaaagttctgtaagttcgtcccgacaggccaaagaaaccccagagccgtctttcgactgactacagcctggaagagaggccaagaccactccctgcctctattgctccatttctgagttggtctcactttccaccccactgacggcgcgctgcgtgaggggcggggcatagagggaggggaggggctatgcgaaagaaggcggggagagtggggtggggccgctccttggaacggaagcgcgcggcctcgaggcccttccggtgcgggagaaactactactcccataatgccccgcggtcccgcgagctgccagtctcgtcgcgagaagcagcggcccggggcgactgagcggacaaacggaagtgtaggttacggtctgagacatcaccgccaagctgggcatcggggagatggccgagactgaccccaagaccgtgcaggacctcacctcggtggtaagggacggctgtgagggccggaggccgcggccttcccgggcggcgccgggccaagccctgctggacagaggcgcgcccaccgcggccgcgcgtggcgtctgccgaggccccgtttctggaagcgtctctggccgaggctcccggccaccttgacccccggggcgctcggtgcgggccagtctccccgcgggcgcccccaagcccgaccccttccagtagccccattcatctgtcgcgaacgccctccgggtccctcccgcctacctctgacaccctccccgcccttcaactcctcacacacccccgggtgccccagcccggcagaaacaacctaaagaccctgagctttgagtcgcagcggcctccccagcccagcagtctaattggacaggttggaaaacggaagcccagagaaggaagatcttgctgaaggccgcacagctgtccagaggcagaaatggggctggaaccccgggaccagggcttgcgtcctgatcccaggaagttgtctcaggatcgatgtggaccgtgtttgtttgtttcggtttttcttaggtgcagacactcctgcagcagatgcaagataaatttcagaccatgtctgaccagatcattgggagaaatatcctttttatctgcagtcggcctcctgtgggcctttggagcctatttgccgggcagtggtggggataaatgagtagttttcaggctagcttcagccattcacttgtagaatttgagcttggattgtactgtgtttctgagaaggactgcgccgagagctaggggcaaagctgagttagactcctggctcaaggagcatacgtctaccaatcctaatagctggtgtggtggaccatgcactgtgaactaagcgcttttgtgtgtgtcttttgatgctcagcatgaccttatgagtgggttgtagtgttatcatctttagcaaatgaataaattgaggtttaggggttccatcactagtaagggtcagggctggaatccgatgcggggtagccatgccccacagtcctgtactcttacccaccagcgtgtaacagtgtcgaaagaaaattggaagaccagtttccctaaagtcgttgtgtttaaggctgtagtctgcagggacgggaggaaaaaggctcaatgagatgttggcacgcgttgtctttaacttcagcacttgatgatatgagtagtcgcattgatgatctggaaaagaatatcgcggacctcatgacacaggctggggtggaagaactggaaagtgaaaacaagatacctgccacgcaaaagagttgaaggtgaggaagggggcaattttttttttcttttcttttcttttttttttttttttttttttgacacggagttttgctcttgttgcccaggctggagtgcaatggcacgatctcggctccctgcaacctttgccctcctgggttcaaacgattgtcctgcctcagcctcccgagtagctgggattacaggcttgtgccaccacacccagccaattttgtatttttagtagagacggggtttctccatgttggtcatgctggtctcgaattctgaccttgagtgatttgcccgcctcagcctctcaaagtgctgggattacaggtgtgagccgccgtgcccggtctttttttttattttgtcttaaaagaatagagagaacctgtaagtataatttgtatgtagtcagacattctgtagatcagttcccagccatgatcccagcaagcatcactgtattgtttacctgctgtggacttgatgttttgaaatttttcatgccaaactcattctttacaccgaatttattttcccagtttttattaattagacttctgtcactattagtgaagaccactggctaacattagataaccactgagtttttatcattccagctaataataaggtgtctttttgttggcctataaagcctgtcactggaagattttccattgcttttttttttttttatggaaataactgataagtcacccacattaccaccttcttaaatggcttaaattctggagactttcttggtaacttgacataggtgaactagattgtggccacattaagcttttaccctggagttcatttaaatttcctctgaatagtttcagatgtcagaggaaagcctagtaattcaaagtacctacacagcaagataggtaaatgtacagaatcactcagcagagtgcatggtgatccttttcctctgtatgtgtgaaaaataagttttagactcacttttctcttgtttcatttataacattttaattctctataaaaatgaatgttgctgagggaggcggaggttgcagtcgaggtcacgccactgcactccagcctgggcgacagagtgagactctgtctcaaaaaaaaaaaaaaaaaaaaaaaggtactggtgcgtggtgactcatgcctgtaatcccagcactttgggaggcaaaggcaggcagagggcagatcagttgatgtgaggagctcgagaccaacctggccaacatggtgaaaccctgtctgtacaaaaattagctgggtgtggtggtgcacgcctgtaatcccagctacttggcagactgagacaggaggcagagtttgcagtgagtcgtgatgatgccactgcactccagcctgggagacagagcaagactctgtctcaaaaaaataaaataaaatggttcctgagtatttttagattcgtagagtactaagcagaatgtacagtaaaacatgcctaatttcctattttctgggcttgctgtggaccacattttaagtcactgtgaaatacagatttgggatgttgaagacagactctaaaatttgcttttatcttcacagtaggtggggttcattcactgtgtgagtaaatcacataactgctttctatgggttatgtcatcgttattcttatccagagataatttggaaaaatgtcctaccagtctcagatgcttctgtgggtctctttttatattatgtggcaatcaaaactgccatcaactgactgattatcttaccacaagaatttcaggatggtagactggctagtgatgggggtcattcaaagaaaagagtgggagtaggaaactgactctgaaacttttaaagatatttccagttaaatctattgctaaaatattgccagaagaaaataagtttaactcagtaggagagtggaaagggatttgtagttgataggtctatatgtcatttttacttgtgctcatataatgaaaaacatgttgatgatttttccttcttcaacaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacactattttacttaaactgtttcttatctaaattcttgcagagtgtcaatgttatcattgattatagaagacagggataatacctttatctctggccactcaaaaatgcagtgccaggagtgctaaacctagaggccaatactgatgacctggaaggtgatccatatgattgtcaccacaaagtgcttttacacaaaaacttgaaaatttgaaaaacatgatttttttaagtttctcatctcaccagtcttggtgtttatattgcaaatctatcaaagtaagaaataatttgtgctgtatacaaattacatggggaacataaaggagtgagatccttctgtgataaaatgaattcaccactctggttacccaactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgctatgaagcttcctttgtgtcaaaaatctgtttggttttcagatggaaatgcagaaatcacattagagtatcaactaaaacctctggacggattaagtacaagtagcccaaggcaaagcaggagagggggtgttgggggaggttgcctgctggaaggggaagctgaggagcgggaggagggcttgccaagactggcattgcaggagacttgtctcaggtgtgttcccagaactcttgcccctggagatgctgcaggaaggaaggggttatggtcacttgggtttagacgacattctgtgaacctcatgaagaaattagcatattaaagactctgaaagtagagcagagaactcagctttaacctgctcacctgctagttttcgaggtctcgctctgttgcccaggctggagtgcagtggcacagtcatagctcacttggagcctgaagctcctgggctcaggcagtcctcctgcctcagcctcccaagtagctaatattacaggttcgtgccaccgcacctgggtcttgctgtgttgcccaggctggtctagaactcctaggctcaagcagtcctgtctcagcctcccaaagtgctgggattacaggctggagccaccatgcctgtccaagggtcttttttatactatatgaagtattccttctccagctattcttgtt

SEQ ID NO: 16560 - DNA, 21045 bp, Human
  misc_feature (1)...(21045): n = A,T,C or G
tggtgatgcacacttctaaacaaccggatctcctgagaactcactgtagggtaccaagcggggatggtgctaacccatttatgagaactctgcccctatgatccaatcatttcttaccaggcgccacctccaacactgaggattacaactagacatgagatttggttggacacagatccaaaccatatgagctatattaacaatattacatcttccaatccatgaaccatgcatggaccattccatttgtttaggtcttctttaatttccttcaatactgttctgtggttttccatctaccagtctcacacttccttggttaaacatgtttcttttatcccttcagatgttgttgtaaatagaattgtttctttaatttcatttttggattggggcagtcttttgaaataaggacatgagtgggaaaaagcagaggatggctgttgacgcctagagaaaaaagtataaacacagagaaaaaaaaaacagaagccagaaattacataaaaaggaaggcaccgggaaagatgagaaagaacagggttgtgggagtactacacttagcaaatgcttaagcaaagtcaagctttcaagacaagattcctaaagcaaggcaggagtatcctaggacagacaaaagctcactcgacaaggcaaagagacaaacaccagagtttggaccccaccaactcccttagccagctggcaatatggtttcaccacttcttagaaaagaggaatggagaggtgtcctcaaaagccaccactaggctttcagaatgttttgtgtgtctgtgtcttggcagaatgagccaaacgtactttcttcgtgccccataagatgagacacacccagcaaaggctgtcctcatacagaactacctccaggtgtcttttatactgcaagacctgcaccaaagggttctacctatagaaatcctagcacctagacatagtcaaccaagtacatggctccctcaccctccaaccaaagatgccatatttccatcagagtggaacaaaatcccactgtgttcctaatgcctcctgcaattttgcatgtgggagacatggctggtatgtgacattctcttctacagattgtaatggattggggaaggagggggaactagagttcaggcctatctttctagaggacaaaataaatatgccttgataactgcaattatctgaaaactatttcaaagaaaactctttgtctcattctggcatttgctcaagggtatggctttccatcagtctctctgtctccatgtctcttttacatacatatgtatgtgtatatgcgtgcgtatgtgtacatacatccatacatatagacatattctctctctctccacacacactcacacacccctccaacctctgtggctctgagcgtcatgtgtgtaagacactgacgcgaatggtgagtgcctaggcaggggtcaaacaaaggctacctaccatgccagaggattgccacaaacacctcttaagcaagcatattccttggctcctcccagacacactgaatctgaatctctaggattctgatttcggagcccaggaatcctccggtgcaggagttcccaggtgactctgatgcaccgggaggctggaggcgctcggatctagagaggaggcggcacttgtgcagtgcagtcgggaaagagaggaggggctgggccggtgcctttaggcggtcaggtgttaggaccggagtacaagccgccagccgcgcgggagcaggccccgaggcagcccagccgcggggcagtaacctttagccacacttggcctccggccgccgccagagccgctccgcccccgccgcctcgcccccaccgccccgccctcctattggccgcgtccccagccgggctcgcggcctcggccaatggggccggcgcgcgccggaagccggaagcgcggcagcggcggcggcgctccccctcggcagctgttgtggggcaccatgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggtaaggggccgccgtcgaccccccggcagcgcggactggccgccctcctcgagtagtcctcacttgccccctccaagtcccacacaccccgccttccctgcccgatagcacgctcacttcgcccgcagttaccgcctgccaactgtgtccccttcccacgctgtctgagtcctggcctcgtcagagcacacccccgccttcctccagtctgtccttgaagtcctcacttgtatagtgtttactaaatactcagcacttggtggtctttaaggtagctgtcacctctcgtacctgattagtgtgtgctctacagtcttttgaaattattgtagctgagaagtgtttcatctatatggtatacctgaactagagcatcaggcagccttctgagaccctggatggtgtttcagaagttcactgggcacccgctatgtgtgagacattgtcctgagaagtcctgtgaaatgcacaaaggtaaataggactcaaggtcaccaccaccacccaggagtctccatggcttctggccttgtctgtgctccatgacttttgggagggcatttaactccctgcgttcagtacttaatgtgatgattctgagttgacttgaggtaatcaggcattagcacagttcattcatgttaaatgcagacacatactttgagatttaaatgattatgacccgaaagaaggcctagagcaacatatactcttcttttatactgttagtattaaatacggcgaaaaactaacctgccctttttttatttttatttttgttgcccagactggagtacagtggtgttatcacggctcactgcagcctcgacttccccaggctcaagcaatcttcccacctcagcctcctgagtagctgggactacaggtgcaggccaccatgcccggctaattttttttttttttttttttttttgtagagagggcgtttcaccatgtggcccaggcttaacctgcccttttaatgaacgaaaaatgacgtaaatgtttcaggaagttttggacattcagaagtttgttatgtgcagttggtgttaaaaaaaaattgaacacttgaatgattatgacttgacccatttaagaactctaatactggtttaatagtttacattccttcagtcttacgtgggtgataacacgtatcccttttacagtaaaggagaacatgctgaggttgtgttacttgtcctgaaattcagagcgaaaagctcttgctgatcacccaccctaatccagggttatttgcactacgctttatatcactgtcttaccgttaatcagatgtttattagaaactttcttttttggctacttagatgcataaaattgggcataattaagtatgggattaatgtcaagagtgacaacagtggccatgatttgattccccgtgatagctggttaatttacagcgctaagtgttactgagggccaggcatctttggccgtaagattctcagacagaaagcccacagttgctaattgcatgacacagaatcagtcatgaattcttactgtgttgaattatcatgttctgggctcaagcctagtctgaatagctgagtttttctgatccacacttggacatagtacttgcagtatatcatccccccatgtaaatgatcagctcctcgaaaactgggaaacttgtctttaaatttcttgcatagcagaatgatgaatgaatcattgcaatagattcctgggtgtcctggcataagacacacttgacacactaatcattcagcatttgtgtggaggtgagtctgccccacactcagtcatagatttttgagcctgagagaaagccatgaaggacttgaaaggtttctgcccagctgagagggtcctcatatcagacatttggacagctttgtccctcattgatttctcacatccggtccaattctgaattctctggttctgtgagatgctgtggaatacatccttttgttcttccccactcaagaaaactcttggttatcgcgtcattgggaaggaacacgttgcatggcaactgaagacactcacatccagacttgactgttgagagaaaggagctggcccctgggaaatacagaggctgctgagtccttagacattcacaagtttccttgctttttgaccaaggctatttacagaagggaaaaaaacattgcatactgtaatgctaggccaaaagtcctgtggaccagaggtgtttatcaaacagaatgaataacgacagtctgatctttgcctctgcatatggtttggacataatggcttcaggagcctttctgtgattgctttattgtgccccttccatttctttacctagaaaccccagccttatattcagtgcatgtaactgttagtagctgaacctattaattcccttccccttcccttgttctacgtagttgttttctcatatatacacatatatatgtatgtgtatatgtgtgtgtgtgtgtgtgcgtgcgtatatatatatatatatatatatatatatatatatggttttttgttttgttgtttacggttttttgtttgtgtttatttttttgttcatgtttatgttttttcttgttacgtttcccaggctggtcttgaactcctggcctcaagcaagcaatcctccaatcccaagtgctgggattatagataggtgtgagcccagatgtaatttttttaaaatccctgtcgcttaaatcagtcttagaatagaattagattgttctgtacctataaactatcaactgggatctgatattgtaacctctcaccagaatcacttaatgtggtatgatctgatctatttttttaatctgattttttttttttttttttttgagacagagtcttgctctgttgcccaggctggagtgcagcagcacaatctctgctcattgcaaccttcgcctcccaggttcaagccattctcccacctcagcctcctgagtagctgggaatacaggtgcttgccaacacatctggctaatttttgtatttttaggagagatggggttttgctatgttggccaggctggtctggaactcctgacctcagatgatccgcccgccttggccttccaaagtgctggaattacaggtgtgaaccactgtgcctggctgtgttcttactttttaaaatgttcttttcctctgatctgagtgagtttggaggcttgttactgcctggatttgtggcctcctgaatgtagaggagtttggaggtatgtgtgtccctgtggttgcatggtaggtgtgggtatgaggatgtgatgtgtctgggggatggtggtttataggctttttgtttttctccagaggcccagttggttgatgacttcagtttcttagaggtgaaatcccagtgaaaccgagtcgaatccccagtagaggggaaggtctgagcgaggttcagtgatttgtgggcactcgaggaaggttggcctttaattcatggaaagggttcctcatgggcagtttggaccttgctgttagggtggaatgagaggtgctccaaccttaacagaggcacagaaactagagaagggacctggttcccactgccacagccacccggccatgctagacacctgcgtaccctctgccttttagttaattgagtactccttgttggttctagtaaattctgtgcttacctatgctaaataatacttatttttagataggacagtatacccatagcatcaagtgtacacctgcggagtgtcagcttacgtgagtgggaattttccccaaatttctcagcctctgcagtgctaccctcatccatgactttatcctcccttccccagagcagggcttctggacaagggaaggtaacttttcttcacataccaaaataagcagatcttgatagagcttcaaaagagagggaaccagtttctcttttaaaaggaaaagtgggctggtctaaacggtgtcatacaagtcaatggaattaacaatacacaatacacagagccgggtgcagtggcacgcacctgtagtccctgctacttgggaggttcagctgagcccggaagttcaagtgcagcctaggcaacagagcaagacctgcctctgaaaaaaaaaataagaaacactccagcagaatccactgagaactgtcgctgcccttagcatcaccaggatattccccgcagttgtgtttctcagtcttgtattggtgataaatggtgcctgaattaacgcacgtacagttgcagaggcctctttccctggtggtgtttgtatcctggcaacgttgccgcgtgctgtggctcatcccagcctgaacagctgctgccggtgttagaactgagcaacggagacttctaacctttagcctggattcccagttctcgtgtaccagtgtcacattttgtagctgtcaggagcccaaaatagaatgaagagatctgtaggggaggagctttcatcagccaaaccatttctttcataattaatattaaattgatagtaaaactaggtatttccagcttttttcatatcacgaatgtaagacagataccagtacctcttacgcagagctcagctcatccgttcctaaactggggtacagaagccctcctggcccctgggatggtccatagataagtatcagaggagtccatgtaccccaggaaaacgtatgcacaattttactaatgtatttgcagtgttttgggggcagggcctatggtttttagcacgtaagagtgtgagaggatcccaggaagattaagaattgctatagtcaaatgcagaaagtacagttttacaaagggccattctgtgtcacctagcaaatgatctctttcatcctgccctcttgctacttcctaatcacgattcattccatttttccatctttttcatttgatatcaatctattagtgaatgctttgcgaactataaaaatgaatcagaagtggatcctgcttttatggcgtttacaaccaagtaaaggagattgagtcatggaatgtagagttaaaaggaattgcaaagatcttctggtccagctgtctatctaatgcttaaatccgttttcaaacagctccgttgagttctgtccacctgtgcttgatggcttccagtgctgagggtcaccgtctcccaggatgacctctgtggacagctccagctattcaaaagttcctctttacactaaattgagtccacatctgactgcccatgacttccaccagtcagtcctagatttccttccccggcccccatggggtcacacagaacaaatttgtggcctctttcgtgccctagtgcttaaacatgtaaaaggagacctcatctccttccgaaaacttctctgagccatcaccccaaaacctgcaactctttctcaggcgtcaaagttctgagtcctttcaccctttaacagggattaaaatgtaaaattgttttataaaatttggaagctgagacaggagaatcgcttgaacctagggagcagaggttgcagtgagccagggttgcaccactgcactccagcctgggtgacagaggaagactccatctctcaaaaaaaaaaaaaaattctagctgttgtaaagccattcttataggtgttgcccattgtgttctttatgacccttgtagagagattcagaaggtcattcttgtatcagatgtcctgagatgtttactgttatttaataataatgttcagtggatctgttactatgtagtttatgagtaacaaagacccaaaataacagtgatttgaatatgacagaagtttgtctgtcatgtgaaagtctagaggtgggcagcccagagctgattctgctctttggtgctcttggtggattcagacttgaatcttgttgctctgccgagaaaaaccttcatctccaaagccacgtcgtggcccaggatggctgctccaatgccagccatcacaccgccttccagtctgcagtggaaaggacaaagaaaaagatgggccaagggcctgctcctgctgtcttttcaagttccccaaagtggctgcaggagacctctgcttacccctcattgaccagaactctgtcacatggctgcccccagccgcagtgcaatctttgttctggacagctgtgtccctagctgaaaagtgaggcttctgttaatttgaaagaaaaggggtacagccatcggggaacaacaagctgtggctgtgcaggcagcaccgaggcgacgctgctcctgctcagggccttgtgttctgctcttgctggaaaagcttcagtgcagatgtatcttgggtggtcaagtcaattcacatcatttttggaagtagatacaatataaataagtgaggcaaaattaggataatttcatcaactctgaaatgcattggttgccagatacgctattattttatgtccctctaaggtaggttaaaaatgctgccagttacggcggggcacagtggctgacgcctgtaatcccagcactttgagaggccgaggcaggcagattgcctgtgctcaggagctcgagactagcctgggcaacgtggcaaaaccccatttctacaaaaaagacaaaaaaaaattatccaggcttggtggcgctcacctgcagtcccagctacttggggggctgagacaggaggaccacatgagcccaggaggtcaaggctgcagcgagccgtgttcatgctgttgcactccagcctgggtgaccgagtgagaccccgtctcttaaaacaaaaatgctgccaattagtctgtgacccgccatcattcgaaagatgcatcctgacttgagagatgttaaaatatgaaaatgtacatctctgagttgatgaaatagggttcctgaaccaagtacttgtctttcttaggaaatgtaggcgtaatgttttgacgtatcaaagaaggttcccgagaggatgaggacagtgctgttgacacccttgctgtcttagtgtttcccttacagtgcatctttcattgttatgttgattttatatgattagtatgctcactatggtgaacgaattggaagatattatttgatttgggcaacttagttcaaattgaattgtttccttcagaggtcttaacagactgaagtagttaagtctaaatagagcgttgaacgaaagaaagcctgacttggtttgagataagatgtctgacagaggaatcttgggaaaagctgtttggagagttgtcttgcacaattgtcttatgtattgtgcttgagtgttttcattccttgtgctgaccacaacacagagatgggcttgatctgtcgcacattggaggcctgggatttatcttctccttttcaggaaatgaatggggtgctgaaaggaatgctctcagaatggttttcctccgggttcctgaacctagaacgggttacctggcattcaccgtgtgaagtgcttcagaaaatcagtgagtaagtattacggttttcattttctttgtacatacatttttcatatatatttgtgtatgttttatattggctaaaagctaatctatctccattcatatgtacagtttatttcaagtctaataaaatccaaacacagtatttgcaaatgctgcggctgtcaccacacatgatactaagattatggaggaagacgaaagggcaccaagagaaactgatatgtctgtcagtgacctgcgtgtgaggtcttatttgtgtcctcttatttaaagcaaacacacccattttcgctcgtcccaagaccccgtgatcagagttgtagaaactcactggaccaagcgtttgcattcgtaatcaaaacagtatttagcccacctggtggttaagatttctccctgagttaaaatctctaaacaaactatatcatgtgttagttacatccaggacccgtatgacacaggctagcatgtcacggtgccttcactacctttgcacgtaggcatcttcacattacatgttgtcccatggaatccatggtttgaaaagtgtcctatttgaaatgtaaccaattcaattcaaagggctgacagtgcctgctgccatttcacatgctgaaaacaaaatagcggtggggcgagattgctggaagacaccagatgagccccctgattgcagcactgacggcttcacagagatcccaaggaaagaaaagacagtgttcaacaccaagcgtttgattaggtttcacgttaaaatctgcatgaatccttccccggagcctcacaaactccttttaaaactggggttaaaactggagcacaattttgtgtgtaaaatggtcattcactgtagttcctctcagtgggtgctgtttctcatgaaaatgactttctttgaattttccagaagagtccattaaagctctatttaaagaacttgtttgacttagacgaatagtatgaataggagtcagcagccgttgcttgtgaattatgcatttgtcttgtctctttataaattccgccccagggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggtacctgcgatggtcaattcgggacaagatgggcaccccatagagccccttgtgttttttgttttgttttgtttttacttgattttatcctccttttttttttttttaaataaatggttttgggcttttttaaattggttaaataaaatctccagatttgtaggtgtagagcgtagaagtgtaacaggcagacagttatggagcaaggcgagcattcatctggctgtgttgatcttaggttgagatacagttaaagtctatcacagaacatgtttgtgaggcagaaaataattgtgaaggaagaagggacagatacctgattcatacatagtttacctttacagcttttgttaaatgcctgtggggagttttgaaagatacttgattagaaaattgaaagaggcactccatcccttatgcttgatgtgggccgaggacactccttggcgagtggaggttatgggacttgtggttgatagccccgtctgtggcaagctgctctgctcctggatgagtttggcaagaatgtctgaaacactcctgcaggcccgtgggggcagaagaaccagggagcacattgcagggtctggaaataggagtgctaaagataggtggcagggagcatgagacccctggggcattgcaggtttgctcagaccaagaggacatgagtggctgttaggaagctaagtggatgatggcccatcacaagatgagtgccctaagcaggtgtcctgctgagaagttagagaagctgagtagggcaaatgagcagacattcctgatcaccaaggagaaacacattcccttacaatgtttgtgtgtgaaagagtcacactccgatgccctcttggtgggactaggggccattctgacttctctgagggcaatttggcaacatggatgaaaattcagaatgtgcattccttctggcctaacaattccactcctaggaacttctcctggggagatgctcagccctgagagtcagatggctattcctgcagcattgctgacagttcaaaagggtggggatgataacctagggcccatcaggagagaatgggctccaggagggcgctgtagacacatggcgcggcctcgtgtacatcagatatctgtgcatgtatttaaatattgttgtaggtttatatggaaaaccagccttgacttactcttgagtagaagttcaggtttatagagtagcatgggtatggtgtggtcttatgaataatattaataatatctgttgagtagtgctctgtgcctgtcagtctgtgaagcacattttgtgtgttattgccctgagcaccctgtgatttaggtggtggtgttgtgttttttttttttttttttgaagcggagtttcgctcttcttgcgcaggctagagtgcaatggtgctgtctcggctcactgcaacctccaactcccgggtacaagcaattctcctgcctcagcctcccgagtagctggggattacaggcatgtgccaccatgcccagctaatttttttttttttttgtatttttagcagagatgggatttcaccatgttggccaggctggtctcgaactcccgacctcaggtgatctgcccgccgcggcttcccaaagtgctgggactataaaggcgtgagccaccgtgcccggctgatataggtattattatgagaaaaccgaggcttgagggaacgtccgcaacttacccatgatcatcgagcaagtaagggcggaactggaattcagacccagctcgcatcctgactctaagggcacgtgagaatgtgcgtgggtacgcagtcctgtgtgcatttgtgtgcgtaccgagagcctctgagacaggcctggaaaggtgttcatcaaaagggcagcagcaacagtcatggagattagattttggagtaattggttatttttttttatgcatggttttttttttttgcctctttttgttttattcacttagttttatcaattttttgtctctttgacattatacatacctcacttgtataaccgaagaaagttttgtttttattttgaaaacttaaaaaaaagattgctgggatttttgcataaggaatcacaagataatttgcagacttcttaaaaaacaaaggagagcccgacgcagtgactcgcgcccagaatcccaacaccccgggaggctgaggaggcagccggatcacctgaggtcaggagttccagaccagcctggccaacatggtgaaaccccgtctctactaaaaatacaaaaattagccgggtgtggtggtgtgcacctgtagccccagctacttgggaggctgaggcacaaatgagaatcgcttgccactaggcagaggttgcagtgagccgaggtcgtgccactgcactccagcctgggcgacagagcaagactccatctcaaaaaaaaaaaaaaaaagaaaggagataagcctgggagtgatgtgaagtgagctccgtcctatgaacgacagagctcttccatagagcacggtgcaggacagcgggcccctctcgggcctcggaggatatgtccttcatgtcatgagctctccccctttcctcacagcagcatttcttcactttgttggagtcacagaccctgttaagaatctggagggaaaaatgctgaggatgttttcctcagggcagatatgcatagactcacacattccatacacaatttcttgctttttttcttttttttgagacggagtctcgctctgtgcccaggctggagtgcagtggcatgatctcggctccctgcaacctccgcctcccgggttcacaccattctcctgcctcagcctccgtagtagctgggactacaggcacctgccaccatgcccggctcattttttttgtatttttagtagagacggggtttcaccgtgttagccagggtggtctcgatctcctgacctcgtgatctgcccgcctcggcctcccaaagtgctgggattacaggcgtgagccaccgcgcccggcctccatacaatttcagaacaatttcagaaagttcatggactgactacgagacctcatctatgcagtctgagctaaacgctcctacttccagaatcgaaggtcgctggtagaagttaaaatagtttaaatgggttcttcaaaagtaagctggtttccctgcttcaaagcaaatgaaaaggtagccccctgctgttccactgttatccagtgagctttggagtgttaaggattatgcttcggagtataagggattagaaaacgctgccgtgagaatgagaggcaataaactcagacttcagctaagcgacttcccagtctagctcgtttcttagaatgcctcgcagggatgtctgcaaatgtgttaccatttaggaaaaacagaaatggcacaaaacccaaaaggtacatgaaaaagtcaaacaaaggtatatttcctaaaagaaaattatataggactgcttatagcctcttgagaaatttgaaaaacctagggttcagagaaaaggaggaaaaacaattcagtggtgggaaacgtcagtcctttaggagaagctgaaggaactggagctgtttggtctcaaggatccgtgtgttatcgctgagtgttggccggagagtttatggagcaagtttttgtttgcacaaaggcctaaaagagacagaaaggggcatacattgctcttcaacaaagtttgcatgaaaatttcaagaaacgatgcagtgctgaggacccccaggcacgcggtggagtcgcctcctccagagagttttcaaaacagagcagcttttaggctctgtagcctgaaccccagctggggagccgaggtctcttccagctccttcagtgctctgagaattgtcttctcgtcccagcaacaggcttgcctcgtgggctgcagagcggccaggccacccttagaaccatcgttggtgttttccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcaggtaagcgacacgcagggagccccggtcacgcttggcttccgtgtggtcaggtcagcgaacctcgtggggtgtcaggtgccatgagggacacagatgaagacaggagctaaagggaggggcagggggtagaaaaggtgccagaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatgtgctgttagcttgggccttctcatggcctgtgagggagtgctgaggtgagaccagacagctcgaaggtaaatgcatcggcttttaatctaactctcctctctttgctgccctgtgaaaaacatattaaccatcctacatcagaaatgttgatgttcactccaggcctaggctttcaaaaaccaccagcctcatcagggacttggataaattccaatgagtagaatctaataattaggtgcggtagctagatgtttgctaatgactggctctgagcagggtgttcactgtgttgggggctgcacatggctgcagcagaggccttcctttgaggacgacagtgtggagtggggacgtttacatgctcctagtaaattcataatcaatttctaattgaagccctcaggattcagctgggcgtgggcttcattaccacgccgccatgtttcccccgggtaacaatgagccgtagctcattcccacagtttcctcattcctctgtcttcactgagggtggtgattagcagggcggggtggggaaatgtatcagggtaaggaaggcaggaagaggaggagcagatcccgggattcgggggagttgggccttagcccagcagctgtcctgagggtgtcgcttaactgcccctgggcggccagcctagaagtcctcaaagggagtctggaagggaacaaatggcccctctgcgtggaggcgctcgtcagggtttacaaaagcaaaacacagctgggcgcagtggctcacgcctgtaatcccagccgaggcaggcagatcacctggggtcaggagttcgagactagcctggcgaacgtggtgaaaccccgtctctactaaaaatataaaaattaggcatggtggtgcatgcctgtagtcccagctactcgggaggccgaggcaggagaatcacttgaacctaggaggcggagattgcagtgagccaagactgcaccattgcgctccagcctgggagagacagtctcaaaaaaaaaaaaaaaaaaacagtggttcggggtgggggaaaaaccccgggagctaccacgaatgcccaacgagaggaacatggtgaggaaaatcataataggctgctttttttatattactctgtggttaaaatcttctgtttttgaattttaaatgataatgagaaaatgctcacgatataaattcatattgcaaaatataaagtaagtgtctcacccatgcaaaaatcgcatcaagaaacaccaggagtttatctgagcagactgtcgagagtggttttctcaatgtagtggagtgtgatggttttattttcttctgtcattaattttttcaaaaaatatctatagtgagcatgtgttacatttataatcagaaagtagcagattgtttgaaatgatcatgagatctctatctagttgggacaataacgattgaaccgtgtcatgtgatatggagagatacccgcagcgtccccctcctcgccctctaccccgttctgcacccgccgtggtgtggccgggcagctagtcgctcactcaccagtccctggccactcgtgtgccgagcagcagagcagcttccggggcctcacaggtggccatgggaggagcatggtgtacgggaaagacaaggcctgcagtgagtagctgcagtgcaccgagccccactccccactggccagctgtctggttttaggcaagtcccccaacactctagtctcggttttgccgacatgagaagggatggtggggacagagacgccctgccttggggagtcaggatgcctccagggtctggcacacatcaggttcctgataaatatttcctgctgggtgtggcggcgcgagcctgtggtcccagctactcagcaggctgaggcaggaggatggcttggacccaggagatggaggctgcagtgagccatgatgacaccactgcactccagctagggcaatagagcaagaccctgactctaagaggaaaaaaagaaaagctgcttgaaagaagataaacaacatgtatcagatgtcactctgaccgctacacagcagcatgtgagccgtaggttaagaggtgctcctctgttggtaacgtacctgctgaatttgtgttttctccgccttcctttccaccccaaccatgctttacagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaagcattgaacatctgattgtgtagtggtggtcgtctttaagattagagacctgggaaggctggaatcagccagccagcctacggggagtttgggatgaaggagcctggggtgtgttggatgagaacaaaggtgaaggaaggggcagtcattgtgcttgtgggaggaaggcagttgtgtttgtgtgtgtatgtgtgtatcagtgcacatctgtgtgcatgtgcacgagcgtctctgtgtggatcagtgcacgtctgtgcgtgtgcacgagcgtctgtggatcagtgcacgtctgtgtgcgtgtgcacgagcgtctctgtgtgtatcagtgcatgtctgtgtacgtgtgcacgagcatctctggatcagtgcacgtctgtgtgcatgtgcccgagcgtctctgtgtggatcagtgcacgtctgtgtgcgtgtgcacgagcgtctctgtgtggatcagtgcacgtctgtgtgcgtgtgcacgagcatctctgtgtgtgtcagtgcacgtctgtcgtgtgcacgagcgtctctgtgtggatcagtgcacgtctgtgtgcgtgtgcccgagcgtctctgtgtggatcagtgcacgtctgtgtgcgtgtgcacaagcatctgtgtgtgtcagtgcacgtctgtgtgcgtgtgcacgagcgtctctggatcagtgcacgtctgtgcatgtgcacacgtgcatgtgcatgtgcttacacgtctttgtgtgtctgtgtgcgtgtgtccgcagttgccctgtcctcgctgtcctcggtttggcagacaggtccctcaccttccttgcctttcatctcctgtgaccctcgccaggccccttctctgtcttctgcgtacggcgtgttgcttcgtgacagacggtgtgatcgcgggagctgtctcatgcctcttgttctccgggctgattctgaaagagtggcttgcaggccaatcaatgcaatcctggcaacctgcccgcccttcttgcgggcagagttctttaccgtaagcgtccccagaccctcaggcctgcggaaacctgctgggccttaccgtctttgcttagcttttggcctagaccttaaagaccagcagtcttctgtgctttatcctgctgcctccagagtgccatggacagatcacccattctcgatcactccggcagcctttcggatccggtggcgcccttcctggctgtgtccttcacctgtgctgtctggttctctcctgtgtggacaggggatgataggaattcccgctgcacaggccgctgggaggacgggctcaggtgacatctgccgaggctttggctcaccagaggagtttgtagatgtcagtcatccccaagtcactaggaactagcacgcctgaggtaggtctcggaatagtgttcaaatccattttactattgcggccaaggagccctccctccagcaaggcggctcatcacatcacgttactctttaggtcaaatgtaaccctcccggttttatttatcactcaggcagagtttcttaaccttttgtgagttacagatcactgaaattctggtgaaagccaggtaggcctcgccgcaggagaacacatacatggtgcacagaacacacacagtgcacagaacacagtgcacaggagaacactcacagggcccggaaaaccccacggggcccgggaaacgcccattttggccgggaaatcacccggggccgggacaccgggcaggaacccggggcgcctgccccctgcctctttcctgtctggtaaccagcgtagacaagtagacacatgctgaagaccgtgggggatgtgagaatccggggagtgcacatgccgggagcacatgactaccccctctcccccctctcttcttttctctcttctgtgttaatgagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16561 - DNA, 27465 bp, Human
agaggcagcacttaccccttactgcttagatggtcatctcttgttgatttctttcccctagatcctttctaatagcaaacattttgtgggcaagaccagagctggatgacagagtgtgtagagtagctgatgtaatgccttgctcaacaaagatgctcaataaatatttgctgaaggacttgattgatcctttgccattgtccctgcactgtgccaagtagtttacaggcattatcttctggaattatcctggaatctttccacaaccccaaaggtagccaacacctattctcttcattttactgaggaggaaactatggctcagatgagacaccttcctagaccatccaagaagaggcaggagtgggatgcccaaaactgtcctagaccagagcacaaactgtaacttctatcctaccgaaattatttatttatttattattattattattattttgagatggggtctcactctgtcacccaggctgaaatgcagttgcacgatctaggctcactgcaacctctgcctcccaggctcaagcaatcctcccacctcagcctcccgagcagctgggagcacgggtgtataccaccacacccagctaatttttttttttttttttttttggtagagacgggtttcaccatgttgctcaggctggttttgaactcctgagctcaagcaatactcctgcctcaaactcccaaagtgttgtgattacaggcgtgagccaccgtatctggcctatgattattttgttcacagacagggtcttgctctgttgcctaagctggaatgcagtgcagtggcatgatcatagctcactgcagccttgaactcctgagctcaagtgatcctctgcctcagcctcccaagtagctaggactcttaactctatcctacccaaatttttatcttatactccaccaactcagggcctcttgcaggaaaagaaacctgagccacttccatagtatgaggcttcgagtgtactcagagatgaagaattgccaaaatacagctcaaaaagtggcattttcaaaaaacaatgtaaacaactcaaggacatagctcaaaattaaaatgtgacattacaagcccattcgaaggttaatttcctggatctgtgaactaaattaatccattattaatccacggtactctagaggttctgaggtctgggttgaggtgcaagtttcaaggaatatgaggaaagccatctttagaaggtgctggtgtatctgggacctggggaataaactgctttggagattggtcacaatctgagtcgagagccctcctggcccacatgggatatgccctgccctgcccgatgatagcgggacttcattgggacttaggcaaagactacctggtctctggcgcccacgtggcccacgttgccatggtgacgtcagaacagcgtggagacgtcacctgacggttgccgcggtgacctcacggcggtgtgacgtacccatggcgacgacaccacgattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggtttcaatttttattggttcgcagttctcaccccagggcgggacactcccagggacttgtttcccattggtttaacggaaggagcggggcgggaaaacccgtgtcggcttggctgcaacacctattgaccaatgttcaagcctattggtaaaggtactccgggctcgcgcgctctgattggctggcctgaagtacaacgcctcctccccttgaggcacgggcgctctgggttgtgggagttggggagctgctccggcttcggcgcggaggggcggcggccggggaggcggcggcggcggcaggtgagaggccggggtcgggcggccgggcggcgcgaggtcctagacccaggacgacgctgagccaggcgtccagcttctgtggctcagtttacccagctctgagagtcttgccccgagggatcggcgacctcaatctgacagtcgtgattttgagcttgacaagcaaggggattccccgctctgagcctcagtttttctaagaaatggggatcacgatagtacttagctcatagtacacctgaatcttagcgtaaggtaatctacgtaaagccttaagcggaggataattttgcgttatgtataaaagtgtaaattgcacacacctatagaccctgcaagctcctttctaggactctgtcctgcagaaatactcatttaagtgtgcaaaacgaggcgtactgggtgttttctgcagccttgtttataattgtgacacattggaaacagcctaaatgtccagcaaagagttctttctgctccatgatttcatgtaatttctacctttaatagtagtagttgtaaaagctgaaacgaagaacagagccagtaataagtagctctcagtaattgaatgattagtaggtgccagacaccgccaagtgtttcccttgcgttaatttaaccttcctaacatccaccgaggtaggtacggttattttctctccatataacgtgtggggaaaccgaggttcttagccatttaagtgagttaactaagatgacatcactggggagtggaagagctggcatttgaacccagatctgttggatgtgtccagttgactcctgcattgcctttctggtacgtagcaagtgctggacggtaactaccttttttgttattatgatgggcttgaactaggtgttctaagatctcttcctgctggttctgacatctagagatctttgctcttctcattggctttcccttttaggattcccaggagccatgttgtcagaagtcctactggtgtctgctccggggaaagtcatccttcatggagaacatgccgtggtacatggcaaggtacaaagccgttagagcctttaaggattgggtaccccttctccctgatgctaattttgtaagaaggtaaaaggacaccctgaggcacagcttgggagcagatcagagagatcaggttctccccagccaggcaaggaaaagatttcttatgcccactgaagggattcttgggcctcgctcggtatgatagcaaaaagatgattataatataaagccctgtgagtggaatgagatcacctaggagtgagctttgatgcagaaggaaagaggtttgagaactgagctccggggcactaagacatttagaagttggaaggatgatctagcaaaggagttgaaaacatccattatctcattttacccttacagctacccccaaggcatacccttttattatcctattttacaaatgtgcaaactgaggcttaggagagaagtggtaacttgatccaagtcctatataccttggtagagcttggtgtgaacctaagtctgtctgaaaccacctctgctgcactctgcttttttttttttttcctgagacagtcttgctctgtcaccggagtgcaatcttgcgatcatggctcactgcagcctccaacctcagcctcccaagtagctgggaccacaggtgtgtaccaccatgccccactaatttttttcttttatttttctgtagagacgtggtctgacactacgctggtctcaaactcctgggctcaagtgatcctcttgccttggcctcccaaagtgctgggattacagatatgagccaccacacctggcttctcactgctattctttatgttcttatatttctcattgaaaacatggtgattatggggaagtgattccttggtattgagaacctctgaaattttgcaggcagaaggcaaagtggattttaacttttagctgatcgatggtggctgttcccaggcttagtgggagagcatgccaaggttgattagcagtgtctggcaagggcatggctaggagtggcctctgtgcttatgtttgctctcttcttagcacgtgggtcctggcccctttgccactcaccctcaggcttattgcttttgtcatttattctataggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtgagtgcaaggaggagaaaccaggtgtgctaagagcctacagagagggcagctggccaggtattctgggctgtccccaagggagccaggggccagctatttcccgggtgttttctaccctgacctcataaaattagcttcactcattttatttttttaaaatttataggtgtaaaacaatgcattggatctctgtgggctgttgtggacagatcatcaaggcctattgttgagtgaaaaaaatgcaaaacagcaaacatacgtatttaagtataaatatgtgtataaatgatagaaaaggtctcgggggcatagacatcagattggcagtggtgattagttctcctgggagagacctagggccagagagtagacaaagtgacacatgttttaaataaggagaatatattggcattttgtataattaaaaattgataaaagtaggccaggcacagtggctcatgcctgtaattccagcactttgggaggccaaggcgggcggatcatctgaggtcaggagttcgagaccagcctggccaacatgtcgaaaccatgtctctactaaaaatacaaaaattagctgggtgtggtggcacacacctgtaatctcagctactcaggaggctgaggtaggagaatcgcttgaacctgggaggcagaggttgcagtgagccaagattgcgccattgcactccagcctgggggacagggcaagactccatctcaaaaaaaaaaaaaaaaatttaataaaagtacaagttacctatgcttattattggaaaatatagtcaatactgggacattgtaattttaaaaatcacctattatttcccttctcctttccctgaccccagtaatgactctaagcatttaggcattaatccttctgggtgattttctgtagattgatagaaagattgatagagacagggagatatcttggttttttaaccaaaattgggtcaggccatataaaccattcagaagtactgattttttctttgtgtgtcacgtgtgtgtgctgatttttgacagcactgtgaagatttcatccactcataagcaggccagctttttccatcagtggagtcccctgtacctgccccagagctgacgtgtgttttctctgttgtcagtttactgtctgctccctgggctgaatgaagccttgctctttggaacagtgtttctcagccaggatggggtaaatgagaatctttttgggttttttccttacactgcacctgaacccttgacacctgcttcccattccccatgagaaaccacagtcactcccatatgccgtatggggatggaggaagagttgaaaattctcatttcacttgttgagatggggtctcactgtgttgcccaggctggtctggaactcctgggctcaagcagttttccactttcccaccttgggctcccaaagtgctggggttacaggtgagagccactgtgcccagccaaaatcctcattttagagcagccctttttaacttcatcatatcttggaatcacccaggagttttttgtgatggtggtggtggttttttttaaccaatacagatggatgggctcctggctccgcccctctcttattgggagttggtagtggtggtaggagtttttgaaaggggttccttgggtgattctggggacacctcagttaaaagccactcctttggagcgtgcatctgaaaacaaccagccagagcacatggaacttgctttccaaggtgcacagggccacccagccagaccagaaatgtctcctgagaaccagctgcaacttgtgtatgtcagtagcttggggtggaagcagccaggtatgggggaacatgtctcagaccactccaactccctcagtgaacctggggcaggtcacttcatcctctgggcctcggagcagagacatgtttcctgactgagggctgccatgaggatccgacgacactggaggcaggcattaggggtgcgacacagagtgcattatgtagggaagggcttgttagttttggagctctgggagacatactatcttctaggttgcaaagatctaccatctttctttcagtgtccttttgctccctcctgatagtaataaacattgaactttttttttttttttaagaggcagggtcttactatgttgcccaggctggtcccaaattcctgggctcaagtgttcttctgccttagcctcccgagtagctgggaatataagcacataccactgcaccgtgctactacagtgaacacttattgggcacttacgtgtgccaggcactaagtgtgttcacatatgttagcactcttagaattcgccagcattccctggaagtaggtggtggtattcatccccattgtacagatctgaaaattaaagttcagaggtcaagtggctcaggttacacttgttggtgacactgaaaggattcagacccaggtttctcctagccccaaagtccaggctcttaacagctgttccatctcgattacaaagctctgaaatacctgggttctcaatgatgccatgacttggccatttgagtatatcattaatccattcaacacacatttacccagtacttaaccagtgcccgaagtttcctaacacacgcatgcccaattccatttcccagtcccttgagaatgtgacctgaggctcagcgagtgatttgtaaaggtgagctggccagaaaggctctgccttctcagtgtctcagaggaaagtggcccaggttcctgtacatccctgggaacaacctgcctcaccttccccttctgcccaggcaccgcctcgcatttacactgtcctattcctgatgattatcttttggaggagggaaatattttgggggttaacttaacactcttttgattttggttttatacaatggaaggtgaaacctaggcccttgtgcgattgagccagcattctctgtgtgtgtctgtgtgtctgtgtgtgtttgttttaagactacaattttttttttttttttttttgagacagggtctcactctgttatgcagcctggagtacagtggtgcgaccacagctcactgtttcttcaacctcctgggctcaagcgatcctcctgcctcagccttctgagtagctgggaccacaggtgtgcgccaccatgcctggctagtttttgtactttctgtagagttggggtttcgccatgttacctaggctggtctcaaactcctaggcacaagtgatctgcccaccttggcctcccaaagtactggggttacaggcataagcgcctgcacccaaccttaaaactactgttaattagcacttactacatgccaggtgctgtgctaaaaagtttacaccccttatttaactttacgttcctgacaaccgtaagaagaggcactgttgttatccctgttttaccaaggtgggaaacaggttcagggaggttaagtcacacggccagtaaatggcacagttgggactcaaacccaagtctgcctaaagccaatgaacagacttgggtgtggggttcagaccataaattcgtgtccatccatgttccaattccagtgactagtcgattttctgtgttctgttgtttataaagcaccaaagtccctctcacccacttgtgtttgcttgtttgcctgtggaacagagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtgtgtgcgtggtctggggaaggagtccagattcagcctcccatggagaaaaaggaagagtttctgtcattgctgctggagaatgcacatgctctcttctagagcagcagccattggctgtcctcatcatgtgccaggcaccctgccaggcacggtatatatggcgtgccttttttttgagacagggtctctgttgctcaggctggaacgcagtggtatgatctcagctgactccagcctcgacctcccaggctcaagtgatccttccacctcagccttccaagtagctgggactacaggtgcgcaccaccatgcctggctaaatttttaaatttttgtagagatggagtctcactgtgttgcccaggctggtctcaaactcctgggctcatgtgatccaactgccttggcctctgaaagtgctgggattagaggcatgagcgactgcacccggccccagcctctctgttgttgtttttgttgtttttgtttttgtccagaacccaaagggaaaaaaacctcaagggggcagcccttcccttgagcagcagatgctggctcagtggccaggctctatgctgaggacacattcggaaacggcctgatacttgccgtccgaagcagaatttcaacttgagagaggcatgtccccttaagtgggtgaggggcattccagaatcttccaggctgggtggggtgggtacgtggaatttgaagacgcacattattacaatttttctatttgggaaatgggaaaagcacttcgtggaaattaccaaacatgaagtttgacagttcttgcttgggggaaatacatgtaagatgtagcgattcggacctttctggtgatcaaaagcagacccgtgttacacatggttggggagcaccgtctggcgggagaggccccggtgaacacacaatcctagtgtgcggtggtgaggcagcggtggagggagggagggcaggcgggggtcctagaaggggagccaggagggtctttgtgggcagctacggaaagtgtcacagtggaagcgacatttgataaggccttgagagatgggtagggatttctctgtgggataaggaggtgcacggctattgcaggcagaggggccagcctgtgctcagagcaggcccacagaaaagcctagcatgtgggcacaggaaggaggtgggagaaaggggttgacagcttgccaggtgcttctgggaagggctctggttgaatgacccagggatttaaatgaacttgatacctgttttctagttgtctgattcagcatgagttcctgatgttcaatagggatacatttggggtcaggaattctcccccagttgagaaaactggaccagatgcttggagtcaggcctgggcctggcccctggttcagtgctggcaccccactgccctgcgggagagtcacgtttcacaccctggtgtgtttcagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtaaccatggtccttacctggccagtgtccctcccgcacggcaggacagggacgtggcttctctcactgagacctcaccacctccctgtgaggtgagaggtgtcatagtggccattttaacatgaggaagctgagccccgagaggtcaaatggctggcccagggccacacagctagtgctggcagagtgggatttgaactcagagtctgagcttttctctcctgctctccaccacctctgctcacccccatcttggctctgttggtttcaagcgcccatggtatggtagaaagagctggagtccagatctagagggcagcaggttagatgaaccctcccacctctgcattgactcaggctaggacagtgttctcctctgtatggtaatgacagtgccctaggggtgattgtccagttttaccacatggttatgaaagaaactaagagtttgctgagaaatccacattagggggtgtgcccattagactagggcatctctcctcctacggggccgtctccacggagggcgtgtcacctctctgcgttcctattgaccacgtgagtcagtgaggcctgtccagacaggcttgaccacagaccatttctatcattaggagaatgttccttgagaaaccacccagtgcgcagaggttacgcagtttgtcccaggaccaggagttgtggatgaggcccccaaatgcagagctctgtcctcttcctgggcttgtttttgttttgttttgttttgttttctgagcttggtttttttgtttgtttgtttgtttgtttgtttgtttgttttttgagatggagtctcgctctgtcacccaggctggagtgcagtggtgtgatcttggctcactgcaacctctgcctccaggttcaagtgattttccacgggccaaaggactggccctgtctttcaaaaggtggagggtgactgtgtgtgtgcacttgcatgtgtgtgtgttcttatgctgcttctaaccatttctcccaccttcccctgaaggccagtcattccttctcagaacccttagggagagtagacctcccaccccaccccaccccaccacaccccacccatcatgtgtttctgagtcggaaaggactggagcccagtctcctttgaagactcaaatctgagccccctaaaaaacaaactgtgtagagcaggaggaagactcacatttgttgagagggccaggccctgggctaggtcagctgcctgagttaccttcccccgcctccatcactcacttcatcccaggcacgctgccacctgttggtccctgggaagggccagccagctctggtgtggttccagtgctgcacaagtggtgtgtctggaatgcaccccacacacacaccttgcccagctggctccccttgtccttcaggcaccaccaccccgccccagcccccagcaattcagcccatcgtactcttacagaaacacctggtttgtttttgtttttgtttttttaactatattatcatttattaaatgtaattaggtagctctggatccttggtctgttttttttttcttttattattattatactttaagttttagggtacatgtgcacaatgtgcaggttagttacatatgtatacatgtgccatgctggtgtgctgcacccattagctcatcatttagcattaggtatatctcctaatgctatccctcccctctccccccatcccaccacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtgttccatggtgtatatgtgccacattttcttaatccagtctatcattgttggacatttgggtgggttccaagtctttgctattgtgaatagtgctgcaataaacacacgtgtgcatgtgtctttatagcagcatgatttatagtcctttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgagaaacacctgctttgaagtcacatattgcagtgtcatggatttgtttgtatttgaatactgatcgctttctgaccttcactttctccattagactctaagctccaagaagtcagggaccttgtctgttttgctccctactaggagcttagtcacaggcacatagcagttgctcaataaatgctgaatgaataagtgagtgtatcttgttggcaccattaagttagtagctaagagcttgggctccaagtcagcagatgtggtcctgacccagcagtgagtagcactgtgatctccaggatgctgtttgacccatccaagcctcagtttccgtttctgtaagaaacaggataattattataccttccctgtagggcacaattgggaggattatgaaccatttctcaatggtccatttgagaaagcatttagcacaatgtttggcacatgctaatcaatagtatgttaactgatgttaactcattattaatcatagtctcacagctaccatgtgagttgccaagtccgtaaaaatccttatttggcagatgaagaaagagactcagagcaggtaattgacttgctcagggctcacagcaagtaagtgattgaaccaggcccccaggcgctgtgaccccagacggcctattttgaggggagcacatcctatctcctgggcattacacaaagcacttgtgtattttttccatctcaatatcctcagtgagatagacactattatccctgttttatggatgagaaaacagggtttaaggtgaagcagttgctcacagatgcccagtgagtcagtgataggatgggctccaaaaagggctcactggctgggcacggtggctcacgcctgtaatcccagcactttgggaggctgaggtaggcagatcgcttcaggtcaggagttcgagatcagcctggccaacacagcaaaaacccatctctactaaaaatacaaacattagccaggcgtggtggcaggcgcctgtaatcccagctactcgggaggctgaggtaggagaatcgcttgaacccaggaggcagaggttgcagtgagctgagatcgtgccacagcactccagcctgggggacaagagcgaaactccatctcaaaaaaacaaaactaggctgactgcttactccataactctgccactgagccacatcattctcagaggtcagaaaaccacctttagcttctgctgtttcatgaggaagggaatctgcagaaaggaaacaaaagctgagagaaaagagtggggaagtggggttgatcattttgtcttgttccatactcatgtgttttgggtctgttcatttaaactgtttgtgagcccacacctggtccatggaaggcagtgaggccacgtgcttgggagagatccagacatggttgggacgagcctggcccctccaggggtctctggggctcctgggatttgaattcataatgatcgtgctttggatctacttgcagggccctgggaaagagtcacacctctgcccgttcttcttaaaggcaggcttggttcaggtgtggacgcttatgcagaggtctgttatagtggcagttgccacctgctgcttgtggacaccttgccatcattagacacacatgcagctagcctctgaggagggtgggggttccaattctccagggaaggataatgaggctcagagaggttagataacaggcccagagtcactcagctagtaagaggcaatgcaggggccaggtgcggtggctcatgcctgtaatcccagcactttgggaggccaaagcgggcgttcgagaccagcctgtccaatatggtgaaaccccgtctctactaaaaaatacaaaaattagctgggcgtgctggtgtgcacctgttgtcccagctgctcgggaggctgaggcaggagaattgcttgaacccgggagaaagtgagctgagattgcaccactgcactccagcctgggtgacagagtgagactccgtctcaaaaaaaaagaaaaaaaaagaggcaaagtaggaccacgggagtccaaagcccaggctgttttgactgcgccaggtgggcttcagagggaagggcgcacacttggcacgctccgtagctggagaggttcagagtggacttgttctttctgagctcaagggcccaagctcctatgccccttggcctgcccagcacagccccaggtgacccctccccagccccactcctcactgccacagtaaagatgaacatctgtgtcttcaggtggaccaaggaggatttggagctaattaacaagtgggccttccaaggggagagaatgattcacgggaacccctccggagtggacaatgctgtcagcacctggggtaggtgtggcctcaggtttattttattgttgttattttaaaaattcttattacaatggtaggtgcccaagagtctgtgctggtttgggaggaatcgaatcaatggattctggaaaaaatagcattttcctattttggggggaatggggagaaatcttggggccctgtctcacaccccctgaatcagaatctccgggggtggaactggggcctgggaagctgcagcttccacgagctccccaagagagttgtaggttcaggatgcagagccgttgccgtggagtttgcacaccatccaggtggcctcccctctggcaagaactcttgcttacagggcccagatgctgtgtcctgggccccaccttcaccatgtggcttgtcgggggaagctggacagtctggagggagggggacccaggaatccaaggcctggcaagagcttcctggtggggcttcggggaccttttgccctcctgcaccttttgtaactgaagctgggctgactcattacttagcctctttcctgaatggggcaaaatgaacccaacccaaagttcaacctctctcccaagtagcacagatatgttagcttttcccacagctctgacccactggtttttctctttaggaggagccctccgataccatcaagggaagatttcatccttaaagaggtaacctgggggtggagcagcacattcagccatggctgcattgatgtgtgcagggggcagagctctgcacctttgggaagtaccataggaggcaggtgtccctggctcttcatcccccaatgtggccctcacagtgcactagctgcaaggaagcaggggtggtggggaagacctgctctctccttctccccttcagctcttaaattgcagagatatcagaaagggaaagtcatgcatggctgtgcccgtagactctcagctgctcattcattcattcctgtatttgcttagtaaacaagaatccattacttcctgtgttcccgatgatgctgcactggggcgtaggaatggagagatgaagcttgggtacagtttccaaggactctcagtctgcttgtgggggtggggccagacacacacaaaagccgccacaggacaatgtgagagtcaccatgatggaggcacacagggcagaggcaggatggaagcgggagggaggcttgggaggggcttggagcagaagtgacatttggagactctcagcctgttttatgtttctgtgtccctcccgctggaatcattggaatcacaaacgtgcatgtgcgatttcagcattctctgttctgtttgcgatttcagcatcctctgttctgtttgcacccacggcagaattgttgggtgcctggaatgaaacgcatggcagaggggagccaggtgcctttttgactgttccctaagcccttgatcaagttgtggggtggtgtttgtcccagggcactttgccacctccatgggccttttcgcatcagtaagggtcctggggctctctcctctttactcagggcggtcttcatggatgagtggcaggtcctggcctgcagcccccaccagctgggccactccattagtggctcagtaacctggcctgccacagcgccacacctgggcccccggctagttctctgggatctttctgtcccagctcagtcatgcctccctttccaaggctgtacgtcagagttgtcagcattggcactattgagatttggggctgggttattctttgtggtggggctgccctgtgcattgtagccatccccagcccctacccactagatgccagtagcaccctcagcgtggcaatcaaaaacatctccagacattgcttagtgtcccttgggaggcagaatcacccttgccgccgacctttgcactccgcagaagccagtaggagcgtggaacagcttcctcgggttgctccagcagtcgtcaggagagcctcgggtgccgaggtgaagctggtctgccaccgccccggatccatgtggaaccagagctggatcatgtgggggagtctcaaatgcccgggccccggcctgtcttcaggagcccacggtctgatggggaaggcggtcactggaatcgtcagagagaagacacctgaagggttgtgaagctgctgtgggtgacagtgacaggcgtcttagatctggctgcgagcctggggaatcattcatggaagtggtggcatttcattccttcagtgtctcctgagagccacttgtggcctaagcactggactaggccctggagctagaaaactgatgaagacgtgggctgggcaccgagtgtacggtctactgggggcatcaggagatgaatgaggaggtttccaaggggggcgggcaggggaacggccaggggaatggccaggcgttgctggtgtgctgggcggaggcgctgggtccacaggcctaggtttgagtccagctctcccacttgccagctggtgccctcaggtgagtcacttctcccagacctccagctccttgtttacttagggggatcttgaacatacaatcagaagcggtggctctgaagtgcttacctgtttgctggccgagttcattcatcctttccacaagtatcattaagcacctactgcgtgctgagtactggggcctccgcagggaacaaaacaaagccccgcctccgtggaactcatactttgttgggagaggagaaaaaatcagttgtctgtgagagcatatcaggcagtcttaagcacctttaggaaacaaggcagggtcagaggctacaaagagaaggaggggtccgattggatgggggttcgggggctgctggtgaaggaacattgagcagaaacctgaataagtcacgccgctatggggcggggctggtccctggcagaggaagcgcggtgcaaaggtcctgagacgagcacgctgcctgccgtgtgacacagtagctgggaggtcagagtggctgagtggagtgagcagcctggggagcgaggagagaagaagaggctggggcagtggccaagcccggatcacaggagcgcttaccaggcttaccccctgcgtggtggccgctggatgggtatgagccctggatctggtggggctggtgacaggcctgtctgcagaggacttgtctaagaaagatgaagatgcaacacccaaactcctcccgcctggctagatgggagcatggagcaaaccaacctttgctgcctgctgtggggtgccacgggagcagatggcggcttcacagagaagctgggggccagactccacgttaatcccatggatggcttaaggagcttccccccaccaaccatgcgtggtgcctctctgtaaagaaaaaatgcattgtttgtgaagtggatcaagatgcggcctcccagaacgctgcccttttgaggaatggcttgtcttagaagggaagagaaaagccaaatagaatgttcatcttttgtaaagttaaaaaaaaaaaaaagccagcctccaaggctgagaatcgatattaatttcatgggcttatgggcagtgagataaagcaggtttctggcagccctttccagccctattggattttacaatcttgaactgtgaagacagcgaataaaggtatcaagggctctgcccgtctccagctgtctcgggccagagctcatccaaatcccccaccttccatcccagcctgcagccctctgaaaggcaggttggatggcaagaaatgtcagcttgagccctcgaagacggctcactacaaggacagttgggattgtggctttaggagggatttatgcagctcctctggggcaggtgaggaccacggggtcatgctagagagtcagctcaacgtggctgcctgggacacgtctatgtgccagagggcagccaaggggatgactgactctacatctggttttagaccagggctgctcgtccgggcaccattgaggtagggcaagaatgggctcagcgtgctggggaccatcctcctctgcaaccctgccctccctgcatttacgagcccgtgcgtggcactgcccgcaccagctagcctgggcatcttccctctgtgtgatccatttcagggcctgttgcttggtctttctaaaactccagcttcgtgggggtgacccacacaagtgaaccttcgccccctccttgtactctgctatagccactttgaatttctcactggatgactgtgccgggttccgccacctccaggctcacacaggctgctccaactgccagaaatcctcacccttctagctttgcttggtggcttcttacccttcctcagttctcagtgtccacgtcatgccagaaaaaccttctcggcccttctcccctatcccctctctggccccggccccaaggccacgctgtgcctagcatgttgtaggtcccagttgaagttgaatgaataaatgagtgaaaagccaagggagaatggccacccaaccagtgcctgggatggaggcgcagctgtggccagcagcagaagccccatgctcccccaatccagtgtcacctcttgtgcctcccttcttcctccgtatcagggtgggcggcttcccggactgctcccagtcctgtcccagctcctccatcttgagttcagtgtggacctgcctcctcttcaccctgcaggtcgccagctctccagatcctgctgaccaacaccaaagtccctcgcaataccagggcccttgtggctggcgtcagaaacaggctgctcaaggtgactcttgttcccttcttgggcaggtttcaggaaggccaggacacaattacatctggattttcgaggtctccctctggctgatgggttatagggggtgtggtgggtggtgggggcccttagggaggtggttttggcagaaaagaaggtaccgtccgtgcccgtagcctggccaggaaaatgacagtggtcgggctcgttagacacactgactttgcagctgggaaggcaaaaaaacaggctcagaagagaggtggtttccccagaggatgggcacgggctgtgtgaacacctcctccctccaccccactgctggggcagctgtcctgcatctgcctgcccccaggcctcaccagccgttccttctttttttctccagttcccagagatcgtggcccccctcctgacctcaatagatgccatctccctggagtgtgagcgcgtgctgggagagatgggggaagccccagccccggagcagtacctcgtgctggaagtaagagcctgtctgcaggaaccggggttactgagtccacaccactgtccaaggcagtggctctgcaatctggctgtgctcagaatcccccggaagctagcacatagaggtcaggacctgcctctggcctatgctctcagctgggcccaggtctgtgcgtgccatataagcgtatcttattttcaggcctcttcctgggtgattccgagtaattgggagagtgcaagggaggccagggcctggctcgtgctaagtgcaatggaaacaggtttgggtcacttctaaggagctctggcccacgtaggtagatggggatgtggctgatgcagagtgctctgtcggtgcaggggtgacttcttggtcactctcctgctattgctaacttcatgggtgcattcaacaactacttgtcaactgcctgctttgggtcagacagatcctaacattgttttttcatcattgcaaccccatccactgccatttgcataattctagtgtagaggttgtgacctggtactttgggtgtgatcaggcctgtgtgtgaatcccagctccacttctgctggacgtgtggcctcgctagagtgtcttaagaatgctcagattagacgggcgcagtggctcacctgtagtattagcactttgggaggccaaggcaggtggattgcttgagtccaggagttcgagaccaggctgggcaatgtggtgaaactctgtctctacaaaaaatacaaaagttagccagacatgacggtacatatcggtagtcccagctactcgagaggctgaggcaggaggatcacttgagcccaggaggtcaagtttgtagcctgggcgacagaatgagaccttgtctcacacacacacaaaaaatgcttggagtctcatgggtgacacgcaagcacaatgtctggtgtgctatgagcttagggaaccaaagagcccaggctccccctggacacagtccacctggcctggtgaatatgggctgttagccatctggctgcccttgcagaatgagaggatcgggtggcccctagctgccgtggctgtgcagcagccgtcagtgaagggacaggagaggggcgtgcggtctccatgtcaccacagtccctccccgcgccccgcactctgtagtcattgcctggtgtctcccggtcccccgtgggcattcgagtctgtagcccctgtgctgagtggaagctgccactaaagcaagccttttacaaatgattcttttcacttgatcctcacacccacctccctgtgaagtaggtgtcttatccctattttacagatgtaaaaactgaggcctgaagagagacttcccccaaggttatccagctagtgagtggccgagccaggggtccagccgacggactggtctgtccctttattcaacagatctgtcatgagcacctactatgtgccagggcagcgcctccatcgaattcctgtgtttcggccctcattccctcagtctttgtcttcctagctctcaattccttccacatagaaaggagggaacacagtccccccgagtaggaaatcaataatgatagaatactgcctaaaatacaccctgtcgagtccctggagaatgccacagaacagcacgttgattatacattgtgtgtatttttggctgtggcagccgctgaaatgtgcagctcagctcctggacagctttgcactcaaaccagcgaactgttctcctgtgtcacaacctgtcatctgatccttgacagattttggatcagaatgtgacaggtgtctggaacctgcctcggcaacgtgacacctggtgctcaggcgcagagagcggcccccagaagtcttctctcacatccagcccatcaggctggtgagaggcacccggggctgccaccaggccatcatgcctgtctgctcatttgtcaaaaatggtgagcttggcgcagagcgaggtatgaggcaggctgttggggagggccactccaaccctgcctgaccggccatccccatgcgggagagctaggtgggcctccgcagagatgcctcagtgattggcaactcctggtatacaggcaatccaggtgccccggaacagagcttcacacggaagtgaggaatgccagggggtgctctcagaggcagggtagacaggagcttcatgtcaggcagacccgccttccagtgccagcttggtacctactagctcagtgatcgtgggcaagtcacttcttctctgagcctctgtttccccttttgtaaagtggggatgatgctaacgtacccataaaaatactaacagcacatatctcgtgccaggcattgaacagaaaactcaccttgtttcgtctcagggcaaagaagcagatttttttttttttttttttttttgagacagagtcatcttgctctgtcgcccaggctggagtgcagtggcacaatcttggctcattgcatcctcccaggttcaaatgatcctcgtgccgcagcctcctgagtagctgggattacaggcacacgccaacatacgtggctgatttttgtatatttagtagagatggggtttcgccatgttggccaggctggtctcaaactcctgacctcaagtgatccacccgcctcgacctcccaaagtgctgggattaaagacgtgagccaccacaccctgctgaggcagatactcttatgaccccggtttacaagcaggagacagacccagtgcagaagaccttgctcaaggacacacgaccaaaaaggggcagagcagagactcgaacacaggcctacttgactccaaatcccatggtttttacttcctgatggctgggaccgtggctgggcacccatccttagagccccagcacgttgtgggtgtttggtaaatgaaatctaactactgggtgcctgggcagtggaagctgtgaagttttattttttcatccacatgcatcttgttggatccttaaagagcaggaagtttatcctgcataactgaagaaacctagacaaacagctgtttccctgcttatggccttgctggagttacacctagttcttattctgaaaccagtccccaaggcagctgtagggaggcatgttatttgaaactttttctcttgcaaatggcagaaatccatttcaaccagacttttgtagaaagggaatgtattggctctcaactgagaagaccagaggtaaatggcttcaggtatagctcaatccaggggctgaaacaatgtgtcgggaatctgtccatctgccacgtaatatctgatcatgtggcaagataggtcatcttggcgacttgtgtctgaagttaattattttagcagctctagtgggaaggggcagaggaaaccctgggagggctgtgattggcccagcttggaccacatgcccatccctgatcagtcaccagtgccagaggcttctgtgaccagccctaggatatgtgctcactgctgtggtgaaggtatgctcagctctacccaagctccgtgagaaatgctgcagggcagaaggattcttttacaagtggagagggccagggtgccaggtaggcaaagccgttggctgtctccagccaacaactgtcagatggacgaggcaggctcaggggtgggcataggaccttggcctcaggcaggccaagtgggaacagatggaaccttctcccctaggagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccaggtatcccgggggtaggtgggccaggctgccagcctgggctcctaagaggggtccacctggagaattcccttgaaaggaaaaagagacctggaaacaggtctcagctccgctgtgtggccttgggcaagttagttaacctctggtctttgcttcctcattggtaaaataaggatgagagtatctagcttgcaagattgttgcccagattcaagcaggaaagtgcacctagagagcctggtgcagggctgggctgtggctggggctcctgtcatcggggctgtccgcacaagcttgggaagtaaccagggcattgtcactctccacgtctgcctaaccttgccccacttgtacccttgatgtggtcaggatgcggttgattttgctacaaaacgaaagggtttccttcccgttggtttggggaaagaggaagaccgagtaatgggcttggcttaggaagctccctggtgcctgggggcctggcaaggggcttctgctagtgtttaaccacctgacacctacctctgccctcaggctcgctcctggcctacagtaggcactaaccggtcccacctgcctccatttccctctgtgctccttgtcccctccttccttccttctttctctttctgtctttatctcctcctctctgttcttcatccttcctttcccctctgctttgcactgagcccccttaggctccagacatcccctcacactccatgatggctcccaggcctcaggaggtggccacatcctcactccagccaaccccaactgttggttcctagttcagagcccatgacgatggtgggacttgacatttctggagtgtgcccgctgtgccaggtgttgtgccaggcactttacctgcgttatttcctttaagcctccctgagatctgcacggggagtcatcattagccccattcccagatgaggagactgagactgagagaggggaagtcacttgtctgaggccacacggccagtacaaggcaaggccaagtcctgtgacttgagagcccatgtttttaactcttgctccctaaacccctgggggtgcaaggctgggcattccagtgcacggaggggctgcaggtaaccttgggctttatggcctgttggctcaggtgggtcacagccaggaaggcacagcaggaaggcctgggcttttgccttgaatatgatgagcttctcccacggagcggagagttgtcaagggtgacctgccttccctccccgcagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagtagagactccaggccaccagcacctccctctgtccctgtcccctctccagctgtttcctccatggagctcttcagcaatggagggaaatagggtttggggtcactttgttgtgcgtcttggggatgaggtggcttttcccagatggcccttgctggagagggactgggacacggctctcagtccatcagcacaactctaggctgctgctgcggagggagaagttgagcttcctagctccagaatcacaagcacccacgagagcacagacctgtgtaagacaggaaagcagaacctgccatcgctcctggggcgcgccttcctttctgaaatgaactggctggatggagaaaacagactcaaatgttctggcccgggtgcctggcactccccacccccgccccccaccggccctatttgaactttatattgcagtcagcttggtgctttccgaaatgccattagccatcaggaaacccttgtagttggtgccttgccagccagaacctctgggacccacggacctgcaaagaggccgagtggaaaggtgggggccggcgcagggatttcaggatgaggtgaaagcgattcagtgcgcgtctgcccttggccactagggggcagctggcggccttccctgctgttgtcttcctgcagggtgagaggagcaggagccgagctccacccccacgccagccttgggcccggcctgggatcactgctgggaacgtgagagtgaagggaggacgcctaccccagcttaacttgtagaaatggccccagatcactgatggctgttccctgccccttcccttcaaaacacaacgcataaagcagtaatactaattaatactgaacgctcactgtggactaggcgtgtttacgcatcgccccttctcatctctgccccgacctcagtgtcattgctagtctcatccccgctttacagaccaggaaaccaaaggtcagagagatcgagtaactggtgcaagtccacacagctcatcagcatctgaggccggattcaaatggactccagagcctgctcttagcccctacgtgtgtctgctgggtgcggctctgtgtgcaggctcactgcgattttttagctttctgtgctcaggctcgtttttctggattcggatgtatttgaccggggtggggctcggacctgcatgttttcctccccacgcgattttaatgaacaaccaggccagaggctgctgtgccctcagtgatggcgctggctgacagccagcctccagcctttaggaggtgggcctgggagcctccccaggcttccatagatgtccgcggcagctgtgagatgggtgcaggggacagaggctgagacccccagagcccgtctgctccttgaggccctctctctctcattccctggggacaggatgtcactcctggggcaggggccagctcaacactcttgctccagtgaagcagctgccggtgcgctttggccagagcaacctttcaacccagccacccctgcggccaccatatgggcctggtgtcacactcctggctaccttgtagacagttggcacttgcggctgtcaccccttctcattgcctattgcagtggttctcgctctcagagctgcacctcggaaccacctaaggacccacgaattcctgactccaccccagatattctgagttaatctgtctcagcggtatctttttaaaaagacatcttttaaaagctcccaggtgattctaacgtgtgaccaagcaccacatggtgctgcacacctgtagtcccagctactcaggacgctgaggcaggaggatcgcctgagcccaggagttggaggctgcagtgagctatgatggtgccactgcactccagcctggatgacagagtgagaccccgtctcaaaaatatttttaaaaaataagaaaatgcagccagggctgaagataccgaactggatgaccccagggtcatctctgcacgccattgtggtggttgagcacttcagccct

SEQ ID NO: 16562 - DNA, 32099 bp, Human
  misc_feature (1)...(32099): n = A,T,C or G
aggtgggcaaacaggcccagagggagttttcctaccctgaggcaggcaacccttccagttcttgacctcttgggaccaaaagtggggttacacttgttcagaagtagaggatctggattaggaaaagccatctaatatttatctctctagtatttagcacagtgtctggcacttacaagggccttaagaaatacagtacctcagtgattgtgtatttagtaaattctggggaaagctgctgaagtagccttgaagcctacagataccagtgttgtctggttgtatttgttaggattcttggttgcaggtgacagaagccattagacaaaaaagggggtttcactgaaaggattctgggggaaatgactagccaagacttcagaaaggcaggatgtatgtgggcttcaggagcctgtgggagttggggtcataacattgcaggcctccacctgtgtcctggtatttcttccattattgctcagagcaagaccagatgcatctgctcctttgacttcttagcaggaaacaaggctgtagacagtgccagagcttttttttttttttttagacagagtcttgctctattgcccagattggagtgcagtggcacgatctcagctcactgcaacctccgtctcctgggttcaagcaattctgcctcagcctttcgagtagctgggattacaggcacgcgccaccacacctggttgatttttgtattgttagtagagacggggtttcaccatgttggccaggctggtctcaaattcctgacctcaggtgatcctccagtcttggcctcccgaagtgctgggattgcaggcatgagccactgcgcctgtgagttttacgtcacagctttgctacccagagagactactagatcgaaaatccctaggaaggactctggttgatgtagcttaaccagtcagggtccttcagaagaggtattcctggcaagggggtagcctcccatttgaggctgtcaaaataatgtgcacacttcagtaggttgttagaagtggcctcctggtcagtgaatcatcagtgggatcagatgaaagttattcctaccagttatctaagaaataggaaacttgaagtttctgctaagaactaagtccacacggaatgctagagatcatgctgcaaaatgaagactcatttgtttgtgagtggtagtccatgaaatctatcctttctttgccagcaggcgttcagcaatctggattttatattctatcaagacaaagagtagagatgactcaaacatttctaacatttatagagcacttagtgacatgcccctggtacttccctaaacattttacatgtgtcatctcctttaatcctcacaagaacgctatggtctaagtattattattccaatttaaaagagaaggttggggacagtgacacacacctggacttacagcactttgggaggccgaggcgggaagattgcttgaggccagaagttggataccagcctgggcaacataaggagacccccttctttaccgctcccccactcccgccaaaaatttagccgggcaatgtggcacgtgcctgtagtcccagctactcaggaggctgaggcaggaggatcgcttgagcccacgagttcgagatcgcagtaagctatgatcattccactgtactgcagcctgggtaacagagaccctgtcgctaaataaataaatagacctgagttggaatatcggctctggagaccttagtgtaaccatgcgcaagtgtttactcacctattaaatgagactaaaggtattttcttctcatgactatatatagcataccactaagccctctagacatcatattccccatccatcgccccgtccagtggaccagggatgaagcggggatgcgctaggcatcccggtttgtcaccagggggcgtgcgaggccctcagcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtaagtctgtgggcccgtcctcccttcgctggcccagatttcgggctccgactcctacctggagtgtgaatggcagtccttgacggacagccttcaccgtttgctgggcccctagcctggcccttggtttctgacctttattctcccggctcggcctcccttccccacctcgcgtctcgccagcttccctcatgtccttccttcccccgggcatcttcgttttctgcacagaaccacccccgccgcccgactttcttccccccagttactcatcgcgatatctatgttttaatgtctgtgttctctactaagattgttagctccataagacttgagactatgtctgttttggtctccatcatctaaccagcacagtacctggtacataattggcattcagtaagtatgaatgaaggaataaattaatacataattttagtagattagttaactgcccttctttcgtcattgttcagttgaagaatacctgctatccctccaaagtgtataaaaactcatgttgcaatgggtaccttatatttgacaaaaaaaaaaaaaaaattaacacgagctcatttcttgtactttgcggatgtgctaatttaacttgctcctttggatacttggcatctagcaagagaactacccccttggggggttgaggatttgagaaggcatcggggaggattatctcgaaactgactcactgctgaatgtgtgcttggtttctcccactaggaaaaacagtaccagttttactgtcatcttgcaacagcacacatatcagtgcttcagagatgatttggaaatttgatgtgaaagactaataagatcaagtctttattcaaaagttaatgcagtagctgcattttattcactgattataggcaaatcagtactttgcctactgtctgttttcttcatctcataagtaattgcaaaaatgagattttctggttgattagacttctgagccagtcctttgtaaatcacaccgctctccttttccttataatctttcattattaagagccactaattgtgtgtgtgtgttttttttgtctctgccccccctttttttttttttttcatttttaggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtaggtggttggataaaaaaactgaagtaacagtatttatgaaagatgtctccaaatttaaaacagggatgattattaatattctcaacctttttcatatcatagcacatgtagaaaattatatttatataacttactggttaaatcaaccctgcctggcagccagaaagccagaccctttccagctgtctcagggctgaaaatacccatatcttgacacactagttgggaggctctgtcataaatattacagcaatgagcaccattcagttttaccttaacaaatatttatgtgcctgctatgtgtctggcactgtggtaacccttggggacctatgtgtgaccagagtagaggatctctaccccagtgacactttgagttgggagagtgggttgacccatcaaacaaataattttagatgtataattacaataatttttccaaaggaggtgattgcaagttagtgtagtataattaaggaacagtaaaaagtttgatgagaggctgggcgtggtggctcacacctgtaatcccagtactttgggaggctgaggcgtttgagctcaggagtttgagatgagcctggccaacatggcaaaaccgcgtttctacaaaaaatacaaaaattagctgggcgtggtggtgcacctctgtggttccagctacttgggggactgagatgggaggatctcttgagcccaggaggtgggggttgcagtgagccaagatcgcagcaccacactccagcttaggcaacagagggagaatgtgtctcaaaaaaaaaaaaaagtgtgatgagagattataacacaagaacctgattttgattagtaaggcttctctggaaaagtggactgaagagtgaacggaaattacttaggcaaggggttgaatgtgccatgggatatggagaagagcattctaggaagaaaggaacatttgcatcttcggaggcccccaatgtggacaggagttttgttcttttagggaactaaaagagtgccagtagatgaatgagggggaaggtgatgtgaaatgatgctggagaagtaagcaggtgtgtcagtttattcatgtgtccttatgtcttgatagggtcctgtagaattgccagatcttgataattaatgtcaaattggtttctaggtagattcttcaagtttacactcctagcatcattgtttcttctctctctcaaccttcacctatggtgagcattactgagctttaccaatttaatgctcattttacttgtgtttattgattatcaatgagggttaacatgctgtgaattagtcttttttggtaagttattctttacctatttcagttggggtattctcttttgaatttatttgtaaaagttcttttatttattaaggatattaccttttgtcacagttgttttgttcccttttgttatttgctttttaatttgctgtgtgttccacatattctcctttgctttaaaatgtgtgctatggctatgcatattaaaatgctgatattaaagttagtgtgtgccattctagagtgcacagcaaccagcagaataacaggaggcttggaatgtacttggtgttagacagaaactgatgtaagtgaaaactttatcaagcatataagaaaacctgggcattttatattgtataataagtcttgtgagctgtgtacttttgaggcaataaaatagagccaattaatattatttgaaaatagggagcaatgtacctgtgttttacttgattttaatgtaaaaggtcttctgttttcagtaatgatggactgagttattcagatagaatcttcctgctgaaacagaaaatgttagtatataaaaagtgtatatctgtattttttttacctttttttttgagatggatttttgctatgttgcctaggctggtcttgaatttctgggttcaagtgaccctcctgcctcagcctcctgagtagctgggattacaggtatgtgccactatgcccaactaaaagtatatcttttaaaaaatggcttaagaaaaatgaagagccagcagcatagtggcgaattgctaggttagtgttggtgggagaaagcgagaatccaaagaggtaagcgcagtcttggcaaaccaaaaccacatttgcctttgaattcacagcattatggggtgaggaggattgaaggaaagacctaagactcacccaaggtagattgtcctgtaggtcttgcagtgtaggagacccttcctgtgttaccctggaactccaaagggctacatcctcagggaagagtgaactagaactaacttccctgcccactcttagggactacatggaaggttgtcttggcactgaacggagaaaggtcaaaaggaagataaaaagtttgttccagagaaggtaaagtcaaaaactggctatcatgcagacttacagcccaaatctgtgcatcgagaggagatcagggaaccttaatccctgagcatggtttaatacggttctccactgggaatactgctagacaccttacagcagtaaatttatatcttttctcaaggaaggtatctttttaggtctttggaaattcctacaaattgcttttccagggcagtaagcaccagccaaagataactagctgtagaaggaagtgattccaatggtaatgacacttagaaatttactaatgataaatttttctgtattattctttataaagtgattctaaaaagctacatatatgatactttactgtaaactttgggatctgatactaaatttttcttggctgaatgaaatcaccttggaatcagtgacttcattgttctccattttacacttctttgaataacagtctgagtatgtttcatttgttgtcataacttttgtagtttaagaaagtctcacctcacgatagtgcaataggtagtgttaggatttgctaatgttctctgtgacaaaccattctggaggtgtcagaaaataaataaaatctgagatttcttctctcctatgtggtacccagatattctgttttagaaatttctgggtggagctcataacttaaatgtttattttgtcatggttcgagaggcagtaagcaagatatcagagacactcctctccccaaggctgtgcttgcctagaacaaattgttttgtgtctatatatatccattatttcagtacacataaacttgtcaaatacaatcgtacaaaatacaatacatgggagtcttttttaaaaaacaagagtttatttagtagccaagctttttatatagtttagtgttttgattggtgattgtttttacttaaaatactattcagaggagtttttctttaactggaaaggccagagtcaaaattatatgagatagctacactgtatgaaaagcattctttcctagactagtactttctaaattcagatgaagtatctgaactatcccaggaacttgagacatgcatgcaatccctaatactagctgcttggagagacaccagccagtagcaaccagcttgccttgcttagagaatcttgagggacatttgtctactgataacatatccattttgtgtgtttttcttcaggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtgtaggcatactttgggggagggatgggaatatggggctgatgttatgcatacaacaggaattagaggtttaaaaacctaggagccaaaccttaaaacttgagaatttccatactcttatttttcttcctgacaatatgtctcttctttcaatcacataccgagacatttttaaacaggttgaatgaggaaaactaagtgctatgtgaagggaactagaaagccactgggagctgaagctactcacttttatttatttatttttttgagacggagtctcactcactctgttgcccaggtcggagcacagtggcttgatctcggcgcactgcaacctctgcctcccaggttcaagcaattcctgtgcctcagcctcttgagtggctgggattacaggggtgcgtcaccatgctcagctaatttttgtttgtttgtttatttattttttgagatggagtctctctctgtcacccaggctggagtacaatggcacgatcttggctcactgtaacctccgcctcccgggttcaagtgattctcctgcctcagcctcccgagtagctgggattacaggttcccgccaccacacccaggtgttttgtatttttagtagagatggggtttcaccacgttggccaggctggtctcaaactcctgacctcaggtgatccacctgcctcggcctcccaaagtgctgggattacaggcgtgagccactgtgctcagccactcacttatttttaattagttaattagagacagagtctcgctttgatgcccaggctggagtacagtggtggaatcatagcttactgtagtcttgaactcctaggcttatacggtcctctttcctcagcttcccgactaactaggactatagtcatgtttcatcatgcctggctaatttattttaaaaaatttttttaatttgtagaaatttatagaaaaggtgaaaaaatagtacaacaaacattgatacatttactttacatatacatatgtaaattctgcaaccattgacaaagttgcagacatgttttatttctaaatggattgctcaggagtatgcatcatctaagaatgaggatgtttatatatatgagtatatataaatacaagtatcacaccaagaagtgtatactaatacatttttatatatttgtgcagtaatattatctaaaatacaatgtatagtcagctttcccacatggtcctaattatgacctttatagcttttttgattcagtattcaatcatgaatcacacattacatttagttatcatatttctttagtcttctttaatctagaatgatttccctgccaaaaagtgggaggagtgtctttcatgatattgacaattgttgcgtaaactattggtgattatgtcattaagatagtaattctcaaccttggacactcattataatcacctggagaagtttttgcagtcctgatgcccagacctgaacctcatacttacaaaactggaaactctcagggatgagacccaggcatcaatatcaatatttttaaagctccctagattattccaatgtgcacccaagattgagagcgactgcttgaagagaaggtacttgtagcattggcagttagtatagatcagtgaggaaattacagtgaggtagagccttgtatatttgggtgaaaaatgtgaagtgaatgaacacatagtggccagatattcagaagaacaaggacgttttctctgccacttttgaactagtatgtttgtactgtactaaaataacttttgtgaaaattgatctctattgagaaactctttgccagaggcttaaaaccagaatttgcccttaagctttgtgttggaaatatttagttcttagaattcacgttataggtttggattttataattgataagcctacctgactacttactttatagtcctcattttgaataattattataagagctttctgtcctggaataattatggctttcatttattgaaacaagtagtcaataattgcctagcactaatgtttaaataagaaagtgtttttctgtgtctttttaataaaatatcttttaaaggggaaagcatttcagtgcaagttactatgtttctttctttacagaaagccatggctgaaaccttttacctttctaacattgtgcctcaggattttgataataattctggatattggaacaggtgagggatgagagttttaaaaacatgattctatggaagataaatgaagtgacaggagaatgtactgatgtgcctattagctgtttctgtctttgtttttcaaaagctaagcctctgaaggtaagtatgttgggccagttttctttgctgtgttttgggagtacagccttctacagaagatcagacttcaaaacgtagcctgcctttttgatcatgtttgccactgttcaaaagtcaagttttgaaagaaatgactcaaaataataatcttaataattgaggcagcatcttttttgagtgtgttcagtgaacactattattttctcttgtattccaatatttcttagctttttttaaaaaaacagttttgtatttcaagagctcctgagctttaggccagggtcagtggttcatgtctatagtctcagcacctggagaggccgaggcaggagaattgcttgaggccagcagtttgagactggcctgggacatagtgaagccttgtctctactaaaaatttaaaaaattaaccaagtgtggtggtccatgcctgtatcccagctactcaggaggctgaggtgggagaatcacttgagcccaggagtttgaggctatagtgagcggtgattgtgccactgcactccagtctggacaacagagcaagaccctatctcaaaaaaaaaagttcctgaacttaaaaaaagttggggtatagtttaatgtaactattaaccagtttttttgtttgttttttgtttttttgagacaaagtctcacactgtcgcccgggctggtgtgcagtggcacaatctcggctcactacaacctccgcctcccgggttcaagcgattctcctgcctcagcctcccgagtagctgggattataggcacacgccaccacacccggctaatttttgtatttttagtagacatggggtttcactatgttggccaggctagtcttgaactcctgacctcgtgatttgcccaccttggcctcccaaagtgctgggattacagacatgagccaccacgcacggccactattaaccagtttttgatagaacctaactataaaataatctgggccttctacatttttctgacactgtcaggtggcttctttatgcatctaaaactaacggtttgaggttctttcaggctattgtgtttttccccatatagtactttgtggtttaaaataatgaagagagcaccctgcaccaatgagagacttcagcagttatcagtcatggcgacatttgtttcatctacataccctcactttgccccactcagattatttttagcagattgcagatattttatccataaatgtttcgttacatatatttagaagataaggattcttttaaaatataaccacagtattattaatgcccttaaagaatttaacaataattctttattaccaattttatagtcagtgttcaaattttcctggttgtctttaattttttgttgttgttggttggtttgaaccaggattcaaataagatagacacaaaaatttggttgatatgtctctttagttcctataaatctgtagattttcctttctttttttttttcctccattcagattatctgttgaagatctaggatgtttgtcctagagtttcctttccatattctggatttgctgatcgcatacctgtggaagcatttaacattttcttttcccaagagataaatttctgggaggaaaactttaccttgtaattggacatatatatacaccctattaaaaataatttaaaaaaatttttaaggccagtcaagtgaagcagtgggagtagagaaggaacaaagaagtatgtaactggttgtgaacaattagttgtaaacaccactgcacttataccagcctataaaaataattggattttactttttagataagaaactgaggaatgaggacatgcattgttatctctcatttagaaatctcttccaactgggccgggtgcagtggctcatgcctgtaatgccagcactttgggaagccgaggtgggcagatcgcttgaggtcaggagttggagaccagtctgggcaacgtggcaaaactgtctattttagtagacactaaaaataaaaaaaaaattagccgagtgtggtggcacacacctaaaatcccagctactcgggaggctgaggcaggagaatcgcttaaacccaggagatggaggttgcagtgagctgagcctgggtgacagagtgagtgagactccgtctcaaaagaaaaaaaaaaaaaacttccaactgcagtcatatacatactttcatatgtatatgaaagtacatattacaactacttgccatttgggcacctgtaatcccagctactcgggaggttgaggcaggagaatcacttgaacccgggaggcagaggttgcagtgagctgagattgcaccattgcactgcagcctgggtgacagagtgagactccatctaaaaaaaagaaaaaaaaaatacttgccatttttatctggtaagttgacaaaaacagattttaaatgataaatcccagcattataaagattgttgtgaaactgctgtgttgtattttaattttttagagtaaattgatataaccctattaaaagcttatagagtaaattgatataaccctattaaaaatgttagttttacatatgatgacgagtctttaaaataaattcattcagtaattctggtccttgaaatttatcctaaggaattgatacaacgttgcattatataagaaatgttaacataagcccaattgtcctgcaagaggaatggttaaataaagtatatcatcttgttggaatgatacataattcttgaaagctggttgggaactatggcataaaaaaagttttaagttcatgaaatttgaattccagaatgtactctgagcgcacataaagaaaaatgtagatagttttgttagtgtatgtgatttttaagttttttctgtgcagtaagcaaactgggaaaataattgtttatatgcttataatgttttgtgccatgttcttgtttaatttctcaaatgcagtttttcttggtatctttcataggaattgatatgatttgctgctgtcttacatgtatatatgtgagaatatcatacatttttttatttgtttttcagaatagaaatgtactgtcgagagctgacagaaaggtttgaagatgtttgggtggtatctgggcctttgaccttacctcagactagaggcgatggaaagaaaatagttagttaccaggtaaggatgtttaatagtcaggtttatgttatctgtatgagattataatctcactttccattctgctttttatttttatttttatcattcaaaaaaaattttgcattctactttttaatttcacttattcaacaatatttattgaacacctattaggaatgataggcatagggaatatagtgatggataaaagcaactattgacttcaaggaactcacggtttagagtggaaaacagatgttaacaattaattacattaaagtgtgacatgctgtaatagaggtaaacacacacagtgtggtcttgtgaaaggactgatgggctctactcatatgagtcaggaacgcttaaaagaggaagtgatattgagctataccttgacagataagagtcaggagtggaccctgaggattccagaggatggagcaggatgagcacaggacatttgtggtcaacatcagggttttgagatttatatatcattcataaaaattggagcttatggtacaaaacagtgtgggtggctcaaggggtatgaagagttccataacaacaggtggacgggtgagataatatgcgactttctattctatgatgaagacttgggttttaatttttaggcactaagaagtcatagatttgttttaagcgtgggagaaatatgatatttgggttttataaagagtattttggcagcagcgtgtaaagagataggtgggaaaagggagcatttgaagaagagattagaggcaaggagatgagttaggacatacaagcagttggagtgaggaataatagaggaacacaggaaagagtaaccatgaataaataacttgtttgagtgaggaagagggagaagttccaggataacaactagattgcagaccaggctcagtggctcatgcctgtaatcccagcactttgggaggccgaggcaggcgatcacgaggtcaggagttcgagaccagcctggccaatatggtgaaaccccgtctctgctaaaaatacaaaaattatctgggtgtggtggcgtgtgcctgtagtcccagctacttgggagtctgaggcagaagaatcgcttgaacccaggaggcggaggttgcactgagccgagatcgcaccactgcactccagcctgggcgacagagcaagactccacctcgaaaaaaataaaaataaaaataaaataaaaacaaccagattacagtgttacagtgagttgaataaatgggaagaaaagcttttcttctagaagcttcttttttttaatatgcaagatatgtgagcacttttatagactgaaagagagattaaagataggagagtgtaattagtggtgtgagagcttcagacatctaatgttgctgggaaattcttagctagcctttcatattggcaatttacaaagtggtatacctgaagagcaggtgttcttagaaaaagtttaacatttaatcttatcatgcagaaatatcctgaggattcttccaagagggtggctgaaatgttatactatactgtgaggcttacagagggcagggaacaggtggagtgaagcagaagaggtggtagagtgagtaaaaagaagcactgaaggacttgctaataaggccaaagaggaggggagggaacacctagctcagctctggaaataaagtagatatttaataaatgctggttaggtaaatgattacttaagtctgtgataaaatttaataacctgaggaacagattgaggaaccacccccccccccaaaaaaaaaccaaaacttttagagtatattctgtccatttgacttgcttattatcagcctgtctagatcagatgtgcagtaatgtccaagcatccaaggatttgtataggtccatatgaatagcccactttctctttttccacacaaaattatgacccaactacttctttttgttaagtggaaatgatagagtagttgttttcaaggatttgtacatccttggaaaattccagtagatatgggagtgaaggaagtcaaaggaattagtattttaaaattaattcatttaatatctctcctcccatattaatttctctcctctgattaacttgctaatttaattttagtatattttatagtcttaggagaaaaaaaggcttaaagccccctgtattatttttcaaatattaattattcttggtctttgttaaatcctgtttattttatgtcagaaaagaggctcttctagctttgacttgtatatcttaaatggttaaattacagttttatttgtgctttgtttttataaaattgaaaaatttatatcactagcctactgtgtagtagaacaaaaatttgtacaatgtttaaaacgaaaaattaaccaataattacaagcatttcactacatagatttttgtgtggctatttctgtaaaatatgtgttgcccaaatgccgtagtggaaaatgtattgtttttcttaagttggatataatttttaaaaatagaactgataaaaatatatcttctagttgtttctgctgaaaaggcccagaagaattggtatgtcattagcaatgaacacatcttgagacccagatatttgtttctaaaaagcatctcctgaaaagactcagcgcttagagaaatgactgatttaaggggtggtacagggagagtacaaaatggaacatcatatatcagaaagccaaggaagtgctcagacaaatggtggggatatgtcagaaggacatgtgaatcagcttgaaggagctcccacttactgtatctggtgctattgaatatcaaaataaaatggattataaacctattgaattaaataagaatacatactcaataaatatgtaaatacatagggtgtaaagaaaagcttctgcataccatagaatgtcagttaatnnnnnnnnnnnnnnnnnnnnatcccattacccaagtgatcaagtttagtattgctagtaatgggacttagtgaaacgctgtactcctggtgtgatgcactgagcaggataaaatatcaggcataccccaattgagagacattctgtgaaacagctgacttctactttacaaaagtgttagtgtcataaaagacaaaggctgagaaactatctgttccagattaatagattaaagagtcatgcaaacaaaatgtgtagtatgatcttagattagatcctagaccagaaaaaagttgctaaaaaggatgttattgggagaattggcaacattcgaggtctgttatctaatatacaaattagataattgtgtattttcagtattaaatttcctgatttttaaaattgttctgtgatatgtaagtaaatatctttgctcttaggaagtcatatcctgaagtgtttaggagtaaaatggtgtgcctgtgacttttaaaaagtttagggaaaagagaagagagtgataaagcaaatagaacaaaatgttaacaattggtaaatctgagtgaaggatataaaggaaggagttctttgtgctgttcttacaaatgctaagcttttaattaattcagaattttaaaattatatattaaatattatatagatatttaaataaaatattaaaagatatattaaaatagttatcagtgaaatgatactcaaacatgttcaagctagccttaaagagtttcaaaagagacctatcagctctcctcaccctagttagtgtcataatgatcagtcatgtgaggtcagtcaagatcagcttcctgaagagtatactttgagtaatagtcttgtttcttgtttttattttaaagacttgctggtcttaggtattctctttcagattctgggcttctaaggtcatatcattagttttccatgtctcttattaatttataggacctatgcatgttcacactggcaaatctttaattcagtaagtcatccgttcagcaaattttcaagtacctgtcatgtgggaggaaggtatacagaattgtaaatggcatgctccaaacttatattcttgattactttcttcctctcctgtatttcacatcctggcagtcatctctcactcttaattactttgaaccaacaacttttattaattctctttttttaaaataacttttacttagacataccgaagctctgaacacctgcagtattgcagaggcctctaatgggtttctctgcctccaattgcgttggctaccagtctatctggagtacagaaaccatgacagagaaagtatacgttgttactttcctaatcctcggaaccataaaaaaaggaataacattaaaagaacagaaaaggaaacttcatttatactgaaattagggaatgttcacagtcctgtatcaaggaatttttcaaataatatctgcaagataaagtgaaatttggaccaaattataaaggatgttaatttgacatgtctcctcttatcaaagcatgggacagggtactagaattagtaaggaagttcagacctaccggtagtagaccacaggagaaatttctggtgtttaacttggagcttatccctttatcttgcaatagtaggaaaggcagggtggttatagttgttaaaagcacatatttcatgtcagatctggccttggatctttgctttgatacttacttgcatgtggtcctgggaaaatgacctaacttctttaaagttcagttttatctgtgatatttggatagtagtagtgtttacctcaccgagttgctagtatcatcgttagcttggtagttagcacataggaaatgttcagtaaatattagctactattactcctttggaggctaacataagaatgaagaccagtgttttttgtattctttggtgcatgtactcataaacctatgatttctaagattcttttttacttctcctttcttatctacagaagcccaaaagtcaggtgcctctttattaattttaaagcacaatttttgtagtcttctaagtcgatgcttttgagttcatgagttcatgttatgttaggagttgtgaaattagatacttacattaaacacggtttagtcttgatgcttttttttcgctcatggcattaaagtcataactggcaaactatctttccttgaaattaaacttgaaaaatttttaaattatgcaattatatgtgcataatgataaaaatgctaaatcttaaaacatgattgtggaaatatatgacattgtaatgaaattcaaacagtacaaagcagcatgaaaaggtaaagtctcacttatactccttatcccactgtccagtttttatttgttttggcacttatttctatatctcagaataatgagcactaaaatatatttttaacttgtgacctgtcgcttattaacagttactttatctctataaaattatgaaatttattgtttatttcttgcactgcactatactctgctagtcatatatacttaattttagttcttccgttggtaaactttgcatcatatactttacataatatacttgaacctctaatcttgatctaccatttatacttgtcaaggtttgtagcatttacatttatgtttgctaacgataatgtagtctgagttttgcctgtagcagagtttgtaaactgaggcctcttatggcaagtccagcccatagaggtattttatttggctcacatggtatatatatatatatttttaagtttttcatagagatagggtcttgctctgtctgctaggctggagtgcagtgacaagatcgtagctcactgtaacctttatcttctgggctttcgagatcttcccacttcagcctaccaagtagctacgactacaggcatgcaccaccatgcccagctaatttttaagtttcttttttgtagaggtgggggtctcactatgttgccccagctggccttaaattcctggcctcaagtagtcctcccacctccacccctcaaagggctggaattaaaggcgtgagccaccacacctgactgtatgttattttttaattagtttataatgtttaataattgggagatttcacataaatccagattttagcttctcttaaatcagatgactccgtaacaattggcatatactcccataggcagccagtttactagacaagagtatcaaccttctccttagattgaacacacatcttcaaatcactgtagtctttacctgccccattttactcacttacatttcctgtctagcccttgttggtctttgagtttgtaatccaagatctattagaaaatatttaaccagcatttatattattataagtgtgtatgtagtatgtttggacctataaggaaatagatataattctatatcattaaatctgtgccacttgagagagaaatattaccacaaacaacggaaaaacagaagtggaaggtaagggtggcagtgtattataattgctctttttaaaaatactttctaattcagataatttaggtcatttaagcatattatcatatgattttttaaaaaggtaaattagttttttcgtgaaaatatattcttggagccctctgactttctgttttaatttggattacttgtttcctccctccttccctttctccttcattccctttcttctttccttccttttattcaacagagacttaactaagcttttactaggtacctggtgctgttctgggtgcttctgatacagcattaaacaaggcagaaaagagtaccctcatggagcatgcattatagtggaggagatacctagtaagtaaaatgcctcgtagaaatataaagcacggtagaggattgtattagggtgggaaagaaagacaaggggaagtgagatagggcagaagcctaagtgaagtgagggagcaagccatatgaacagtttttcggctagagcgagtgcaagacacgggtgaaactgaggttggcacattcaaggagcagtgctctgctcagtgtgactagagcagcgtaagcatgaggaggagaagaaggtaaattatagagggaggcaatggcaggaaatgtggattgtattaagtgagatgggacacttaaacagtgttttgatcaggttagtagcataatctggtttacatttttaaagcacacactggcttcttgtgaagaacagaagaaagtgtggaacctggaaggccagttaagagactaatggaattgtctacatgagaaataataacttgaataggatggtggtggtagaaatggtgagaagtggtatgatttaagatgtgctttggaagtggtcagcacactgatgatgttgaaagctatgatnnnnnnnnnnnnnnnnnnnncgaaagagtcagaggagcagcctttaaggtaggagaaatctaggggagagtgatgttccagaagctaagtgaagaaatcatttaaaggagggaatgatgagttgagaactgactgtttgcaatcccagtaagcttttttagttttaagtcatctatatatctgtccttctgtttctccttattatactcctagcttgggtccttaaattcctctttccccttaaatattatcttaaatccctcttttccaccctcccccccctccccctgcttttttttttgagacggagttttacggtgtcccccaggctggagtgcagtggtgcgatcttggctcaccgcagcctccacctcccaggttcaagcaattcttctgcctcagcctcctgaatagctggtattacaggcacctgccaccacatttggctaattttttatatttttagtagagacagggtttcaccatgttggccaggctggtcttgaactcctgactgcaagtgatccgcctgccttagcctcccaaagtgctgggattacaggcatgagtcactgcacctggctacccttttttatagataacttttttttgctttggtagagtatatcctcaaattttttctggaagagtcaatggatgataacctttccgagtccttgcatgtctgaaaatgtcctaaaactctgaagatgcgctcaggaatctttatgtatgacaagttctctagagtagttttatgtataccaccattttattttattttaatgaggatgatccctttatttgacttgaggatggagaagaagaggattatgaggtcacgggaatgtctcatgaggaattacccaaagctggtaacaccaggtgctctgccaggaggactctctggaaggggcagccagctcacagatgccctggatccctcgaggccagtcactaaaaagttatgaccatccccttcttgccagtctgccagggctccaggggggaaaagtggaaaattatctggtcctggcccagggccagctcctcggtgaggaactcgaagaagtgggtgctgtggctgcggttctcctcagtggtgtccatcatgctggtggaggagatgaacagctgcgcccagggctcagtggacctactcagcaccatggtcaggcccgctacacccatcatgttcacatgctgcccttgttctgtgctccctggcccatgctcccatccttgggtttgcccaggatggaggctgtggcgcagagccatttctccaaccctgcaggcacttggttggcaggcaagttcgtgtctagctctaggaagggcatgggctgtagaaaaagagacccattcttttagagagtatttttctagcctcatatgaaggcaaaacaaaggcctgctacttttgtgagttgtaggataattctgcagatgaatttttttcagtcacacactttgattttgataccctttatttgctagagtactacttaaggggtggtaaaaatattaatatcagctttggctttttcctgtatattttatcttaacaatgtcatcacatccatctttcatcttccagaagttcacggtagttcttagtccagtaatgcagtactctgtcatttttcagcacttttatacctttttactgccattccatatatttatgtggaatatatatatggatatccatatatatatatatgtattttccttttaatttgcagaggagaggaccaaaaacccgtgttcaatttgccttttttaactggaaaccctactttaatctatatttattagtgttttgcaaagcaggttaatttgtttttgtctttgcttttagcaggttaatatttcttaatgttttatttggaaataatttcaaatttatagaaaggttataagaacaataaaaagaactcccctgtatctttcacctagatttactggttgttaacattttgccacatttatgctcccccatatagataggcatacacctgtttttgttttctgaaccatttgagttagttgcagatatcttgttcctttcctcctaagcattctgtcatgtaaccacagaataattatcaaattcgtgaaaaaacatatagaaatactacctaatatttagtccatattgaaattttacaaattacccaatactatcctttatactgttttttttttctgattcagtatccaaccaggattgagcattgcatttagttgtcatgtctctgtagtctcctttaatctgaactagcttctgactcagccttttgtcttgaatgactttgatatttttgaatagtacgggccagttgttttacagtatgtccctcctttgggtttgtctgttgtttgctcatgattcattatgtttttggcagaatgtaggagcagtgatcttgtgtccttctcagtgcattgcatcaggaggtgcataatatcagtttgtctgattattgatgattttaactttacttggttaaggtggtgtctaccaggttttttcaccatttccccctttggaatttataagtaatctgtggaaatactttgaggcgatgtaagcatctttttcgtcttcgaactttcactcaatagttttagcatccattgatatttcctgcctgaattagttattactatgttagttgctaaatgatgactttctaattcttactcccttaatttattagttgacattccactgttagagcttttccttgttatcaatgtagactcacagatttatttttattcaaagagttttaatgtttactgtgattgttcattttgatgctcaaattgccccagatttagccagtgggagctccttccagtgtctcctgtgtccttttgatgcatcctcatcattttttagcatttcctactttctggtataaggctatgttccatgttcatcttggccatcggccatttctccaaggagcactggatccttttagtggggattgatgtttagaaaccaagatctggacagcaattcagattgattcttgagtgcttgctctgctgtttggtttgtcaggtgtgttcaccacatttatttttagccttttgtagtggatggagagagccccaaagctcgtagtatatggattccattgcctttagtggctcactgttgagaaggcctttctcctctgctttctgtgttcttgtatttcaaaacagggattgacagacactggtcattaggaaagcagttcactgtgtttgtacattgtgtatgtatatgtaaagttgaatattgacttcacgaatccatatttctggaggagcatatggtttttcagttttctcagaagcatatcaaactgacatctacttttatatatttatgtttttcactaacaaatatctccataataatactgcttttattagttttggcattatatttcaagtcaaactttatttcaggtagaattttaaacctaaaaatctttggtgtatctgttagatgaaagcaaaatatagtttgttagtaaaataaatttgaaaaattatcttgaaattcttgccaagaatttaattgggcccaaatttttatatatatgcacacacacatgtatctataaacttgggagaatttggttaagaaatagagatgtgggaggtctacctaggcaaggtgaagagatgagaagcgataggatatatgctgagaaaacagttaagttagagcgttcatgtagggaaggagacaaaaataaaaggaaagtttggggcctggtggcagaaacttcaaatgaccagctaaaaagtttaggcaagaacttcaagataattttctagcaagcagggcctttgaaaagtaggcaattaattataaaacaaatatagataaaatgatgtcctttaattattctgggaaaggggacacagcattgcccagtgctggagactggtctgtttctctcaagcaacgaataatttgaatcatgaattcccactttcaaggcaatgtcttgcaattacgtacggcaattcagagtgcttggaaagtgttttgttttctcagatctagccatttaatatttactgcttgcttacaactatactctgaaccttattttaggaagttgtacccaataaaagggtttatttagttttctgtccaggcaatgaagcatatatgtgtttttactttgggggaagtaaagcaaatgaactggcatttcttgagggccaggtataccaggcagtatgtaagtagctttatatatgcatctcattcaatcttcactacacccttacaaaaaaagtagtgaccattttcttttatagacaagaaaatcaaggctttaaggatcaagtctcaggcatatagcttataattgtcaaagagggtatccaaacatgggtctgtctgacaattgccagtcattcacagtgttactctttgaagcgctcaagtttatagtaaatgaattgctgtgctgttcatatacaaaagcttaaggttagcagataataaaagatggtgtggatggagagaggagttacaagtgatacttgctagcatgcaaaaataacagaaaatgggccaagaggaggattccttatagccaggcagaaatgtctgttagaatatgtaggaaaggatcacatcatcatagaacttgagtgaatatgagcctaagggaagattcgtagcagtgattttatcagaagtgagtcatctgacagttctaatcagaatcaccccctttattatatagctgaggtcatccctgtgctttctctgatgttcctgtttcaagaagaggttgattccagacaagtgaaacatacctgaagattctggtttggacattataaatggtctgacaagaaagtgagcttcagattttagaactcagtgatggtggtaatgttagaaatatttaacaatctgtgttcttttataacagcactttgcaaacttccattatactaaccctaaaggggaggaaattgaaaatgccctcaggagtcttgagacatcatttgaagtgatatgggagtaatatttttttttaagtctcttgctttatatttagggaaagcttttgttcatttccatatctatttgttttaatgaaagttaaattattttactggttgtctccctaccctcaccctaaattttcaagtaccattgacagcctagaaagagggtgcttgttttactgtgacttagtaggctgctaccctttggcctggaacaggtaccccagtgtgagaagtaccgtcttccagggtttgtgctgccacaaaagcatctgctgaggctctatagataacacagggggcgaccacattcttgttgactttaccacactttgtgactccctcacttttcatgttccttccccccctcaggttcggatttcctgtttatcaaactcccatggtttctttctttcacttgatcggcatgactttttaagggcgtggtctcttgatctgtccctctagttttatttttggagtttctttttttgtcttaccaggggaatgtaaccaaatatatctatctaattctagcaggtacatattttttcctcttgatgctgcttaatattttattggaggcacatttacagtatgtatgaccttacaaatggcaggcttaatatgggtattgtttgttttgggtctcttctgggtctgggtggcacaggtggtggtggcaaattgtcatttctgtctcttggatggaaggaaacaagctcaggccagtatataagaaaactagcttcaggttgcgaatgagtgccagcttatgtattgtattttctagttaactcccagttgacttccaatttttgctacagtcttgagtagagttcagtgcttcttgggaatttaatagcagcaagggtttcctttgcaaaatatttttatacctaaatcttacatgaaaagggttgtttgctgactcactgattaactagacttggtttatgttaagcctttgagtcctttgttacagacatcatttgtgcccaagttgctttctcctcctgaaaccccattgctgacctgtaactagtctaatcttgcttgattatacgtttcccccgcccccatccctctgtaaaaccatcttttgtaccaaatgccgttgtatcttttgaatgatgtccactacaaaatagctttttacatagatcttgtagattttgaaaaatttttaactaacatgtcattgtatcttcataacaattctatgagagaggcatttataaaatacaaaatagcaatccacccatggggatggctgttacgtattttgtaaatgaagaaacaagaaatgggtggacgcgacttgcagcttagtggcaaagccaggtttgaccaggtctctgggcttccagtccaccaaacctctagtagtgtttagaaacatttctggaagtctcccaatttttccaaaagtaggaaaaatttattatgtagattgagttgtctttaaagagacagctctaaaatattttacgattgatgttgttttaaaaaattgtcttaaattcaaggaagaaacggtgtgtttttctgaatatccaactaggacctgtccctatattagacagattaaagatgtttgcttcctaagaacaaagcagactgaatcagaaaagagattagtgagtggctaagtttttatttttctccttagttctagggatagtattttacccccttgaaatagtgtgagaaggtcatgggtagaaggatcacacctgtgattcctaataggaatttctgtttccatgaggtttctcaaaagtagaatcgaggtcctttagcaattgtaagagtttttaaacacctatagaaatggtacatttgcataaagtaaagctgtagaactgaaaatgtccaacgtctttacttttggctggaattttacgagcctgattagctctgcatggcagcaatgggcatgttaattatatttgaaaattgccgtttgtttgtagacaaggagtccatgaggagagaaaatcaagtgaatgttcttgaactgtactgcagtgatggggaatgtccacaaggtggcgcaaagactttgtttaactgctggattcctagctagcacctggaatacttgaagcccctttcaccttctccctctttgcaaactatggctcagctgcatctgtgccctcagttctggtccccagcttcccctgaatccccttcgtgctgttatttgggctttgtattggtacctaaccacattctacctgtagtgaaagctgaaggtcttggttcccactctaggtggtaagtttcttgagtggaggcaccagctgcatatactttaaagcatattcttttctgtatttccagcaatgccaggcacaggacctctgagttgcattgttgaattaacatcttttggttatttgtgagttaattgtggacttccatagggttctccctcagtatatttttggctttgaagagtatgtttatcttcccagctgcataaatgaatttttggggtgaaatggggattttatgtttgtagtacatagtttcatagactttacaccacaccccgaccaaccactttcagtaacttcgaagacagttggttatggaaatcattcccgtgcacgggtcttccctgaagctctgcaattggtcttggcagtgggaccttcatgtgtgacagacagcagatggccatggagttcccaggctgtgtgccatgtaggtaggagcttgaaaaaagcagaaaagaaacctcctttgtagctgtcgtgtctctgtcttatttgggctcacaagaaggaatcttgctgcaggcagagctgtctgatcaggaaagaaaactgactcttaccagggaagggcccgggaggggcagtaataccaatgagcatgttttagttggattatgtcagttattggggaccattaagtaaatagatgttgagtattttctttttcaaaaaagcctttttgttttgttttgttttgttttgagatggagtttcgctcttgttgcccaggctggagtgtagtgtcacaatctcggctaactgcaacctccacctcccgggttcaagtgattcttttgcctcagcctcccgagtagcagggattacaggcatgcgccaccacgcccagctaattttgtatttttagtagagatggggtttctccatgttggtcaggctggtctcaaactcccaacctcaggagatctgcctgccttggcctcccaaagtgctgggattacaggcatgagccaccacacctggcccagatgccaattggaaggaaatttgaaaaggtttagtaataatgttatttcattaatttcagccaaaccacacaactaatttatgttttctaggcctgaccctggctctggcttcttcattgtgtggatacctttccaaaatgtttgatatgacaacatatttagaagttctttgatcacaagcccaaggatgtgcaaaactcagagcaaacagcatttacatttatgtaatttaattttaaaaattagccctaattgaagtgatcctggagatggtaatgttgacttgacacctggctgcttctctaagggctatctgtttagttccctagtgaatttcataaactaaggccatgtttttatttctagagctgggagtacccaagcctgcagttttgacctttgaatgtttggagcaccagaagttctgattatgagatgaagagaaaatgacagcttttcttgtctattaaaaaaccaggactcactcatggcattcctttgtcctttgtcctacaaacagaacagagactgtgacccctgatctttgggttggcattattttatttttattttttgaggtggagtcttgctctgtcggccaggctggagtgcagtggtgcaatctcggctcactgcaccctctgcctcctgggttcaagcaattcttctgcttcagcctcccaagtagctgggattacaggcgcctgccaccacacccagctaatttttgtatttttttttagtagagatggggtttcaccatgttggccaggctggtcttgaactcctgacctcaagtgatctgcccgccttggcgtcccaaagtgctgggattacaggtatgagccaccgtgcctcacctggggttatattattttaaagaatgtgatcagaattgacctgttaaatactcttcttgtatgtgaatctctgagtcagtttattatttttggcagttgaatttaaattcattagaacagagtgggatggcttataagtacatttcagcaatgcattaaataagtatttttcagaaaaaatttgcgaactgttagcacaaattggcatcactaatatggctgctttgtttttaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttacctgagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaagaaaagaaaaaagaaaaaggtctgcccacaaaatcactagcttattatttgcttcctgtgtgcctgcttgtctacctagcatagtaggccaaaggtccaaaggcatttagcattcctaggggaaattgtggctgtttttctgagccagatctcttgatttgggtttacacggagtcctttcatggactatcctgagtattgtcagtaaaacgtcttggggcataagaacttgtctgaatctgtcatacataccactgctgtcttttccgagtggtattacaagaaagatttttgtggtgtgtttgttctaagagaaatgccaaggctttcagataaagataagatgataatgattgacattgttctgctcttttatttgggtaaaaaaggaaagttgaggggtcagaacacagtagcctgattagtaccattctgttttgtcacactgttccccattagcttgtaccagttctcctcttctcggggatgtagagccaaaatgtcactgtgaccaaacaatctgttcaattttttctcctcaatggagaggtgatggtgtggcctgggtgtttctccaggagtgtgagtgggcagctctgtgggataagtcctaggtacctactgcccatctctagaggcgggcccccaactcccttcccctgttgctctgttctgccgacctgcattgccagcagccttggagttacttatgctcttcttgctcgttcctctccacct

SEQ ID NO: 16563 - DNA, 15621 bp, Human
gagataagtgcgatgcctagagaagataccaggctggcgcgcctcccccaacccaatcgcccaccccttaccctgtgctgtgcacccagccgggcctcgaggtgagggcagcggcttggaggggacaggctcagaacccagtctctcgctgtgctcgctttgtccagatcctccattctcttctctacacccacacccacatccaggtggaatatgggggcccgcatgcaaatgaaagacgagatccaaaagggctggtaaatgcatttcataaaaatcccaaatccatcttccccaggagctcaggcagggccagccgcgcaggctgtgtacgtgtttgtgtgtacgtgtttttcggtgtgtgtttcagtcccagtgtgttggcgcgtgttcgagtacagatacaccgggggtgtttgggtacccgcacatggctgcgggtggggcgcagtggagaggaagcccacacatgcgtgtgctgagatatggccgcatccttgtgctcccccagcccagacgcaggggagaccagcaccgagacacccgagctcgggagcccttcagcggcggccgggcggagcttggctccacgtggggctggagagcacgcaagcctggagtctcggcgctcgcttctcggctgccgccggcttttgtagaaccgagtggccggatggcagctcgcggggaggctcggccacccgcccggctcgcccggggcggggagaagaaggagagctggagagagaaccggccgcggcggtcggagaggcgagcggagtgcaagagaggcgagcgcccctgcccggcgcccgggcgcgctctccgccttccccgcccggctcgcctgctcgctggctccctccctctctccctcccccttcctccttggccctgcctcctccctcgatccccggctggatgactgaggcatttcagacgtgggctgaaccagagcgagcgagcgagctcaggggctgcagcgatctctcgataagccacctagaggcgactctgtgcgcgcgcgctccccagtggctcccgcccgccctctgatcatgttgacatattcacaggacaggcagtagtaccgatgcggcgctgcgacgttacagtttccgacaccttctttttataactcagctctatcccccagcactcgacctgtgaaaaccacgcctatgcagcaacacaattggtccgaaagcgtcaaagagccaatcaagaggcctccggctccccgcagcccacagcgcagcccgaccttctagagccgccgagcagacgcccggtgaattctagaggcggcggagggtggcgaggagctctcgctttctctcgctccctccctctccgactccgtctctctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggtaagcagtgggggcctcctcccctaagctgttggagagttttttcctccctttatttctctgctcccagaacagtcggttggtcggttattacggcttggacgaaaagttagttcccctagaaatgtatgcacagacttccaggccctgccccggtggcaggaaatttcagcttacctgggcatctgcatgggtcttgcatttggtctgcatcctgggttccctcccgaacagacagaatttttcagtggagcacagacatccctgcagggagcaggaaagaaaaaaaaaaaaggcactctactgcaagaaactcactcttcaaaccctcctggaacatccttatttctttgttgatgttgtgttgtctgttttattttgttctcagagagaaaaacttaaagccctttccttttgtgtgggtattgggaggcctgacaccattccccggccctttctgccctccagtctagcctctgggtctaaaggggcctgctgctgccctggtcagagagaaatcgaagggcattttggtttgtttgcccacactacttcacgtgtctgtaacccaagggcgagttcagcaggcaattttgcataatttaagattatgtttgcagacttaaggagccagtgaggagacacacaccttttttttaatgtgtgaatattatcaaccatattttacataatgtttaaaggtccttgcctgaccaaaacctgcctggaagagaagatcctgtaatagtcatttaaaatcactgattttttttttgtaatagcattgaagcctgtaaaggcataaagttgatacaaaaataaaatccccttcatgatatcttaagcgttctgtctccttccaagctaaatgaggccaaagtttggcataaaatcctcctcaaactcacaagacatttagtcagttttccagcaaagtgcttccttgcttccttttaagtcaagactacagaatgccaacccttctgtgaaattaacagcaatgtggtggcacagtcttgcggttttggactggcctaagaagtgggggaatgtgttagcagctccacgggcagatcggttatcaggcccaggagtgcaccgaagtctgcaaaattcgttctgggaactcactgaagtccagtttcacttcgcccacagcgggattgctattctgcagcagggaggggtgcaacttgacgttcatttccttgataagtttaacattttctcatcaatgggtggtggaaaattctagtcttaactgaccgcgctttacaaaaatcttaccccaacctgtttagacctagatacccacagaaaaagacatgggcaagaatttgctctcaggagggcaatctgtaaagtcaagcaaggacaaaaaaaatattgaagaaattgttagacaatgtagagaattgcagtgccacaatgcatttgttttgaaccttgggacgtctaaatatggcgaaactgagaatatttaatacgttagttgtggaagaaaacgattttgcaaccagttgcctcactctgaaacatgtaagcttatcagtcacaatataaagtcttagacttggtttcaatattatgtgatacataggaaatcaaacccaagattacgggtggtttatctttctttttcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttgtaagtttcattgctctcttcagtaaaattttctcctccttcactcagtcaaaggcagtgcttcccatttcatgagtttcagcccagacttctcctttgcttctccctaagcatagcaaacttgtcctcgtctggaaaaaggattcggggtgtttctctccaaataatggaaggcctggcgttctaaaagaaatggggcaagaaaacttaccggcttgtgttctatagcaattccagctctttggtagattcctgacctgagagtgaagttaaaaaccattttttaagagctaaaatcaatttcaaggctatgtattcctaaaggatttgttttgttttaaaatatcatacttctgttttgaaaccagtgatattattttctcaggagagtttacgtttcggagccttgactctgttggttaaatggtgtgaatacatttttaaaaactcgttcttttactaaaaaaagaattgggcttaggtgggagtccggcttaccctaaatgaggcttagatcttcagaaaaaaatggtttgtgtgttgggagtgtatatatggattcagtgacagtgcttagaaacttagaaaactttcattgcttgtagatatcaggcaaaggaccttttgcgccttttcctacccctccccaacatttcaataaaataaacagcgtgataagcaaggagtaagcagaaagattaggcccaggaagacgcgaatggcgcggaaatatcttcagcgggcaggaattgcatttgaagcccttgatttgattaaggcataaatattcctctctagagttcagcctttcagggctttaagtggattgggctcgtcaattagtgggcgcttaaagtactgaatcattttgtaaattaaaatgcatgtttttctctatcttttaagactttggccttcccaagtgatcacgctacgtggcaggggaattatagttttggtactcaggtaggctagggttcaaggtatgaatgatccttagatggtgagggtggggggggccctttggcaactgaggagcaatttggattctccagaagataacatctgtggagcgaaacgtacccagggggtactccaaggaggtgggctcggtacaagcgtggtaccctgcggtggggaagatttcagcctggcaggggtcctaagatcccgtttgttctgctaaatccttgttttatgtatgtctcctcttccctgcccctgcagactatattgaactccatgcacaaataccagccccggttccacattgtaagagccaatgacatcttgaaactcccttatagtacatttcggacatacttgttccccgaaactgaattcatcgctgtgactgcataccagaatgataaggtaaactcaaggggctttcctttttaatggtgatattttgccttccccttaaaagctgctttaagtcaggatgagaaagttacaagagagtggagacgagagtcttgagttgtcttttgtgatttgtggagcatttggggggaaaggacaatgacacctcgaggagacagaaaaacaccttgactaggtaggaacaatgctgagcaaaaaaacgccatactaattttgccacagagaaactcctagaactgctgtcattgatgccacccactcctccccccctcttgggctttgtcctgtctgttttaaggttcatcttcttccccttggggaagaaggatcaagaagtcacattcaaaaggaaccagctaaaaatttaaggcaaaagccatttgggatcctgggaggagaatcctagtagagaccagcttttctcccctagccagaaatcctgagtagctggtctggtttttattaccttttatgctgctgtgttatgatgtgtgtgtgtgtgtgcatgtgtgtgcatgcatgcgtgtggttggaaaaacctaccctgatcacagggtcatattaatcgagttgtctgaggcttttgagttggggtggccaaagtcaccacttcatttgaattccccccctcccccaggcctgaatctggaggttagaaggatccccaaaagggaaagcacctgatatctagagctatggtggcctgaaggtcatgggcacagaaaaagtgacccttactgctgattcaccagttcccagattggctgttagcagttatggggtgggaggagggactgaagacccctgctctgcaatcctggacttcaaagagagtccattttacctgacaacacacttcattttgaactcactgtcattgtcactgtccttgggtcctctgtggacttcatgatggggatgttccagctaaatttctttagtgtgaataccaaaacatgatcttctctccctgtgaaacctgaagtcttcaatagagcaatttattccaagaacatgaatccaaccaagggtccccctttccacctctgagtaactctgtgtatataacttcttcttcccaccaaggggaagggatttgaaagattacacactatagcatttttctcaaagtgcaaaatgcatgtgccctctagacccagaatcctgtgaaatgaagttgttaatgtaataataaaatgtagcatttttgatcagacaaaaaggccatgggccttctccacctaatggccatggcagagcatataaatgaaaacagatgtttccagtggtcattcagtactgtaactgtcaatattgtaatttcctcaaaccaccccccaggcaaagaaaaaaaaaattaaactcactcccgcactcactcccgcacaagggtagtgaaaccccataaatcatttattggattcatggaaaaggagtgtgtgtgtgtgtgtgtgtgtgtgtgtgtgtgtgtgaagggagtatgctataatttatgattaattgcactgtataaaaatcaaaatgaaagcataattttaagatctacaggttttccctcttgatgactttgacaacacttccatgtctaaacccaaactgttggctgcccaaagaaaagaatttctttgaataatttcatccccaaatccctggtttggcctcatataggagatacaagccctgccacagtttccttattatctcctttccctggcatatctatatgacttctgttggcagtcacatctctagacttgttgagttgggaaaaacaccctcaaaacattctagaaaatgagaacaatgtctctgtcttgcttgtgtctcttccaatagataacccagttaaaaatagacaacaacccttttgcaaaaggtttccgggacactggaaatggccgaagagaaaaaaggtgagttgaaacaattatttattagatagtttagaaaaatccctttttttaggatccaactctgaagtgttagaagtgagatgcaggcacttatcctaagagcgggtggaaatcattcactttccccactgctacatgcttgccgctatcagtatacccaggacaagtacttttcctacctccttacctttaaggaaattaactaggctacaccatacttatctctggaagagaagcatcagggataatagattatacagggatgcctattaattcctaattaatttaagttcatcctaggcaggtcccagaaagaaccatgccattgagaaaatacttgggaatttttgcaatcctgtcttccaaataccatcagacagagctggggacttcggaaagatgtatggctctctccctccttcgtggggacatgtatcattttgcattacgtagacagctggagagtatatgaaagagggtctcccctcccccaccccctttcaaagaatttctaaaatccagaaaatcacccccaaatttttaacctatccccttggggcgggcattaaaaaataattgctaacagctaaatatatttttattccaattaatttgttagtaaaacgattacagtaaagtgcagcatgaaataaccacttcctcccaatcttagccaccatccaaaatttgggtatgctggggacagacagcgttgtgtttgcaggattggacacccggttctccctatataaggctggcagtccagctgtctctgactagatccagcctcttctcctgcttttaaataaaatttcacagcccaagcaaatgccttttcctaatgaaaccccatcttgaataaatgcaactgaagcctccttcctttctccctaaccctctgccacactcttcagcccagttagagggtcaaggacaaagcttgggtctatgtggctgccctggggcaagcagatttcagtgaattagcgttgtccctgggcagcaggcagggtgtgaggtatgtgtgtgccgctttggaaagggtaagggaaacaaagaggggaaatgtatgttacattctgtaacctgggtgtgggcttctgccacagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaaggtaaaccatgtcacctttgtgatcactggactccagtccctcgtggcctggaagagttgaagggggatggggcaccaaccagggcacttgccctttaaaagctagaagccttctaaacatccttaaacagaagccagagttcaaaaagggctatcaggtgtgtctccccttccccgctaaggcagtagaaggagagcacagaggcctttctcccagatccttatttggctggtggggaggggaggtgggtgtctgtttgcatactacctcttggcaagcagctttgaaaacttgcttgaagcgcttctctcttttctctctgtctctgtttctttctcctcccattctctccaaccaacagaggctccaactgctgacttttcactgtctttgaactctaggttacaatgtgttggactgggtgggggggaagcaagggactctgccacctggaaccgagaaggtggcctagaaaacatccagctataaagcaacaattgacctgggagaggaggtggagcactggggatctgcggtgggggtagagctgggggaggtgggtgaggagtggacaagatggctcaaatcccccctcagttacctgtgtttaaagagcaagcagtatttatttggaaagacacacacacacacacacacacacacacacacacacacacactctcaacgggaagaaacctgttttttagtgaaataaaatgcaagtcctttatgtcttcaatccatttaagctttaaacataaaataggatccctttttcttttcttctggtggaacacccacagagggtgtggtaaaagcgaaaaaagaatctatgatcgtccccgggctgtgagccatctgtccgacactcatctctctctgcagggactggggcaaatacaaacggttcaactgagtactggtgttgaaggacaggtgtccgttctgccattatcaattcagatgtcagggttcttgccaaacaaatccttccagagtaattcacaaatttgtggaaggtgctgctctctgtcattcactgattttttgatagtaattagaatatgttccagctgtgagttttaatgttactttttacttttaaaaagttaatttgcaatcgaatggggaaatgcatgtgaaatctgccactgtaggaactcaaaaaaagaagtaaaattcattaaaataagaagagctactgattaggggattgtccatctaagggaaagtttaaactctgggtaaatactttaaattcataatcgcttattgaattttccagcaatgttgttgggcacgattatccccattttgcagatgacaacactgaggtgcagagaggctaaggggctttccccgggattacacagccactaagccacgagctgggattccaacttgggaactggagttccgttggctcatactggagataacgcccttctgccttggttttttccttcgcctgtggtagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcaggtatggatccttcttcctgcctccaccagtctttccacctttcgtccagtttccctgtcctttgccagcagaccctcacccgatccctttggcctagtagctgtaataatttttactgagccattaccgggttcaaggcttagctcatggagttattatgacttcattctccccattcaccccaaaaatctttaaaatttttccgaagttaaaggctgtttccagcagagtagataggtagtaacaaagataacagctggacacagcacttactttcaggcattcttctaagtgcttgctctgtattgactcatttgacctaacccttcaggggtactattatcacctccactttacagatgaaggcgaagacgcccagagatgttgagtgacttgtccaaggtcacacagcgggtacatggtggagctgagactcaaccccaggctatctgactccagggcctctttgagggtttctgattttagcttcagagctgacatgtctcttaagtgtctcatagccaacccttccccaggaatgggactctaggcctggggaggggaagtgactacttcctgagtaggagttcagtcttgattcctccagcctttcctcccagttcgaagctcttctccccacccccaaccccaggcaggccagcctattcctcgaagggttaatggtttgtgcacacgtgggaaatgtcagaggacagggataagcagggactggggcaggcctggaggcctgtgtgtggctcagacagctgtgctggggggaggtctcaggcggctggaaacaccctgaactcgatgaaaaggttctatgaggttttgcatgctgttgccttttgttttgtctgagcacattcgtctggtctcccttccctgcgccaagaaaccagattggcctccccactccagggaggagggagctgaggaaaggcttggcttctggcatttctcaattcctcccatctcctctgctggcttctccgggagaccctgtcctaggtgggcaggtggttggtacaccaaggactacctgaacagacaaaaccttaagggcacctcaaggcatgatgcagagaactggcccaggccagggtgcctgcatcttaaatgctgcttctgccaattcccagcttagtgcactcctgaactcctgcggcctacctcggcttctcacctggaacaccagtgaatcatgctggacgatttctttgtctctgtttataacaaatgccctttttccctcccccagccccagtttccttttgcttaagatcttcactgtctgttttttttgttttgttttgttttgtttggagaaacttctaggattggggtgggaggatgggggttggggaagaagaaagatttaaaaaattattcctactaatttatgtcctccggcttccccttggttacctctgtggggtaaactgaatctgtatccccatttaacaggtgcaaggagatttcctgggggctgcacacactgtgtgcagcatattgcaggctttcactcatttaatatctacaaagtcctcaataagtatatgaattacttatgatttccctgttttttcttcctataaggaagctgaggcacaagttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagctcctcccacccggctgactcgctgtgtgtctcttttctcaccccagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctttgggccttgtgttaaatgttttttctttgggaacctttcctgaagatggacagtcaggggagggtttagtatcttcttgttctgagtttacccccttcccttcgcctttaaataattaagaccgcccccagcgaaccaaaatgagatgtcactcaagttacaaagctaaaaacaaaagtcccttacttgagcgaagggagccacttcaatctgaaattacttttcctttaaattagggagcaaagcagggagacggaaaggggcctgatgagaatacagaaagaagggtaatttcagatacttttaagttttaatggaaaaagactgatgtgctccctaagtcaggttttcccacccgaatccgaccaaaagtaagctcggcaagtacgaatgtttttcgttttaagctcgc

SEQ ID NO: 16564 - DNA, 15621 bp, Human; identical to SEQ ID NO: 16563

SEQ ID NO: 16565 - DNA, 12907 bp, Human
tcacctaggctcaggtggccactgagatatggtctgtacccaacctttgtctccatctgagccgagtacaatagccaaaagtgcagaaggtaccttgtctcctatttccaatgtcagccaactccggctgttacctgttttcattagtaaacaaactgtaaaacaaatgtacagtttcactggttaacggggagatccctgaaagtgaacgggaacgaaagaaaatccaccgctgtgaagcaaggactgtctagtcaggggagaggagaaggacagcatttcttagaaggagggctgggtgaatcaggtcactccagagacactccagtatccatggcctccgatcacggctggagatcgggaatatcttcagggactttaaactattctgcatgaataaggacgactgaggaaattactgttcaagaaaccaaagccaccctgccctccccttctttgtgcttgttctgtctcctcctctaacccaggagttgcagaagcaatgacatctgatggcttcttccttaaggaaaacactggacaggctggaagaggagagagaagggcatgtcctgaccttgctattcccacaggggtccacgtgagcggactgcggagcagttcccagttactggggctaccccgaccatccagcaatagacataaaaccttgaaacttcagttctttgcatcgctgggccaagacgttccttgagtaggattctgtgcacacactgctagttacaagacgtcacgatcttcaaaacatctgaggggtggctttgcaaatgaggcttccacaagctgccaggcagtggcttcctaacccggcggacgcccctcgaaacgattatcaagttgtttcactggacaggtgctgggtaaaagcttgttgagaaaataaaaaataaataaacgtgttcgacccgccgccgcaagaatgatttatctgtaaaatacgtgtcggtgtggtcacaaccgttccccggaggttaacagccggagaaggggcttaaggagcatcccgcggatgccagaccaggctcatgtcgcgcctgccgggcggccagtgcagggccgggccgaggtcgcctccgccgctcctcctcgcggtagctcaccggccgccgctcccggccagagccaccctcccagctgtctgagggcgccgctgtactggagctttagtcgttgacacaggccgtggtagctacctccgggcggccgccctgcgcggtgactgcgccggcgaagactgcgagcgcgcaaacgggggtgggtcacgcggactatgaccttcgggaatcgcggcgacgcctaccgttagtagaaaccgaccgctaacggccgcgcgctaacggccgcgcgccccgcccatcccctcctctcgcgcctcagcgcccaacacccgcccccgccccttccgttcgccgccccgccccgtccctcctctcccaccatccgcgcccagccccgcccatccccgccttttcccctagcctgccccgcccctcctctcgccccacctgcgcccagcacttcccggccccgccttttcccctcgcccgctccgcccctcccctcgcagcacccgggcctagtactgcccgtcccgcccctcctctcgagcctcagcgctcagcatcgcccggaccccctcttcccttcgcccgcctcgtcccgaccctccccttcgcccccgtcccgctccgcccctccctttcgcccccgtcccgtcccgccccgcccctccctttcgcccccgtccctccccttcgcccccgtccctccgcgcgtgcgcgttcgccttcgagcgcatgcccgcatctgctgtccgacaggcggaagacgagcccagaggcggagcagggccgtcgcgccttggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggtgaggaggggaccgggagggccaggggctggggaggccggatgggcccgggacgcgcctgcctgaccatcaccccctcctcttgtcgccccacccaggcctcttcaccctgctcgtggaagatttcggtaagagccttttctccctgccggaccggggctgtggcggcccacccctgcgccctcactcatcaggggctgtccttccctactgctttcctttcctcatcgcaggtgtcaagggggtgcaagtggaggagatctacgaccttcagagcaaatgtcaggggtgagtggctgtacaccagggctgccccttacacccagagtgctggggaaggtcccagagaacagggccccttagggaagacagtgccaggaaccctacgttgtaaaatctcacagaaagcagcagccttgctctctgagtgcccgctcctgatcaaactgatactttcttttctcccaaactttccttagcgcttccctttttgtagcagccccctccccacccctaagcatcctttggttcagctgctttcctggccttgcagcgggaagaccccggtcacacaatgccttttgtgcagttgtgtaatgtattaattttagtgtgcccatgtgtccttggctttaatcctgacacaaagtcatcctgtattgattggttggggtgacaaggcccctcctgggtgcccacacttagagtcttttcccagtggtcctgcagaatagatgtgtaagagagtagcaacagtagcaaccgtgactgaaccaagaagtctactttaatttcctggaacaaaagagactggtgtgggtgttcatttgctttcctgactgcattggggcccacaagtgagaaggagtgcctcagttcctcatcagagtttttgttcttgtcttactttgtgttcctaccctgtcccatccttggccctcagttccagcttttcttctcttacccagaactatagacttcataaggagactgggtggactcctggagcatcacagtcagaggcttatgctttgctctgcctgtggcaggcctttggtgtgtgagggcacaaggccacttcagacacagtgttgggaagaagccaggggagaggggggatcacagcaaggacacctgagtgatgacgcagtgcaaaggattaatgggagaaagaagggaatgctgattgtcttctcccctttggctgatctggctctgccccttacttcccccagccctgtatatggatttatcttcctgttcaaatggatcgaagagcgccggtcccggcgaaaggtctctaccttggtggatgatacgtccgtgattgatgatgatattgtgaataacatgttctttgcccaccaggtctgctggactctgtgctttgtttggagggtgggatgctgccatgtttttgcttgggaagtggaaatggaggaagacaggaggaggagataggcagattctaggggtggtagctacagaaatcctctggcagaacgaactgaactcttaattcattaaagggaacagctttagagtaggagggtgtctgagtccactctctgtgtcctcagatatccagtgggtatttggtaggtgcttgttaaatgaataaacattaggcaaagatgaaaggagctgagaaggggagttgtccagatatgactgacctgctctggatccccattcttgatgtatatgggcttggggcttgcagtgaggggtgctgtgtatgggtgactattcttggtttcacagctgatacccaactcttgtgcaactcatgccttgctgagcgtgctcctgaactgcagcagcgtggacctgggacccaccctgagtcgcatgaaggacttcaccaagggtttcagccctgaggtaggctgcagtgccttcatcctggctcacagccaactgggcagatctgaccctgagggccactgggaatgctaccacatgatattgggtactattaggctgtttctttttcaaatgattgtttatgttacatttgactcttaaataaattgtgtaaggccattgtttttagatgcagttgcggggaaaggacacaggcctagggagggaggagagtttccttaagtcagaccatgtcagaaccttctctgtcaggacttttcctctcaggccatgttgcttcctagtgtccactaattaccatgcaaggccagcacagtccatctctttggggctccagagctcttttctgcccccaccagccttttaagaaagttcgtctgtgttccttccgattcctggaatgcctccaggctgctctctgaagctttgccttccacccatagtcctacctgaggagaaattattctgatacggccttattttcttccccgtagagcaaaggatatgcgattggcaatgccccggagttggccaaggcccataatagccatgccaggtgtgtgggagctgtgggagctgatgtggggtgggagtagggggagtatcattttttgggccctgactctgtttttccccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatggtaggcaccatgagctggaggcctgttgggtgtctctgcctacctcctagggagctggggctcagggccctctggtatgtggtacccagtggcaggggttgtcggtaccgacacccggctctggctggggtttcaccctacaccatattgcccgaccagctcctgattccctggctcaactgctcttctctgtcttccttcccactcctggcctgcccaaactcagggtttccttctcgctgattccttgtcttggtctccactagggccctggggggaggacgaggagtggacagacaaggcccggcgggtcatcatggagcgtatcggcctcgccactgcagggtaagggccctgtgcctgccctgttctactctctggagctgtacctactttgggagggacagagagtatccaggtgatttgtaaattgcaaggccatatggtgaatctggcaagatcaggcttagatcatgggttctcaacttgttgtcttatttcctgcctgggctgcctgtggcctgctcctgggtgggctgggggaggggcaggcctcagtggagccttaggcagcccaggtctgctggttcacttccagataggcccctcatacagcttgttggaaggtaccagctcaggtgcctggcatgtatggctagtcgctgcctgcctgttggggtggggcctatacctacagctgcaggtgtgactgcagggagccctgccaggatatctgcctcaacctgatggcggggccggggcgggagctgctctcacggctgcggctgtgactgcagggagccctaccacgacatccgcttcaacctgatggcagtggtgcccgaccgcaggatcaagtatgaggccaggctgcatgtgctgaaggtgaaccgtcagacagtactagaggctctgcagcaggtaggtgccctttcttcctggcctctgcccagcccaaccctccctgcattcctcctcccttcccccacagcatttgtctctgattcgtgaacatactctcttgtagatctgggcttcagctaaccacatcttttctttgcccccattgtgggaaaggtgggacttggagtggggagggagaatagcttctaaaaggaagtttgggtttgggtgttttatttccctgtgagtgaatgggtagagccaaggccattattcctttaggtcctcagcccttagctatttaaggtagaagcccgggtctaccctttctcctctgagccctggattctgttgttagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacaggtactggggggtttgggacctcttgtggacctcagagccacccgctaatgtctgacatgggaggcctaaacagggaaagtctttttctggggatgtccttgggcagtgttcttcccccgtcagaaggtagagggagagcagtccttccctaaagaaaggcacctgtaaagggccgctgttaccacaggcccctgggcccttctctgtaatgtacactccctttcttgttttctctagaggcggttttttttttttttttttttttttttcttcctgcttcttttttcccatctcattctttgccctgtctcattgcgggatcatgacttagagcttgctgactcccattgcaccagctggctgggctgttcttctctgggaagtgctggttcacagggccggggagactgtgagcttttcttggagatcctactggaggtcctgcctgtgttcttgccctgtctcagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggtaagctgggagcacccttgcaggattctctacttgattctcttgagaggctgcaacaggcaattttcccatgtggttccttggtgttcatccttggcatggctgggtcaagctgcctgggcctgggttgctaggttcctctgcctgatatgaaaaggcccccacaacagcaggagcttagggaggcagggagagctcctttgaatttaatctagttacgtggctgtgggattaaatgtttaggtcacgctccttggtacaacttcatgggttgggttttactggcaaaataaaggcatgtgtttcagggcactctgtttctcttaaaacccctccgtggggttctatccagtgtaagtgggtggcagcctccccacaagccaaggacaggccatggaacagctggaggggttccgctgactcagtctggaaaaccatgttggctttctctctggctgtgagtgtctaggctcagcctgggccgagcagcacttgtttgtaactgccctggtctttgtcccaggaggaagaagacctggcggcaggtgtgggccgcagccgagttccagtccgcccaccccagcagtactcagatgatgaggatgactatgaggatgacgaggaggatgacgtgcagaacaccaactctgcccttaggtcagcccagctttctaaggctaccaggttctaggtgcttcggatcccatcctgaatatctcagtctgtgtctgagaatgccctgcagcagataatgttgagcacctgcggagtttggggccctgggggaggctggcatgatggggctgaccccaggtccccaggaagtttttggtgggctggggggtaaggctgagcacgtaagcttatatcatgtcctattggaagtggccttttagccaggccttgaaggattggttggggcagggatggaggagatgtgggtggtggggaggcagctttgctggaacacagggcattggcaaaaggccaggagtgggatggctggaatagaggaagtgtcttttgaggacacttggctgcagctgtcagaacttgatgccaggcttagcatggctagttcaagttgcttggaccaagtataaggagttttagggtcagcccctggaggtcgggatgtatttaagccattctgggtactgctgggtatggtcacctggcccgttcccttgcttcacatcttctcgggccccacaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacaggtgggccttggactggctcactggccacttggtgcacccaggagggaggagggaagtggccaagtgaccacaaagtgtcctgcactctgatgattttcttgtgacctctcttcccagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggtgagcctccgttgtggttttctcctttaatcctggcagagggtaaggcctgagctcctcctgcccaggtgccaagttcttgattggaactttggtgtgaagattggtggctggagccatgtgccagaagactttctgggttgggtggtggcaggggccttgataggcatggactcgctgctcatccttgcctctagctgcctattgctcgtggggctttgttgctggcccgccccgatcagaggtgcaatgctgggttttggcaggagctgctggcactgctgaagtgtgtggaggctgagattgcaaactatgaggcgtgcctcaaggaggaggtagagaagaggaagaagttcaaggtgggtgatttctccagttgcctgatctggcctctcccgaggtccactggtggctgctctggcaagattggctccagtgctctcagtcttcttctctcctacagattgatgaccagagaaggacccacaactacgatgagttcatctgcacctttatctccatgctggctcaggaaggtgaggggatgcgctgctgtcttaactggaatgccctgctgagggccgtgtccttcagctcccctcccctggcctctcctgaggcttgagcagaccttggggcacagggagggccatgagagcctcagctcctggcctgaggcagccagcacctgctcaagggtctctacctcttcgcaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaatgaaccctcctgtggttgctggcctgagatatggaggctgggccttactagacctcgtgggcctagggccctgggaccagaaaggtaagaagtatatgatccttgagtgtccagctgtcttgggccagagatccttggaatcctaggcctgggatttaggacctgagctgaggagggacttcaggtggactgtagacagggtgcactttctggggagagggccatggctttcaccaaatctgtggctttgcagcctggagaggtgctgggactgtgggtcaaagaggcggggctgcctctaatctaatctcgcctggtgtgttctccctgggagggcgctgggcatctcttccttgttgcttttggacaggtaaagcaggtcaaagctgccgcctctgtcccgctctcctctgccgactgcatcgtctgctgaggctgctgcagcccctcaccagccccctggcagtgagtcctgcagaggggtcctcatgcaagcagctaaggcacagctggactgcttagaaaattcagctttaatggccccagcccttctgtctgagtctagtagtccagggcacagatgagggccacaccacgctttatccagtgtcgctggggctgatgggtggggatctccacagcaatgacatagttggtagagtgtcctgtggttgatagtgttcctggaatgggcaaggagggggacgggttaggtcatgccctattactactagcagggatagcgtaggggcagggcagtgggcagactaagctgaggacagggagggggccctgacccaagaggaagcctacctgatgagggggtctggccagggttcaagcctgcccagggttactgtattggggactgaagatagggatggcagagttgatgccacttttcattctctgatggacctagtccaaacaagttcctgccctgggcctcagttacccctctgaactcccaatgacaggctggggcttgtaggctcttggggcccaaggtgggcctgctgagggaggcatgcaggataggagttcaggggtgctccccacagccagacggcaggccttgggcattaacctgcctgctgcttgctggcctggcccaaatctctgttgtccttccttgttcagctaacctggataagtgactggcttgggctgggctgggttagtcctgggtccccgcccatagtgtaggctcccatcccaggcctcataccagcacgagtcagtgtcttgtagatggggcacaggtaaaagtcctggtcctgggccttgcggttgggtgttggcaagagccagataacggccatctctgtgtacagctccttgggctgagactcagccagctggaaggcctctggatcccagcgggcaccttccaggaataatccatggatatagcaccctacttggggtctttgtgttaactctgatggtgcctcaaacatcacctgtgggtagacacagacacaccccacacacataacaatacccagaatctgggttaggaggcacaaaactcccttctgagagagctgcctaatgctgcctgcctgcccatcatcacgtacctaccactttagcccatggcctgtggtctgtgccctgcccctgtggatttctgatggacccagcccagacccgttcctgggactcatggcctcttctggcttgggtctttccatgccctggcttaggggtcccccaactgccaaccaaccgtggcctcagagcctctcctccctgggctgtaccctagcctgtcacctgacctggccctggctgtgcccagaccttgaaatcaaaggagatggtgtcaatggagatgacaaatttgcgggcaaaattctgcagagtgcctgttaagaaagcctgggggaagaagaatccactgatccagaagacagctgggatgccatcttggatccaggcctgcagaaagtccaggcgttgcagcaggtccatgacccatgatgacagaggcttgag

SEQ ID NO: 16566 - DNA, 8625 bp, Human
ccccggccggaggcggagcatccgcgcggggcctggcgcgcctgcgccctgcgcccgcccctcgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcaggtgagagcagcgagcccgggggccggcccgcgccgccatcttcgccgcccgccccggcccgcaggccgccggcggggcccggggcgcgcgcggggggcgccgggcgggggggcgcggcgcggccgggcgggggcccgcggactcggcgcccttttttgtgcgcggctgggctgggggcctgggtggcccgcgccgcgcggccggcgctcaagcgggggcggctgcgcctgctcggcgcgggcggagagacccccccttcctctcccccctccctcgctctcctccccctccctccctcccgagaagcctctctttattgtgctccgccatgatgcctcgctcccatcagccgccgccgccgccacatggtgcggccggacgcggccccgcgcccgacctcccgcgcggttccgcttcgcgcccggcccgcggcggcgcccccggcacccccgcccagaggctggccccggcggggcttctgcctggagctcgggtggggtgggggcgcggggaacacgcgggcggccgcgcgctgggccttggccggccgggaggatgctctggccagcccgggcgcactccccacgtggggcggccgccccgtcgcgccagcgtgcggagaaacctggcgccgcgaccagtgtatcgggggtcttggaaatggctaagaaagctggcctctgcctaggaggctctcggcaggggggctgccaatccgggatggttaccggaaatgaaccgcgcgatctggccctttcacacccacttagctttgtagggggtttgtagtctttacaggacaaaagggcacctattccagagcacacccccttttcttcctctcccttctgtgcctcactgctttccgatctcatagttgctcccagtaagtgctccaaagtcgtgtggggccgcatctgaggtctgcccgcctgaattgggttggaggggttcatgttctgagaaggcgaaggccagggtgtaggatggtgccccgtgactttccagtctttgtaggcgtgcctggtatcttcatcgtaatagcagagtcgtcaactttctatgaaaggtggttttaccttgataggtggtagtggtggcctaatttgtatcattgtcatgggtttagtttccatattctagttagcagctgctactgttctcttgcaagtgtataatgtgaaataataaacgtgaagacttctgaataaggttattctgtgtctttcatagtagaaaccttaatgatcggtctgttgtagtgaaactctttaaaaaggcgctatagaaaaccaatttctgagtaaaccagcagacagcatgacttgtaaatggtcttttaattaattaaaaagaaattagtcagctacaagcatgaacatgtggaacgcttacctttgtactaggcgtttttgtttttgttttaatggcttttggaatattatagtattaacatctggaaaactaggtaaatttatcttagaattaagttttttgctccttttttgcagaaaaagaacagcaagaagcgattgaacacattgatgaagtacaaaatgaaatagacaggtaacatttttcttaatatacttcggagaaattttctgagatgtgtctaatagcccggtaattatcgaagctatggtcaaatctatccactgtcaaaggggaaatgattctaacttggttggaaatacttatgtagattcagtgttttttggtgaagtgattgtacagaagtttttgaaagtgcattgaccttacaaggtttgggtttgctttcaaagactgaaaattgtctgaattgcagtgtaggtcttctgatggtttagcagtgtggcatcagtggttgctctaacttgccttacaactttgttatggattagccactttatttagaaatcgcgcttgagggaaacaattgaaattggactggaaatggagtgggcgaagtaaatacacacgttaccagagtgttgagtttgggcactcttaacagtcattattactcagtgtttattgataaatcagacaaaattgccatcttagttttgagtgtctaaattaggtgataatggttattataatttggttattttgcatgactcaagctagtaagtaaatacactctgtaatctcaaccaattttttaatttgttaaatactatcattgtcaacatctcttttcatttgcttcagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaaggtatgttttggacagggcattgttaaaggataaacagtgtttgttagaatggaggaagcttggtgaagacttagtccagcatgctgggttgcgtgcaacaaagacaggctgggtgcggtggcgcacctgtaatcccagcactttgggaggccgaggtgggtggatcacttgaggtcaggggttcgaaaccagcttggccaacaggttgaaaccccgtctctactaaaaatacaaaaaaaattagctgggcgtggtggcgcgcgcttgtaatcccagctactcgctacttgggaggctgaggcaggagaatcgcttgaacccaggagggggaggttgcagtgagccgagattgtgcgcttttgcattccagcctgggcgacaagagtgagactgtctcaaaaaaaaaaaaaaaaaaaaaaaaaacctcaaagacgggaaaagatatacagctactgctttctattctgtttaggagaagctatattctaattgcttgatgaaagatagtgacagtctgatattgagcaattgcctttagtcaataatgggtttataaaaccaaagatgctcactaagttcggaaaaattttaaagggatcacttaaattgttgttagtgtgtgcctgttgaaaattcagctgacctgtaattttctggcctagtgtctgcactgcttggggaggaagatgaagaggcactgcattatttgaccagagttgaagtgacagaatttgaagatattaaatcaggttacagaatagattttgtaagtatctctaacttaatcttgtttgccactgtggaaattaatgtgagctttggttggaagacctgttcatatttctaatctttcaattatttattacagtattttgatgaaaatccttactttgaaaataaagttctctccaaagaatttcatctgaatgagagtggtgatccatcttcgaagtccaccgaaatcaaatggaaatctggaaaggtatgttttgaggaattatttgacaaaaatagcattttgcctatttcagtttagttttaaccacttacaagtgcttgatactttggtcatgtggctaaatacaaaaccttaaaatataaaacgttccagtgtgctgaagccaagtattacagtagtttagggttctcattagatactacagatgtaggcaggaagatctcttgagcctaggagtttaccctgggcaacatagacccttaccttccaaaaaacaaaaaaaaagagaaaaatctagcccaagtttaagaattgagaactggactaaattttttgttgctgttgttttctgcagtggtgactgagctcttcaaatggcttgccatttctcaaaatcatttacatccgtatttaggtagtaagacatagtttagatatttatactgtgttgtgctagtggctgttaacagtggaactaattttatggaaaaccaaatgtagttgatactacctctacctgctgtacagttttataattgctcttaggtaataatggtagcgtagatagtatactgatatttgttttgcttagcttttggggaaaatcttattttttaaattatagggagtttgggtgttatggagagattgtatcaaaagctcttctggtattcatttaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggtgagttctaatactcatttattcaaggttggacttgtctcggttgtttaaaaatgagtccttatattgtgcttttttttttttaaggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggtaaaagaaaatttggctaaacccacaaagataacttttaaagaattcatgttattttggggtgtatatatatatatatagtgtggtagaactgaccagaactgattgtggaaaaaaagtaagccattttgttgttcaagaattaaggaaatgtttgataagcacatggtactaatgtttaactaggttttttttggtttttttttgggtttttttggttagacttatcaccacccaagcttgtttttccctagccagtacttaggcaatataggcagtgtagctggtcaaattctgacatctctgaaataacaaagtttcatgtattttcgacaaactgcacaatttctgaatagtcaaattaggataggttggttttatttcggattatttgatccgaaatatacctgatttggttagaactgaagttactaattaatctgaagcaacatcatcacgggtgtttccttcgatgcagctgacttacaggtttagaaactggagtgcccccaggggcactcgtggggtccattgtggtccatatgaaagcaagtctcagcattaatcctgaagattaactgcccactttttctttcaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgataagcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactggggtcattctccttgttttatagagaaatgttacttgctattggattcagaaattgttctagttttttgtcttcacatcgttagtgactggggaagcgtgggttagcgctaatggtatgacattggtttagaaagctttgagctggtcggtgtccgagtaaaggacaaattcaaatatcttacttggatacagtttctgagtaaacagtttctgagagggtgagtatagcattttcattctgaagtctcaaaaggacttttcactaggaagaaaattgagtacagtgggtcctgttatctgcagcttcagctacatgtggtcaactacaattcagatactttgagactacattcacacctatactgtatgttaaatgtgtgaatgtatagttatagtatacaatagtcaaaattatcctataccgttaatctcttactgtgcttaatttggaaattaagttttataggcaggtacaggaaaaattgtatggggcttgatactcctgtggtttcaggcagccactggggcatcttagaatgtatctcctttggataagtggggctactgtagtcatttgaatcaatatccacaagcctgtgataactttctcacaaacttaacagtgaaacttagcacaactagtggttttacatgctggtgagcgtctagggctgtcaggttataggtcacaataacgtttattttcgggaatgtaaaaaatcgggagccctttaaggtagtagtagttcactcaactattgtgatctcctgaggtgccactaatatctgcaaatcttgtaagagaactaggctgtgagaaaacaaaatggcaaccttactgtaccaaaaacttccatacacagtagccagcatgccttgtgtccaactgcaagacaagttcttgggctggtctttagtgtgtattggaatgggctcagctccttttctcaaggacatttgaaaatagacaatagaagttgggcacagtggcacatacctgtaattgcagtactttgggaggcccaggctgaaggatcgtgtaagtccaggagctctaggccaacctggatgacagggacatcccaacactaccattaaaaaacaaacaaacaaaaaaagaggtgtggtggcgctaggctaatcctagctacttgagaggctggggcaggattgccttagcccaggagttttgaggctgcactgagctatgagtttgccaccgtgcttcagcctgggccacagagcaagaagaccctgttcaaaacaagacaagagtaataatggctgtttaggaaggggctgtgttcccaagctgtgctgtatttggtttatgaggggtatttaataactgcatgaattaggatggagggcagtagcttgcaagatgtcct

SEQ ID NO: 16567 - DNA, 11133 bp, Human
gtgagactccgtctcaaaaaaaaaaaagaaaaagccagttgcggtggctcacgcctgtaaacccagcactttgggaggccgaggcaggtggatcatgaggtcaggagtttgagaccagcctgaccaacatgctgaaaccccatctctactaataatacaaaaattagctggcatggtggtgggcgcctgtaatcccagctactcaggaggctgagacaggagaatcgcttgaacccgggagaaagagattgccatgagctaagattgcgccactgcactccagcctgggcaacagagcaagactctgaaaaaagaaaaatctagaaatggatggtggtgatggttgcacgacattgtgaatgtagttaatgccactgaactgtgtacttaaaaatggtcaagatgggccaggcgcggtggctcacacctgtgatcccagcactttgggaggcccaggcgggtggatcatgaggttaggagatcgagaccagcctggccaacatggtgaaccccatctctactaaaaatacaaaaattagcttgtcgtggtggtgcatgcctgtaatcccagctactcaggaggctgaggcaggagaatcgcttgaaccagggattcggaggtttcagtgagctgagatcacgccacactgcactccagcctggcgacacagcaagactctcaaaaaaaaaaaaaaggtcaagatgataaattttaggttgtgtgtatgttactgctttttcacagatgaagaaaacaacactgacatgcattatctcccaacaccaacctcaacccagccctggagtgtgagcagagccagcagcatttccagccccgcctctggaggaaggagaggaacctgagactcttgggtgacctgaggcgtctctggcagcaccagcaaaagagcctggccctggccgcccagcacaggtgctcagtccctcctgactgccactgctccctcaacaccaaagcacagggtcgcgagatgttgggagagggtcggggatgctgggctgggagaggaccgggggcctgtcagaagccatgacatgatgcactcaccgctcaggaggaagctactggcctttgagtgaaatctataagaatgaactctggagatgtatcgtacaacatggagtctacagttaaaaactgtattgtatactggaaaattgctaagattagatcttccatgttctcactacaaaagcataagtatgtgagatgacggacgtgtgtgtcagcttgatttaatcattttgcagtgtggcaaagcatcgcactgtaggtggtaaatatatatacagttttgtcaattataccttcaggaagctggggtggttggtgtgtgtgtgtgtgtctgtgtgatgtgaggtcagtgaggtgctgaacatggtgcattaaacagcattttcattcttatctcatgattcctggacttgaaccgttgagtggcttctggctaaacccaaacctgtttcctgctctctaaccacacctccctccaggaccggttggaggagcctcagcccaggcccctgagctcaagccctgggggactcctgctgggcagctctctggaccccagtgagatgctccacagacccagggcgccctcggggaagtggggaaggagggaagtcaggtgcatcacctcttgggaccagccccgaggggactcaagcccatccagggcgcaggtgcctccaaaggaaagccccaagggagggtcttggggggccatggcgcatcccacctccctgtgtgacctcagctcttgctgaccctctgcctgtggtgggaggtccccaaacaaagcacccagggccccaggggcaaggccaagctgacaggtgtgggaggcagttgagccctggatcctgaccacagcagggcagttggcagatgtgcctctgggacagaaccccaggggtaacggtcatggactctggaaggggcctggctgggggcagggaccagaggatgaggatggggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggtaaggggtgagagattccaggggatgtgggggtctgggtggcagaggcgggaaaggatgaccaaggggagacgagccagaggggtgaggaggaaggttaatccctggaggggagccacagacactgactttaactaaagtgtcaagattttgtccatctttgaattaatttttattgcttaatgtcatattaaaatattatttatcttgattcctgagatttcttcccccacttacatttggcaccaaggccaatgtctccctcacctccccctagtccttggggtagggcaggactggaggcaggggcaggacgtccacaggagtggtggccgctatccctgaaggatgcccaggcctctccctcctcctcctcccactcctcctcccccccctcctcttttccccttggcctatgtcacctgtccactcccaccctcactgggcaggggccactccctggagctccagctaaggtgtgaggggcctttcctggagtccctgggtcactagacctcagccagcatcgcctcctgaaaccagcccctaggagacacaagcttatccagggtgcaagtgcctccaaagaagaagcccaggagaggctctagggaggccacaactccctgtgtgacctcagccattgccaccactctgcgtgtggtgggaggtccccagacaaagcaccaagcatcggggtccatttatgagcatttgggacacaacagcctgttcactggtgcatgttatacccacaggcgataatcatttcaggggcagaacctccctctcggtggccccataggcaggtcctgctgtgatcccctttgtgcagacggggatagagcccggagaggtgaggtgacccgtccgagtcactcagctcatgggcacagattctaaggcccaagctatcccctctagctctcccctgtcccatcctctaagctgatcgagcggacacgtgcacctctgggacctgagtttccctttttctctcttttttttctttttcaaataaagtttcacagagtttcactcttgtcgcccagtctggagtgcaatggcgagatcttggctcattgaaacctccgtctcccaggttcaagacattctcctgcctcagcttccggagtagctgggattacaggcatctgccaccacacctggctaattttgtgtatttttttttagtaaagacagagtttcaccatgttggccaggctggtctcaaactcctgacctcaggtgatccacccacctcagcctcccaaagtgctgggattacaggcatgagacaccacaccgggcctgagtttccccttctgcaatctgaggggccctgactggtgagggccttcagcgtcccacccacccagaggatgctggggtggctgtggtgagagctccagcagtggcagccgacctgacccacaccaggagcccggccatggaggcggggtcagcatggtggcaggccgggaccgggtgtcagtgtcctgcacggacttctgagcaaggagtccccatcagggtcaggctctgtgctggggctgaggtcccagaggatctagatttgccccaattcaagtccacaaggagcgggggccgggtgaggagacagccacatgcagggtgatgcctacagaacagagactgggatggggaaggcccgaggggtctccacaagggacgggtgacaggtggagggagacacagataataaaaaatggtattatgttggggggctattaatgtaagtttttatattagaatctttagaaatcttatagaaatactatgggccgggtgctgtgtctcatgcctgtaatcccagcactttaggacgccaagatgggcagatcacgaggtcaggagattgagaccatcctggccaacatggcaaaactccgtctctactaaaaatacaaaaactagctgggcgtggtggcgcgagcctatagtcccagctactcgggaggggaggcaggagaatcgcttgaatcagggaggtggaggttgcagtgagctgagattgcaccgctgcactccagcctggacgacagaacgagactcccactcaaaaaaaaaaaaaggtattatgctgggggggatatgaatatgagtttttataatctttagaaatactatgggccaggtgcagtggctcatgcctgtaatcccacaactttgggaggctgaggcgggattgtttgagcccaggagtttgagatcagcctgagcaacatagcaagaccccatttctacaaaacatataaaaactagctagtcatggtggcacttgcctgtggtcccagctacttaggaggctggtgagaggattgcttaagcctcggaggttgaggatgcagtaagctgagatcccaccactgcactccagcctgggtgacagaaggagaccctgtctcaaaaaaaaaaaaaaaaaaaaaagactgattattcctgtagaattctggtaaatatctcctatcaaataaatgacttttctattcatagcttattaaaagatattttcattgtttttaagaaataggttgtgtatcactttttatatttagttgtaaatttatttgttttatttatttttttagagatgggggtctcactatgttgcctgggctggcctccaactgctgggctcaagcaatatccctgcctcagcgtccccagtagctgggactacaagcatgcgctaccacaccggcataattttttgtagagatgaggtttcgccatgttgcctgggctggtcttgaacccctgggctcaagccatccacccgcctcggcctcctaaagtgctgagattacagacgtgagccaccctacctagcctgtactatttttaataggtcttaataggttttgaatgttaattatttttaaattaatttcaaaaatcttctacaacatggatgaaacctgaagacattatacttagtgaaataagccagacacaaaaggacaaatgtcatttgaatccacttctatgaggtacctagaataggcaaattcacttggacaaaaagtagatttgaggttagcagggtgagggggagggaagaatgggggactgtagttaacgggtttagagtttctgtttgggaagatgaaagagttctggagatggatggtggtgaaggttgcccaacggtgtgaatgtacttagtgccacggagctgtacgtttaaaaatagttaaagtggaaatattgatgctatgtataaaaatggagcggggtgtggtggctcacacctataatcccagcactttgagaggccaaggtgggcagatcacctgaggtcgggagttcgagaccagcctgacaaacatggagaaacaccgtctctactgaaaatacaaaaaattagccaagtgtgctggcacatgcctgtaatcccagctactcgggaggctgaagcaggagaatcgcttgaacccaggatgtggaggttgcggtgagccaaggtggcaccattgcactccagcctgggcgacaagggtgaaattccatttcaaaaaaataaaaggaaatgggactgtacatagcaggagagagagggagagatcaatatgacacttctttttttttttttttttttttgggacagtcttgctctgttgccaggctgcactccagcctgggcaacagagcgagactctgtctcaaaaaaaaaaagaatgtctagatgcagtagctaagttcgcagaagccatttcagtgtgggaggcgaggtgactgagtccagggactccaggtttctggctgaggggttgagaccgcccatggtcattgtgatgagatgaagacagaaaatgagctgggctgggggaaggtggtcatctcctctggacgtgattagtttgaggctcctgttgggtagcccactgggcaaggtcagtaggcaattgaggagctgagagggtttggagctgggatagactccagcctcaccatgtgggcaatagtgggggtcacagagtgtgaaaatggctaagaaagaggtctgggtggggtctggggagtcagcagccaggcatgggccatggagaaacagatgccaggggaagaggaaaggggagtctcagaccccaaggggaaaagagtcactggaaagaggggccagccctgtgtcgcatccagcggagacaccaggtacagcagaaggaccttggacatgaccatgaggagggccttgttgaccatggcctgggagagatgggggtgagagcctgggggaccacaccatgtccccagcacacagtgcctggtagacaggatggatttatggatggacggacaggtagatggatggacgaatggacagatgatagatggatgcaaagacagatgaatagatggacagatgcatagatggacagatggacagatggatggacggacggatggaatgaatgatcagaaaaggcttcatgaacaaagtgagactgagctgcatctccatgggtagatataaaagcagaggactctcctcttgagtcaggaatgacccaatgtcctggtccagggaggaagtcagcctccttgactggggacacttgtggcagatttcagaggcccttaaaatgaggccaagtgaggtggacaggtccgagccagctgaggactcctcagccacacggcacagctgcctgaggggatgtgtcactcagggagttgctgggacctactgggcccagcgttgccatcagcaccaacagtttcagagagggggacacacgctggggcagcacctgcctcagagaagggacaggcacagagacactactgggggacactactgggacactggccacccccctaccctgtgcctgggtcacagcctacacactgcagccctgtgcccctcactcccagcaggttcctgctccagcgcggctcctggactggccccaggtgctggccccgggggtttcaatccaagcataactcagtgacgcatgtgtttggcagcgggacccagctcaccgttttaagtaagtggctctaacttcccaggctgtcccaccctctcctgtctctggaaaatgtgttttctctctctggggcttcttcccctctgccctcccagccttaagcactgacccctacctttgtccatggggcctggaggagatgtgttagtctcagggtaatggcaggaagggcccccacagtgggagcagccgccttcaggttccaacagcaggacacagcctggtcccagggcctgggctgggattgggcggggtcagggctcctcccctctcccagggcagatgtctgagtgagggacagaggctggttctgatgaggggccctgcagtggccttagagacagtccctgggaccccaggttctaggctgagggctggatgcccatccagcctgggagggccacacgggggcctggggacacaggggtcacccccaggggagaccaatggagggcacagagagggctctgggtctaggctgcagctctgtggcctctgctgggtcttcagggcatggggacacagaggaacggatgaggtcccagagcccagccctcccaggacagtcaccagaaaggagagggtctcttagtgcagagatgtgcctgtccctggagccctgtcatctctggggcctggtgtctctctgttcatgggtcgacctcccaccttcatttgaggaagggcaccttagactcagaaggtgactagcggggagtaaacgggagtgcagagaactccatggctgccaggtgaagtccaggggcatcagaggctgctggggtgggcatgggggctgcggtgccccaaagtctgggggagcagccccaagaacccagctgctgtgaagggtcctgtggtcgggctggtggggacaggggcgacggcagagccccagggtgtgtctgggtggagcccacgcttcaccaggagagctgagtgggccaggctggggcacagcctggtgccccaggggatgggaagctccaggccatgccaggcttgggtctccccacatcctgccagtacagttttgtgtgctgtgagggagacccctagattccaaactcagactccagaaaccaggaaggagggagcacagcctgccctgggtgcacacggggaaactgaggctgcagaggaaagggctgggccaggacacctgggaaaggtgacttgggaagggctcctaggaaggcacagggctgtctgctctccagagggctccagtggaaaggagggaatgaggagggaaggagaggccctgggtggaccagacggccacaccatgaaccctcccagagactttagacagagagaggcgctccacaacaccccacactccctctgccatctctcaccccctcctctgtccacacaggtcagcccaagaccaccccctcggtcactctgttcctgccgtcctctgaggagccccaagccaacaaggccacactggtgtgtctcatgaatgacttttatccgggaatcttgatggtgacctggaaggcagatggtaccctcatcacccagagcgtggagatgaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttcccagcccccaccccacccacaggggcctggagctgcaggatcccaggggaggggtctctctctgcatcccaagccatccagcccttctcgctgtacccagtaaaccctcaataaataccctctttgtcaaccagaaatcctgctccctctcttcatttcttatctctcatataatctaatgcttctcctgggttctcagtgtggcgttgggggaatcctggcaccagtgggaaagtagcctggaggagaggatcacagtctcccaggggtgtcccctggggaaataggccaggataggagtcggctcactggacaccagtccctccattctctccctcctccccttcctccttgcagctcaatccccgactcgctgcctactttctagagggagctatttctgactgagcctccagatacaccctgtgtccctgtcctggtctggaccctctacccacccacggcctctctttcctcagcctggaaatcctactctgggcctggagtccctctgcttctagccctggcccctggaatgccctccttcctctctgcccagctccccacccctgagggctggactgtccaggacactccaacaccatcaaattcatgagctcttacattttgggcccaccttgatttttcacctgacagcaggttcagaggtgtgagaaaaacaggaggaagccaggaaggaaacacacatgaaaggcctgcaagaggatcaggacactttcaaaaaataggctctgagctccccaggaaccagtgcaagaagggtaataggtgctccatcatttctttcttttttctgtttttttttttttgttgttgttgttgttgttgttattgttgttttgagacggagtctggctctgttgcacaggctggagtgcaatggtgcaatctcggctcaccgtaacttccgcctgccaggttcaaccgattctcctgcctcagcctccccagagttggagatggggcctggtaggaggtgtttggttggtggtggatccctcatgacttggtgccatcttcctgatactgagtgggttctcgtgggatctggttgtttaaaagtgtgtggcacctccctgtcaactctctcttgctcccgctctggccgtgtgagacacctgttcccccttcaccttccgtcattattggaagcttcctgaggcctccccagaagctgagcagatgccagcatgcttcctgtacagcctgcagacccgtgagccaatcaaacctcttttctttataaattacctggtctcagggtttcttcacagaaattcaagaatggactgatacagacattaatcttattagtaagggcagagcctctcacctctccaatgccaccacctcataataccatcacattggagattaggttgcaacctgaattttggtgggatgcaagcattcagaccatagtaccctatctccaaatacagacacatactgacgaactggggttaggacttcaatgtatgaatttggaggagcacaatccagcctgtaacatctgttttggcttgggctccctgcaagcaggcctcaaagaaaggctgttgtacttggagcttgtttgggacgagtactcccagaggcaagactgagggatggggagggggagagcaaaacaggagcagcaagaaaaccaatgcaaaggccaggcacagtggttccgcctgtaatcccagcactttgggaggccgaggtaggtggatcacttggatcaggagttaagagaccagcctggctaacgtggcaaaaccccgtctctactaaagatacaaaaattaccagcctggccaacatggcgaaatcccgtctctactaaaaatacaaaaattagacgggtgtggtggcgggtgcctgtaatcccagctacttgggaggctgaggcaggagaatcacttgaatctgggagatggaggtttcagtgagccgagatcacaccactgcgctccagcctgggtgacagagcaagactgtctcaaaaaaaaaaaaaaaaaaaaaaaaagccaatgcaaacgtacattgctgagttcaccattatggaagccggggtgcc

SEQ ID NO: 16568 - DNA, 15575 bp, Human; identical to SEQ ID NO: 12634
  misc_feature (1)...(15575): n = A,T,C or G

SEQ ID NO: 16569 - DNA, 37133 bp, Human
attttaaaaatttagccaggcatggtggtgcatgcctatagtcccagctactcaggaggctgaagtaggaagattgcttgagcttgggagggtgaggctacagtgagctataatcacgccactgcactccagcctgggtgacagagtgagactctgtctcaaaaacaaaacaaaacaaaaacctcctaaaatgtataaatagcaagaaaatgaggggcaaatgtggtaaaaaatataatggctaaaaagtctaaggaagttctttgtgtgcatcttgtaaattttctcagcatttcaaattacttcaaaataaagtgtttttttaaataacaaataaagcacaggctttggagtcaggcagtgtgttagtgtgagaacctagcctgacaacttcctagctgtgtgatcacgggcaaatgtttccacctttgtgagcctccatgttctcatctgaaaaaggaaccttaggactacgcctgcccagcctgcctacctctcggtgttgcagtaaaagttggataagggcaggaaaggcccttaatgagcatgtgcattaatcgaggtttttccagaactaacagggtatttatatttattttgaggtatttattttaaggaattggctcatgtgattgtggaggctggcaaatccaaaatcggcagggtagactggcaggtgggagacccaggaaggagttgctgctgcaagtggaggccaaggcactgcagccgaattccctcttccttgggggagctcagtctttagtctattaaggccttcaactgattgaatcaggcccaccaccttacagatgataatccactttactcaaaaaaaaagtctaccaatgtaaatgttaatcttatctttaaaaaataccttcacaaaaagatctaggataatgtttgaccaaatatctgggtacctgggctcagccaacttgacacataaaattaaccatcccagtatggaagggccctggtcccccactacatcttggagatttttgccttctctgtgaattattattgctgggccaaggcagctggctgggagtcctctgcgagttttgttttcaaagctctgggcacaggagttgcatgtctgtctcctttctggctcacacacttggggtgtgttttcttgcccttgcgaggctggacaagtgcctcatacggtccctcggctgtccacaagtgtgctgagaaactggacacacagaggttcccacccgctgaccacacgggggcctgtgtttacccagaagcagaccaaaacctgagtccagctaggtccctgctttgctgtgtgtccctgagcaagtcagttccctctctgggtctctttttcctctctgctgctttccctgaatgtgagttccctggccactgagaacagggggaaagggacagagcctcaaaagatgacctgtgcgcccctgcttctaagcactttgcaggtattatttaatcatcaagctaatcctacgagagagctgccattttcccccagcttacagatgggggaattgaggcgcgaagagggcaggcgatgtgctcaaggacagacatctagcaggtatgaagccctcacaatggggttctagaggctgtttagttaacctcaagttttggggagcccctgaagggctggtcaccacgctgccggggacagggaaagcctctgagcttgagtcagttttggtttccctgctggggtgcaggagtcagtaaaccttgctgcaaggggcggggaagagcatttgagcttaagttagttttggtttccctgccccggatgcaggagttggtaaactcactgcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttgcctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaatccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctggtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtgctggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaaggggttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagtttgacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctatcacctgtaaaccaaaagtatctgagacaggtctcaatctatttagaaagtatatttgccaaggtgaaggatgtacccatgacacagcctcaggaagttctgatgacatgtacccaaagtgctcagggtacagcttggttgtatacgtggtatggtttggctgtgtccccaccaaatctcatcttgaattgtagctcccacaatttccacatgtcatgggagggacccagtgggaggtaattgaatcatggaggcaggtatttcccatgctgttctcatgataatgaataaatctcacgagatctgatggtgtcataaaggggagttcccctgcacaagctctctctggcctcccaccatgtaacatgtcccttgctcttccaccatgattgtgaggcctccccaaccatgtggaactgtgagtcaatcaaacctctttcctttataaactactcagtctcaggtatgtctttattaacagcatgagaacagactaatacaatacattttagggagacatgagacatcaatcaatgcaggtaagatgtacattggtttggtttggaaaggcaggacaactcaaagtgggggcttccaggtcattggtagatttaaagattttctgattggcaattgatggaaagagttatcatcaatagaagggaatgtctgggttatgatgataaagggttgtggagaccaaagttttatcatgcagctgaaaactccaggtagcagacttcagagagaatagattgtaaatgtttcttatcagacaagagcctgttctatcactaattccaaaagagagggaggtatcatgaggcatgtccagctcctccttcccatcatggcctgaactggtttttcaggtcaactttggaatgcctttgctgagaggagaggtccattcagatgactgggggggcttagaattttgtttttggtttatatacctaagccaggattgtatctccagctcccccacctcctcactcacagcccatcactaagtcctgccagttctgcctaacttgctcctaaatctgcatcatttctctcccttcccactgctacttccctagtcaacgtcaccaccagggatggggcaatggcttcctaattgtctccctgcctcctgtctcactccaccctgcagctggtgctctctttccatgcacaaatattgtgtcacacactctgcctctaatggcttttcactgcatttaggaagttgaccaaaaaggccaaactctgtaaaatattttaagaggttttttctgagccaaatatgaggaccatgacctgtgacacaatctcagtagttcctgagaacgtgtgccccaggtgattaggttacagcttgatttgtatacattttagggggacagaatttacaggcagaaacgtaaatcagtacacataagatgtgcattgattcagcctggaaaggcaaaatgtctcaaagcagggtcttccaggtcatagatggttataaagatttcctgattagcagttagttgaaggagttcagcttaagaaaaggggagttgtggaagacaaggttcttattatgtagatgaagcctccaggtagcaggcttcaaggagaataggtggtaaatgtcccttatcagaccttaaagatgtcagacgattagttaaaatctctcctgaatcaggaaaagatctggaaggggaaggggattctccacagaatgtgaatttttccacaggacacagctttgcagggccattccaatatatgtcaaagaaatatattttggggtaaaatacttttgatttcctttagggcctgttatctgtcaggtgatgccagagttaggctggaatttggtgtcatactgctacaaagagtctgttctgtcagtcttggggtctctattttaatgttagtgtttgtcgattgtgcctgaattccaaagggaggagggtataatgaggtgtctgagctcccccttcccatcatgacctgagctagtttttcaggtttctttgggggttccccttggccaagagaggggttcattcagtaggttgggaaggcttagaattttatttttggtttacaaggataaggatcaaactcctcagcaggacaggactttgatgatctggcagcccctacttacttacctctccagctgtaccactcaccaccaactaactctctatgcttcagccactctggccttccctgagctcctcaaacccacatgatgctagctcaacttgagactttggcctatactgttcctttgcctggaatatacttcccccagccttttatttttggataactccaactcatcctttaagtcctctggctctctatgtctgggttagatccactttccacatgctccagtagcaatttgtgctttctgaatcatgggatttatcactttgcaaaccccaactatctgagacaggtctcagttagtttagaaagtttattttgccaaggttgaggatgcgcacccgtaacacagcctcaggaagtcctgatgacatgtgcccaaggcgctcagagcacagtttgcttttgtacgttttagggagacctgagacatcaatcaacatatgtaaggtgaacaatggttcactccggaaaggcgggacaactcgaagcaaagtgggacaattcaaagtggggagagggcttccagatcataggtagataagagaccaatggttgcattcctctgagtttctgattaacctcttccaaaggaggcaatcaaatacgcatttatctcagcagagggatgactttgaatagaatgggaggcaggtttgtcctgagaagttcccagcttgacttttccctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagtttgggaggttggcagttctgagttcttatcctggtcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgctttttgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagctatttattatcattatgggggaagatagaatgctctttccgtcaacctccctgcatgccaagtgcccagaaccatgcctagggagtcagtaaatatccactggggtgtatgaaaggaacaagctagctgctttctcctggtttcttatctaaatgtgtttatgggccagggagctggctcacgtctgtaattccaacactttggaaggccaaggtgggaggatcacttgaggccaggagttcaagaccagcctgggcaacaggcttttttttttctccaaaaaaaaagccaaacatggtggcacacgcctgtggtcccaggtactcagaaggctgagccaggaggatcacttgagccttgaaatatatttgagggtacagtgagctatgattgtgccattgcggtccagcctgagcgacagagaagactctgtctctaaaagtaagaataatgatgaaacaaactcagtagtcctatagaccattttttgtttgtttttgtttctatttgtttggttgtttttttgtgggggggagggttgttttgttttttaatgaacatagaaattgacccttctgatcttaaagcttgaaacttacatttgttttatctaagttccttcctcagaaaaggaacctcagacctctcaaaaagtatcaaagaactgaaactcaccagtcactgcatccagacaatgggatgtcaaatcccttattcctcatgattacctccttacccctccctaattcccgttttcccacacatagttacatttcttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctcggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccatactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacaggtaattttccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgcctcctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcccatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggcttacaggtaagggttttaaaggtgaggggacagaggttacaggcaaagccataaatcaacacgtggaggctgtacattggtttgacctaaaaaggtgggacgtctccaagcaggagggaggaggaggatgggtggcgctggtcacaggattcaaagactttccaatttgtgatgggtgaaatgggcgaagctttatctaaaaatttcagatcagcagaagggaacgttagctctggctcgtaggtgtgacctcctccaaaaccctcaggaagaaatttagaacaaagaacgaggtcagggttcaatcctcagtttcccctcatctgaggtctacctgccagtggatttgcttggtgggggcctgagtttctgaaaatcaactcagggacatatgctaagatgttatctttagtttctatagggaacaaaacatcttttgactctaacttccttggctactgttttaagtgactattaccttcttttttgttgtttttgttttattgggttttttttcactgctcctgtagaccctgaactactgtatttttgcttatcgagttgctcattgacttttcaaggctagtaaggtgcctggaatttccctcgaaagaactccagattttcctttattttcatgcttgtgggatgggggcagtgggtggcctgcagacacctaagagaggtccctgctccatcccagttgttccacatctttgtcaagacttggtattgtcagtccactgaactgtaggcattctagcaaaggacaatgacttcctgtagacctctggtttcttgatttcagatccctgacatggtaagaactagatccccaaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgttctggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaaaccatagtcacattttgtcccctaaacaaacactggagagacacttccccttatagaaggaaggagctaagagagaaaggggatggggggcaggaagaggagaccactttgttattttattaatagaatgtctctgtaaagcagcaaacccagggccagaggggcttgatgtcgtagacaaaatccctcagcagcttggaggagctgcaggaatccaaattcaagttgccggattcccactccaggcctctttccccaaaacagattttgcctcccacaagcagctcaactgactttttttaatctaatggaatacacaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctggtaagagggttttccaaatacagggtgtttcatgctgcaggaaggtcttcctgacacccaggctaggtcttatctgagagtactctatattcgtttcctgtattgctgttacaaagttccacaacacagatggcttaaagccacagaaatttattctcttaccattctggctattacaagttcaaaatcagggtgttggcagagccaagctctctgcaggccctagggaagaattattccaggcttcctgcagcttctggtggttgccagcagtccttggcttgtggctgcatcactccagcctctgtccctgaggtcacatgcccttctccctacatgtcttcacatcaccttccctctgtgcatgtctgtcttatcatcccctcttcttctaagaacaacagtcatactgaattagggcccaacataatgacctaatcttcactagatcccatttgaaaagacactatttccaagtaacacacattcatcgatactgtaggttggaaccccagcatcttttagggagacacagttcaacccatcacacaccatcagggcaatgactgtgaagtgcaaaatggaacaaagagaaaggggggtacccaaagatgcgagatctcaattaatttttgcaagagagaaagctggtgagcaggtggagacatgaaacggagcattgctcagagaagggggtggcagtcaggcctgtggatgccaggacaggctctgagctccgttcaggcaggtgccgggggcaacagtcagaagtgcggccgaaacaagagaaccaattaaggcaccagctgtgaaacaggtgcactggccttccccctcccatccccaaaaggagaagtaaatctgtcaacacaaactcccctgcatgctcagtgcttattagagaaaagccatccaagaagaaccttcccaggttagaccactgagccctctcagctttcctgggaaccgcactggagacaactgtattaattgaggccaaagaggccaatcaaattccacagttcacagacagattaatttatattcaagttatgggaggcggaatctataccccgtttgcacagaagtttgaaggctaactgagtaccaatctggcatgtaaatgaagatgtaaatgagtttagcaaacttcacagaggttggggagtctatgaatggggaacttccctaactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttatagttgtttttaatctttttttaagagatggggctataactcgctacattggccaggctggtctcaaactcctgggctcaagtgatcctcccacctggcctcccaaagttctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaacatctcctaaaccatcttttgatactcactgtggctgtttttgttctgctatcccatcaacttctattttgagaactgtgagaccatccctgtctctgcagttgttgaagaaaatttaggcccaggaaccactgcataaggcggtccaaacattgggggctcatgcacacatacacacacacacacacgtacatgcatacacaaacatgcacacacacactcacacacatgcacacacatgtactcacaccatgcacacacgcacacacgcacacacatacatgcatacacacatgcacacatgcactcacacacatgcacacacgtactcacaccatgcacacacatgcactcacacacatgcacacatgcactcatgcacacacatgcatgcacaccatgcacacacatgcactcacacacatgcacacacatgcactcataccacgcacacatatgcactcacacaccacaaatattctgccctgtggaaggggcagtgttggcaatgaatattccttcaataggcaccgtcctcagcaactataaggccaacttacaacatctgagaacaaccaaggttggccttcaactttcaagctgagtgcccttccccacctccaggtgagctagcccatcttgtctgtgttgccagcaaaagtacaatatttgtatagaacagtaattacttgcctcttactgctgttttaaaaaaatgccctaaacttagtggcttaaaacacatgaatttgagccaggcacagtggctcacacctgtaatcccaacactttgggaggctgaggcgggaggatcacttgagaacaggagtttgagaccagcctgagcaacataacaataccccgtctctacaaaaataaataaataaattagctgtagtcccagctagttgggaggctgaggcaggacgatcacttgagcaagggagatcaaggttgcagtgagccatgattgtgccactgcattcagcctgggtgacagaacaagaccctgtctcaaaattacttttgcaccaaccaaaaaatatatatatacatatatatacacacacacatatacacatatatatatacacatatatacatatatacacatatatgcacatatatatacacatatatacatatatacacatatatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaggagtttgagaccagcctggggaacctagtgagactcccatctctacaaaaaaaaaaaaaaaaaaaaaaatagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctattgggttctatgctcactacctaggtgatgggatcattcatacaccaagcctcagcgacatgcaatttacccatgtaaaaccccacacatgtacctccttgaacctaaagtaaaagtggagaaaaatgtattaattaattcaattaaaaattaaaattaagaggaaaaagacccctgtgataacatcaggccaaaccaggtaatgcagaataatcctcccatctctagagacttaaccacgtgtgcttcagagggagcacagctgtgccaaaacctggactttgaactgttggcctccagaactgggagagaataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggggggtcttgtgtgccactccaaactctcaggtgtgttcttgggatgtatttgtgcaatgacaaaagacggaaaagatgccagcccacgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggcctttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctcccccttctcttcttttctaagaacacttgtcataggatttagggcccagcctgatccagaatgatctcatctccaggtccttaactcagttacatctgcgaagaccctttttccaaataagggcacatccacaggcccccagagcatgtatttttaggggtccaccattgaacccactgcagattctaaggagcttagaatctccttctcctttgagtgactggagcccggcttgccccatcagctgagctagagatttagaggcttttgtcattcttgtccgtggctcaaaggccacggggctgacatgtttctctctgtttactggtcacacgaccagataaacgtgtccccgtggtcacaagaagggaaggaggaaaatgttattatgtacgcgtaaatttctgcgttgatgccagaacaaatctgtgcaactagagaagaggggcctgggaaatggcaccaatagccccagggcaatgagtgaactgtctcattgaaggtcactggagtgaaaacaggactgagtttctgatcagtgttagaattgtcaaagcatgtgctttctcctctccttcctgaaaccccattcacatgatagtcagtgaaaaataaaaggtatatgacacatcaaagaagaaaagagagccatcggcagataagacattgctttccatcttcctgaagttggttgaaggtttctctgcttaggccagaggaaggtgacacctagagattgtaaggaaggggctacagtctgagaggagccgccgaagcccacctcttaaagacaaaggtggcctgcatgaatgaagggggctggaacagggatgaattgaggatctgcatacaggaaatagaacataccctttcctcacctccttaacccatgtaatcaggcatttaatacccatggataaaataaaacatttttctctacagaaactaaatggaggagaaagaggaggaagaggaggagggagggaagggagaagccttaatggcagagacataaatagcccacaaagcctaaaatagctactatctggcccttttgcagaaagtttaccaaccctgtacctcaattatggatattcacccaatgatcgccagacctgcaggagaaaacacacatcaaagaacagatgagcaccttcaccataattattgcattccgctcgatttatttggttacaggaatccaaataaagctaaatatgtctttaggaaaatctttaggaaattgacctgagaagcaggtaacttgtaactagcccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatgggggtgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaacaacaacaacaaaaaaaaaaaaaaaaaaaaaaaaaaacaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacccgtgtagaccacataatttttacatatctcattattctggagatgctccctgtgtcttagacatcagtcttttaaatatgctaatactattcacagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtccttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctaagcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtcactccacttcccgcagcttcaaagtcttcatctaaaatgcaggtcatgctgcctgcattgtggggaagattaggaatgatgtgggtaaatgcctgggcccatagctggcatgcagtgggtttctagtaaactgtagctatgttattgtcctaggaaggcatatatggtcaaaagcacaacaaagaaactcaaatgtgctgctgccaggtggactcctgtaggctgtacaatttagacatccaagctgcagagtgtgagcacaccagcacgacactgtgactcagttgccttgctgtggtccctgtgcggctctcactgagctcctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccatacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacacggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggttacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagacttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatccctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagagcattttcctgagttctatgagtcattctgcaaattatcaaaactgaaggaaagtcatggaaactcccaagtttgtaaccaagtcggacagaggtgtgggtagcctggggaccccatgtatggctggagtctgaaagaagggtggacttggtgaggaccttgctctttaaattgtgggacctacacacattccaggtagtcagtgccagacttgacttaaattgcaggacagtcagctggtgtcacagattaggtgttggaatgcaccactactcttgtccaggatgcaggcaaaagaaatatatatgaagatgttgaaaaatggaagaatacaggaaacaagcatgagaagaaaaggcaaaaataatttttaaaaagttttttaaatgataaaaaacatttaatgaaagaatgaccactttaagtacacatctactcagtctacaactagttaccagggccttctggatgcccaaacttgcactagatacataggcaggaaacacggaagcagaaactgtgagacgctgtccccatcctcacagggcttggctggaggaactggaacacatagccctaaatcccttaaagaaaaatgaagggccaggcttgatggctcacaccagtaatcccagcactttgggaggccgaggcagacagatcactagagattaggagtttgagaccagcctggacaacatgatgaaactccacctctactaaaactacaaaaaattagctgggcatggttgcagatgcctgcaatcccagctacccaggaggctgagacaggagaattacttaagcctgggaggcggaggttgcagtgagccgagatcgcgccactgtactccagcctgggcaacaaagtgaggctccgtctcaaaaaaaaaaaaaaagaaaagaaaagaaaagaaaaatgaagggcagtttaccacacgtgccaagtgagatgtatatgatgagaaagaccataaagaaaaaggtgagctgctcaaagccatacaaatgcagaacaggaccatttcagtttttctcatcaatgtcttctcagcactcagtagacatttaaattcattaagagcaaagagaataaaatgttcacagtaatcaagaaacatgcagtcatgggtcactactggaagtagctagggcaccaattctttctaagaaaattggcaacaaatggccctgaataggcaataattaaacccggcctttcttatacaaactgtatttcaggattaaaagagcagccataactgacgaggaaattttattattttttttacggaagaattccatttaataaatgtttaaaagatgacaaattagaaacatcatcattttgtaaccgtaataggtttcttgccctatgcacacagcaagtcaataggctgagacaccaggttgcagcagacaaagaggtttcattgtagggctgccaaatgcagagataggaggaaacctcaaatctgcctccctgaagagttgggggctagggtttttaagggtttgggagtgggccaaagtgtggagatcgttgattggttgaagagtgcagcgtgaagtcatgggacaggaagaggaagaaactgtgttctcatagtactgccgactcagtgcctctgttggggtcttcaaactggttgccatcagctgttctgctggaactcaggatcagaagaacatcttaagcaattcttaaacagaagccttatgttttttttttgtttgtttttttttttttttttttgaggcaggggtctagctgtgtcacccaggctggagtgcagcagtgtgatctcggctcactgcaaactccatctcccaggctcaactgatcctcctacctcagcctcctgagttgctgggactacaagcacacaccaccacacccacctaatttttgtatttttttgtagagactgggtttcaccatgttactcaggctggtcttgaactcctgagctcaggtgatctgcctgcatcggcttcccaaag

SEQ ID NO: 16570 - DNA, 37133 bp, Human; identical to SEQ ID NO: 16569

SEQ ID NO: 16571 - DNA, 36075 bp, Human
attttaaaaatttagccaggcatggtggtgcatgcctatagtcccagctactcaggaggctgaagtaggaagattgcttgagcttgggagggtgaggctacagtgagctataatcacgccactgcactccagcctgggtgacagagtgagactctgtctcaaaaacaaaacaaaacaaaaacctcctaaaatgtataaatagcaagaaaatgaggggcaaatgtggtaaaaaatataatggctaaaaagtctaaggaagttctttgtgtgcatcttgtaaattttctcagcatttcaaattacttcaaaataaagtgtttttttaaataacaaataaagcacaggctttggagtcaggcagtgtgttagtgtgagaacctagcctgacaacttcctagctgtgtgatcacgggcaaatgtttccacctttgtgagcctccatgttctcatctgaaaaaggaaccttaggactacgcctgcccagcctgcctacctctcggtgttgcagtaaaagttggataagggcaggaaaggcccttaatgagcatgtgcattaatcgaggtttttccagaactaacagggtatttatatttattttgaggtatttattttaaggaattggctcatgtgattgtggaggctggcaaatccaaaatcggcagggtagactggcaggtgggagacccaggaaggagttgctgctgcaagtggaggccaaggcactgcagccgaattccctcttccttgggggagctcagtctttagtctattaaggccttcaactgattgaatcaggcccaccaccttacagatgataatccactttactcaaaaaaaaagtctaccaatgtaaatgttaatcttatctttaaaaaataccttcacaaaaagatctaggataatgtttgaccaaatatctgggtacctgggctcagccaacttgacacataaaattaaccatcccagtatggaagggccctggtcccccactacatcttggagatttttgccttctctgtgaattattattgctgggccaaggcagctggctgggagtcctctgcgagttttgttttcaaagctctgggcacaggagttgcatgtctgtctcctttctggctcacacacttggggtgtgttttcttgcccttgcgaggctggacaagtgcctcatacggtccctcggctgtccacaagtgtgctgagaaactggacacacagaggttcccacccgctgaccacacgggggcctgtgtttacccagaagcagaccaaaacctgagtccagctaggtccctgctttgctgtgtgtccctgagcaagtcagttccctctctgggtctctttttcctctctgctgctttccctgaatgtgagttccctggccactgagaacagggggaaagggacagagcctcaaaagatgacctgtgcgcccctgcttctaagcactttgcaggtattatttaatcatcaagctaatcctacgagagagctgccattttcccccagcttacagatgggggaattgaggcgcgaagagggcaggcgatgtgctcaaggacagacatctagcaggtatgaagccctcacaatggggttctagaggctgtttagttaacctcaagttttggggagcccctgaagggctggtcaccacgctgccggggacagggaaagcctctgagcttgagtcagttttggtttccctgctggggtgcaggagtcagtaaaccttgctgcaaggggcggggaagagcatttgagcttaagttagttttggtttccctgccccggatgcaggagttggtaaactcactgcaaggggcagggcagagcctctgagcttaagttagttttgtttccctgtcccggatacaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttgcctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaatccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctggtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtgctggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaaggggttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagtttgacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagggggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcacgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccccaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctatcacctgtaaaccaaaagtatctgagacaggtctcaatctatttagaaagtatatttgccaaggtgaaggatgtacccatgacacagcctcaggaagttctgatgacatgtacccaaagtgctcagggtacagcttggttgtatacgtggtatggtttggctgtgtccccaccaaatctcatcttgaattgtagctcccacaatttccacatgtcatgggagggacccagtgggaggtaattgaatcatggaggcaggtatttcccatgctgttctcatgataatgaataaatctcacgagatctgatggtgtcataaaggggagttcccctgcacaagctctctctggcctcccaccatgtaacatgtcccttgctcttccaccatgattgtgaggcctccccaaccatgtggaactgtgagtcaatcaaacctctttcctttataaactactcagtctcaggtatgtctttattaacagcatgagaacagactaatacaatacattttagggagacatgagacatcaatcaatgcaggtaagatgtacattggtttggtttggaaaggcaggacaactcaaagtgggggcttccaggtcattggtagatttaaagattttctgattggcaattgatggaaagagttatcatcaatagaagggaatgtctgggttatgatgataaagggttgtggagaccaaagttttatcatgcagctgaaaactccaggtagcagacttcagagagaatagattgtaaatgtttcttatcagacaagagcctgttctatcactaattccaaaagagagggaggtatcatgaggcatgtccagctcctccttcccatcatggcctgaactggtttttcaggtcaactttggaatgcctttgctgagaggagaggtccattcagatgactgggggggcttagaattttgtttttggtttatatacctaagccaggattgtatctccagctcccccacctcctcactcacagcccatcactaagtcctgccagttctgcctaacttgctcctaaatctgcatcatttctctcccttcccactgctacttccctagtcaacgtcaccaccagggatggggcaatggcttcctaattgtctccctgcctcctgtctcactccaccctgcagctggtgctctctttccatgcacaaatattgtgtcacacactctgcctctaatggcttttcactgcatttaggaagttgaccaaaaaggccaaactctgtaaaatattttaagaggttttttctgagccaaatatgaggaccatgacctgtgacacaatctcagtagttcctgagaacgtgtgccccaggtgattaggttacagcttgatttgtatacattttagggggacagaatttacaggcagaaacgtaaatcagtacacataagatgtgcattgattcagcctggaaaggcaaaatgtctcaaagcagggtcttccaggtcatagatggttataaagatttcctgattagcagttagttgaaggagttcagcttaagaaaaggggagttgtggaagacaaggttcttattatgtagatgaagcctccaggtagcaggcttcaaggagaataggtggtaaatgtcccttatcagaccttaaagatgtcagacgattagttaaaatctctcctgaatcaggaaaagatctggaaggggaaggggattctccacagaatgtgaatttttccacaggacacagctttgcagggccattccaatatatgtcaaagaaatatattttggggtaaaatacttttgatttcctttagggcctgttatctgtcaggtgatgccagagttaggctggaatttggtgtcatactgctacaaagagtctgttctgtcagtcttggggtctctattttaatgttagtgtttgtcgattgtgcctgaattccaaagggaggagggtataatgaggtgtctgagctcccccttcccatcatgacctgagctagtttttcaggtttctttgggggttccccttggccaagagaggggttcattcagtaggttgggaaggcttagaattttatttttggtttacaaggataaggatcaaactcctcagcaggacaggactttgatgatctggcagcccctacttacttacctctccagctgtaccactcaccaccaactaactctctatgcttcagccactctggccttccctgagctcctcaaacccacatgatgctagctcaacttgagactttggcctatactgttcctttgcctggaatatacttcccccagccttttatttttggataactccaactcatcctttaagtcctctggctctctatgtctgggttagatccactttccacatgctccagtagcaatttgtgctttctgaatcatgggatttatcactttgcaaaccccaactatctgagacaggtctcagttagtttagaaagtttattttgccaaggttgaggatgcgcacccgtaacacagcctcaggaagtcctgatgacatgtgcccaaggcgctcagagcacagtttgcttttgtacgttttagggagacctgagacatcaatcaacatatgtaaggtgaacaatggttcactccggaaaggcgggacaactcgaagcaaagtgggacaattcaaagtggggagagggcttccagatcataggtagataagagaccaatggttgcattcctctgagtttctgattaacctcttccaaaggaggcaatcaaatacgcatttatctcagcagagggatgactttgaatagaatgggaggcaggtttgtcctgagaagttcccagcttgacttttccctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagtttgggaggttggcagttctgagttcttatcctggtcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgctttttgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagctatttattatcattatgggggaagatagaatgctctttccgtcaacctccctgcatgccaagtgcccagaaccatgcctagggagtcagtaaatatccactggggtgtatgaaaggaacaagctagctgctttctcctggtttcttatctaaatgtgtttatgggccagggagctggctcacgtctgtaattccaacactttggaaggccaaggtgggaggatcacttgaggccaggagttcaagaccagcctgggcaacaggcttttttttttctccaaaaaaaaagccaaacatggtggcacacgcctgtggtcccaggtactcagaaggctgagccaggaggatcacttgagccttgaaatatatttgagggtacagtgagctatgattgtgccattgcggtccagcctgagcgacagagaagactctgtctctaaaagtaagaataatgatgaaacaaactcagtagtcctatagaccattttttgtttgtttttgtttctatttgtttggttgtttttttgtgggggggagggttgttttgttttttaatgaacatagaaattgacccttctgatcttaaagcttgaaacttacatttgttttatctaagttccttcctcagaaaaggaacctcagacctctcaaaaagtatcaaagaactgaaactcaccagtcactgcatccagacaatgggatgtcaaatcccttattcctcatgattacctccttacccctccctaattcccgttttcccacacatagttacatttcttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctcggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccatactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacaggtaattttccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgcctcctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcccatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggcttacaggtaagggttttaaaggtgaggggacagaggttacaggcaaagccataaatcaacacgtggaggctgtacattggtttgacctaaaaaggtgggacgtctccaagcaggagggaggaggaggatgggtggcgctggtcacaggattcaaagactttccaatttgtgatgggtgaaatgggcgaagctttatctaaaaatttcagatcagcagaagggaacgttagctctggctcgtaggtgtgacctcctccaaaaccctcaggaagaaatttagaacaaagaacgaggtcagggttcaatcctcagtttcccctcatctgaggtctacctgccagtggatttgcttggtgggggcctgagtttctgaaaatcaactcagggacatatgctaagatgttatctttagtttctatagggaacaaaacatcttttgactctaacttccttggctactgttttaagtgactattaccttcttttttgttgtttttgttttattgggttttttttcactgctcctgtagaccctgaactactgtatttttgcttatcgagttgctcattgacttttcaaggctagtaaggtgcctggaatttccctcgaaagaactccagattttcctttattttcatgcttgtgggatgggggcagtgggtggcctgcagacacctaagagaggtccctgctccatcccagttgttccacatctttgtcaagacttggtattgtcagtccactgaactgtaggcattctagcaaaggacaatgacttcctgtagacctctggtttcttgatttcagatccctgacatggtaagaactagatccccaaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgttctggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaaaccatagtcacattttgtcccctaaacaaacactggagagacacttccccttatagaaggaaggagctaagagagaaaggggatggggggcaggaagaggagaccactttgttattttattaatagaatgtctctgtaaagcagcaaacccagggccagaggggcttgatgtcgtagacaaaatccctcagcagcttggaggagctgcaggaatccaaattcaagttgccggattcccactccaggcctctttccccaaaacagattttgcctcccacaagcagctcaactgactttttttaatctaatggaatacacaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctggtaagagggttttccaaatacagggtgtttcatgctgcaggaaggtcttcctgacacccaggctaggtcttatctgagagtactctatattcgtttcctgtattgctgttacaaagttccacaacacagatggcttaaagccacagaaatttattctcttaccattctggctattacaagttcaaaatcagggtgttggcagagccaagctctctgcaggccctagggaagaattattccaggcttcctgcagcttctggtggttgccagcagtccttggcttgtggctgcatcactccagcctctgtccctgaggtcacatgcccttctccctacatgtcttcacatcaccttccctctgtgcatgtctgtcttatcatcccctcttcttctaagaacaacagtcatactgaattagggcccaacataatgacctaatcttcactagatcccatttgaaaagacactatttccaagtaacacacattcatcgatactgtaggttggaaccccagcatcttttagggagacacagttcaacccatcacacaccatcagggcaatgactgtgaagtgcaaaatggaacaaagagaaaggggggtacccaaagatgcgagatctcaattaatttttgcaagagagaaagctggtgagcaggtggagacatgaaacggagcattgctcagagaagggggtggcagtcaggcctgtggatgccaggacaggctctgagctccgttcaggcaggtgccgggggcaacagtcagaagtgcggccgaaacaagagaaccaattaaggcaccagctgtgaaacaggtgcactggccttccccctcccatccccaaaaggagaagtaaatctgtcaacacaaactcccctgcatgctcagtgcttattagagaaaagccatccaagaagaaccttcccaggttagaccactgagccctctcagctttcctgggaaccgcactggagacaactgtattaattgaggccaaagaggccaatcaaattccacagttcacagacagattaatttatattcaagttatgggaggcggaatctataccccgtttgcacagaagtttgaaggctaactgagtaccaatctggcatgtaaatgaagatgtaaatgagtttagcaaacttcacagaggttggggagtctatgaatggggaacttccctaactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttatagttgtttttaatctttttttaagagatggggctataactcgctacattggccaggctggtctcaaactcctgggctcaagtgatcctcccacctggcctcccaaagttctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaacatctcctaaaccatcttttgatactcactgtggctgtttttgttctgctatcccatcaacttctattttgagaactgtgagaccatccctgtctctgcagttgttgaagaaaatttaggcccaggaaccactgcataaggcggtccaaacattgggggctcatgcacacatacacacacacacacacgtacatgcatacacaaacatgcacacacacactcacacacatgcacacacatgtactcacaccatgcacacacgcacacacgcacacacatacatgcatacacacatgcacacatgcactcacacacatgcacacacgtactcacaccatgcacacacatgcactcacacacatgcacacatgcactcatgcacacacatgcatgcacaccatgcacacacatgcactcacacacatgcacacacatgcactcataccacgcacacatatgcactcacacaccacaaatattctgccctgtggaaggggcagtgttggcaatgaatattccttcaataggcaccgtcctcagcaactataaggccaacttacaacatctgagaacaaccaaggttggccttcaactttcaagctgagtgcccttccccacctccaggtgagctagcccatcttgtctgtgttgccagcaaaagtacaatatttgtatagaacagtaattacttgcctcttactgctgttttaaaaaaatgccctaaacttagtggcttaaaacacatgaatttgagccaggcacagtggctcacacctgtaatcccaacactttgggaggctgaggcgggaggatcacttgagaacaggagtttgagaccagcctgagcaacataacaataccccgtctctacaaaaataaataaataaattagctgtagtcccagctagttgggaggctgaggcaggacgatcacttgagcaagggagatcaaggttgcagtgagccatgattgtgccactgcattcagcctgggtgacagaacaagaccctgtctcaaaattacttttgcaccaaccaaaaaatatatatatacatatatatacacacacacatatacacatatatatatacacatatatacatatatacacatatatgcacatatatatacacatatatacatatatacacatatatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaggagtttgagaccagcctggggaacctagtgagactcccatctctacaaaaaaaaaaaaaaaaaaaaaaatagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctattgggttctatgctcactacctaggtgatgggatcattcatacaccaagcctcagcgacatgcaatttacccatgtaaaaccccacacatgtacctccttgaacctaaagtaaaagtggagaaaaatgtattaattaattcaattaaaaattaaaattaagaggaaaaagacccctgtgataacatcaggccaaaccaggtaatgcagaataatcctcccatctctagagacttaaccacgtgtgcttcagagggagcacagctgtgccaaaacctggactttgaactgttggcctccagaactgggagagaataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggggggtcttgtgtgccactccaaactctcaggtgtgttcttgggatgtatttgtgcaatgacaaaagacggaaaagatgccagcccacgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggcctttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctcccccttctcttcttttctaagaacacttgtcataggatttagggcccagcctgatccagaatgatctcatctccaggtccttaactcagttacatctgcgaagaccctttttccaaataagggcacatccacaggcccccagagcatgtatttttaggggtccaccattgaacccactgcagattctaaggagcttagaatctccttctcctttgagtgactggagcccggcttgccccatcagctgagctagagatttagaggcttttgtcattcttgtccgtggctcaaaggccacggggctgacatgtttctctctgtttactggtcacacgaccagataaacgtgtccccgtggtcacaagaagggaaggaggaaaatgttattatgtacgcgtaaatttctgcgttgatgccagaacaaatctgtgcaactagagaagaggggcctgggaaatggcaccaatagccccagggcaatgagtgaactgtctcattgaaggtcactggagtgaaaacaggactgagtttctgatcagtgttagaattgtcaaagcatgtgctttctcctctccttcctgaaaccccattcacatgatagtcagtgaaaaataaaaggtatatgacacatcaaagaagaaaagagagccatcggcagataagacattgctttccatcttcctgaagttggttgaaggtttctctgcttaggccagaggaaggtgacacctagagattgtaaggaaggggctacagtctgagaggagccgccgaagcccacctcttaaagacaaaggtggcctgcatgaatgaagggggctggaacagggatgaattgaggatctgcatacaggaaatagaacataccctttcctcacctccttaacccatgtaatcaggcatttaatacccatggataaaataaaacatttttctctacagaaactaaatggaggagaaagaggaggaagaggaggagggagggaagggagaagccttaatggcagagacataaatagcccacaaagcctaaaatagctactatctggcccttttgcagaaagtttaccaaccctgtacctcaattatggatattcacccaatgatcgccagacctgcaggagaaaacacacatcaaagaacagatgagcaccttcaccataattattgcattccgctcgatttatttggttacaggaatccaaataaagctaaatatgtctttaggaaaatctttaggaaattgacctgagaagcaggtaacttgtaactagcccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatgggggtgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaacaacaacaacaaaaaaaaaaaaaaaaaaaaaaaaaaacaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacccgtgtagaccacataatttttacatatctcattattctggagatgctccctgtgtcttagacatcagtcttttaaatatgctaatactattcacagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtccttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctaagcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtcactccacttcccgcagcttcaaagtcttcatctaaaatgcaggtcatgctgcctgcattgtggggaagattaggaatgatgtgggtaaatgcctgggcccatagctggcatgcagtgggtttctagtaaactgtagctatgttattgtcctaggaaggcatatatggtcaaaagcacaacaaagaaactcaaatgtgctgctgccaggtggactcctgtaggctgtacaatttagacatccaagctgcagagtgtgagcacaccagcacgacactgtgactcagttgccttgctgtggtccctgtgcggctctcactgagctcctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccatacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacacggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggttacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctccccccacccaggagtatcctcttgccaaatcaaaagacttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatccctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagagcattttcctgagttctatgagtcattctgcaaattatcaaaactgaaggaaagtcatggaaactcccaagtttgtaaccaagtcggacagaggtgtgggtagcctggggaccccatgtatggctggagtctgaaagaagggtggacttggtgaggaccttgctctttaaattgtgggacctacacacattccaggtagtcagtgccagacttgacttaaattgcaggacagtcagctggtgtcacagattaggtgttggaatgcaccactactcttgtccaggatgcaggcaaaagaaatatatatgaagatgttgaaaaatggaagaatacaggaaacaagcatgagaagaaaaggcaaaaataatttttaaaaagttttttaaatgataaaaaacatttaatgaaagaatgaccactttaagtacacatctactcagtctacaactagttaccagggccttctggatgcccaaacttgcactagatacataggcaggaaacacggaagcagaaactgtgagacgctgtccccatcctcacagggcttggctggaggaactggaacacatagccctaaatcccttaaagaaaaatgaagggccaggcttgatggctcacaccagtaatcccagcactttgggaggccgaggcagacagatcactagagattaggagtttgagaccagcctggacaacatgatgaaactccacctctactaaaactacaaaaaattagctgggcatggttgcagatgcctgcaatcccagctacccaggaggctgagacaggagaattacttaagcctgggaggcggaggttgcagtgagccgagatcgcgccactgtactccagcctgggcaacaaagtgaggctccgtctcaaaaaaaaaaaaaaagaaaagaaaagaaaagaaaaatgaagggcagtttaccacacgtgcca

SEQ ID NO: 16572 - DNA, 36075 bp, Human; identical to SEQ ID NO: 16571

SEQ ID NO: 16573 - DNA, 13184 bp, Human
gctctaaccagcgttactactatgctctgtagatgcctgtcgcctgacaagctagagggtcaggtaacagcaccaataagcagaagctgcccgggttagggattccttttccagcgggctggctggtgagtcaatgctccactctgtaaccagcactcaccaattccctgtccctagcaagatcacctcccctagatactgtgggggacagtgctaggcctgagaggaagggggacaagtgggcatccctgagccccaacacaggcatccacaaatcctgctccctcaacctccgaatccacaaaggtaagcgcagctaggagtacacacacaaacacaaatacaaacgtaaccccctcacacacacatacacacacacacacaaaagcctacaggagttgcataaacaaaaaactactgtttgcacaaatacacacatttgcaggcacacacacacagcgactggcacacaaacatagctcttcagaattctgcactcacaaacacaaccaagaaagctcagtctcatacacacagggtctcaagcatgcacgccctcacctacacacaaacacacacattcagatttttcaaagtacaccttcacatcaatgcttgcaaacacagacacaaacactcttacgtgaatgcacacgtacacatgaaaacaccctcacatttatgcatcctcaaataagcaaacacacataggcacagaccaacaaaaataaaagtgcacacagtgataaacacaaacattagcaggaccatacacaattacaaacacacgaatctgcacacacgaaaacgcacacgcagaaatttactcacaggattgatggtactaacacaataaacagatgcaaaaatggaattctcaaacagcgagtatacactaacaagctcaggaaacacacccaaacaaacattcacagccaagtgctggcacaaacccctccagctccagcccttggtcccaggccctactccctcagccccctttccagaagcgaaaggcaaatcctggttgcccattcccggcttccccaactaggatccctggtggccacgctggccccaggggaaaggaggcctggtcccttctactcagacccacacaccccctcctcacgcacacctgccaacatcccccctcccccttaacacacacacactctctctcctcacactctgggcgccctgccgagcacggaacatacgtgcgccgcttctcctgcgcccaatgaggggacgaacttgcacacccagcccgcacggcgtgaatacaaacagcgctctcatagtcgctggtgtcccccgcctcagccgtacgacccactcaccacagtgccccataggctgacctggaatctggaaggtgcagcgaggaaaggagagacgtggtgagtgccacctccgagctgtctgcgggaagacccgtccaccctgaatctccccctgtccacatctccctcagagccccgtgagcagcgcactcaggcctgaaactctggagttcgggaccaggccaaatggcacccctcctgctcccccgcctccccaccctgggcctgggcctgggctcggcggccgggcggggaaaactacccaggccgcgcggtctccactagctctctccatgagaaaggcccggctgggccccagccccgtgtatgacaaaaagaagccggggccggctccaggagccgggagaaccgcgctgacgcagcttcagggcgcagagggggcgcgggggtgggggaatccaatctgggctggctgggctggagaaggggagcgaagtgtggggcgtggggcaacttctgcaagttccagggatggcgaagggggcaggggtacctcccggactaggccttggaacccgtgacccccaaatatttgtgaggagaaagagagaggaagagagacgcaattttcgtttcgcgctgcccccgccccgtcagccccaaactggaaggtaaatacttacttagcctccgaaccaggtacaagctaatactcaacaatactgatgccttgttttttttgctctgtccggacagcaacgctgtagccaatttagatatgctataaatttaagaggttgccatggccacggtgcgcccattggccgctgggccccctacgtgcagcgccacgtcaccaaatctgaataaggatgcgcgaattacgcggcgaccagacaaagatgaggatccggaccgcttgaaagtgggggaaagtgccggcgcctccgccaccggggaaagccgctccgcagcgccgaggccagcagccacccgagatacctggggaagcccggaacaggcgccggggcgtgcggcccgtggcatgaggttgtgaacgccacccgccccccaccaccccactccgggcagcccagcgccaggccagagattgcccaaggactggaccggctgagtcttggtccggaccagactcgccctgcagctgctgagacaagaggcgaagggcagcggagggcccggcaggcccgagggccaggggcccaaagggagggcaaggcggccgaagccgccggggcgcggggctatgatggtgcactgcgccggttgcgagcggcccatcctcgaccgctttctgctgaacgtgctggaccgcgcgtggcacatcaaatgtgttcagtgctgcgagtgcaaaaccaacctctcggagaagtgcttctcgcgcgagggcaagctctactgcaaaaatgactttttcaggtaagaggccgcgccgctctgctgcctgcgcgcccaccctgcgcgcgctccactggggcgctggggaaggggatacccccatccccatcccagcctccccggatcacaagcttagatggggagcgggcagcactttgctctcctcctgtccttggtccaggaaaggtcccgagcccaggcggaggaagaaggacgctgcttcgctgcctcacgttggctcgaggccggctcagagcgctggcggggcagagggaggaagccctgacaaacttgctatccactcctctccgccccttccaagcagctgcaaccccaagacagaagcttcaagccccgtcccgagagagaggaaggatttttgcatgagttagagacgcctgaaggcttctcgctccaggcagaatgtgtgagcccatcggccgcaatcccaaacagaaacttctcagctccagagggggcccagcgaggaaggtctcccctggtgatgggaggagagaacctcccccacccacctcccaaccccttaaacatttcctcccatgttgaaaagtagaaacgaaatcgaggctgagaatcaggacctctggggtctagactgggctgtggcacctccccagcccccctacccctgtgggccctgtggctggccagggcagatcacctctctgggcctcagtttccccagcctggaagccactggagtttggggcagctgagccctgcctgtttcctctgggcacccagagccggctttgtgaacaggaattccccgcgctgaggaatgggggcgtgaatcacgccacagagaaaggcagcctgccggccccagcgactccgcactgagaatttgaatgggagaaaatgtcagccgctcctttacacgtgttaactccctggacccggaggcccgatgcccctaatgtagcagtgcttgcaaagtgcctaatgatttttgataaggtgcatatggccaattacgctgccggataaggccaaaagtgacttatggcttctaatgccctcactacatcaatgtcacccaaattcgccctgtttagagacatgggtgtgagtagatgtggggtccctagagtcctgggtcctcccccaccccacccccaacctgagcctcacccatctcctatttcgggggaggctggctttctccctgagctcaaagaagaaagaaaaggaatgagatcaggaacgcgggaaagcggggatttgagagattcctgtcctggccttgcaggatctatgattgtcctctattcacattcccctgctgcctgccaggccagaggtttaggggggctgaaactcatccctgctctctagggtccatcactatgaggccctgctgtccacagctcctgattagctccagcgggtcccagagcggtggattggaaagcctctccattggtactggaaatcagtggaaggttccctcctttctgcttcctccttccagcctaggagaagggctccccacctcatggctaggctcagccagccaggcagattggccctagctaggcagcagcagactagaaaggatccaggaggcaaagccaccaagtggcccaaaccctccccgcctggcttcaaatcattcatggactctgagtttgcctggagcagcccaggcaggcctggcaggggttgggtttgggggaggacatcttggggtgctctgggctctcttcttggctgaaggctgcacccactgctcaccccttcccagctcaggagagtctgaaaagccccagtggaggcatggcagtcccagtcccaaaagcagctcaggacatttgtcccacttctcccactctggccagagcgctcaggattggggttccgtttgacagatatggaaatggggacttcaccgaagccaggtcgggtgggaagaggtcaggggctggggagggctggatgcagtcccaccccatagtgacaggcacattgtgtccacaggcgctttggcacgaaatgcgccggctgcgcgcaaggcatctcgcccagcgacctggtgcgcaaggcccggagcaaagtctttcacctcaactgtttcacctgcatggtgtgtaacaagcagctgtccaccggcgaggagctctacgtcatcgacgagaacaagttcgtgtgcaaagacgactacctgagctcatccagcctcaaggagggcagcctcaactcaggtaggaagcctgggcccctcactagccttaggccttagcaccctcccaccgtgcccagcctggcactccctacttggcccccggtgtgctgtctgtgctgagcttggagctcatcagccccaggcagttctagggcaaggcaagggggttagaggctagagaagagaagtggctttggagcaggttttacaggggatctgagacctgccagctctgcctcaccctcctccaattcaggagccttttccaagttgccctcctcccctaatttggaagcgcacaattcccccttatgtgtcacttgagctccaggtaatttcttgatgcactggaaggacattaattgaggtctggagagaggagggaagagagaggaagatccaagccccaagggaatctgtgccctccttgtcccctctccttgaaagtgggagttctccagagggtacgcgtccccctacccttacccaggtactagctgagacgcgcggagagggcttaagagcgcccctccaaaggcccagccccgcctggagagagtgggcgggcaccgggtccctgggggaggggctgtcgcaggtttgggagggaatccagcggggctggccgtagcctgggcaggccgtagcttgggccggcgggaacccgccactggactgaagaggcgtctggccgtcgctgacgccgctgtccccttcccgatccgtccgcccgcagtgtcatcctgtacggaccgcagtttgtccccggacctccaggacgcactgcaggacgaccccaaagagacggacaactcgacctcgtcggacaaggagacggccaacaacgagaacgaggagcagaactcgggcaccaagcggcgcggcccccgcaccaccatcaaggccaagcagctggagacgctcaaggctgccttcgccgccacgcccaagcccacgcgccacatccgcgagcagctggcgcaggagaccggcctcaacatgcgcgtcatccaggtgcggcccggggcgggcacagctccttagccccgctggcctgggagccgggagcctcggaggagtctcccgccaagcttccttggctacgagcgcgcctggttctggtctgggagcagaccgtgcgcccgagtggggcacttgcccgaggtcggggactgtgaaccgaaagattccatctagccctgctgtcctcctggtattgcgatttgggggcgggtcactttacctctctgaattccgccccccgccttgcttatggaaggttgtaagcctctctggggtccgggatccctctttacctccacctttcgagcagagaaacaggcgatgccccctccctccctgcgccgaagcgcgggcagacaaacggccagaggctggctccggagccgaggggccgaggcgagagccgtgccgggagggaggcctttatagagccgtcaggccgcgggcgagccggggaccaggaagcccaagtctttatgagtcgccccacgggtccgcgaaatccttcacccttggctggttcgccgaagcctctctccacccctcccggcctaatccggcccggccccgcctcgggggagtcctggtgcggaagaggcgcaaggacccagcaggggcagcccagtcagggaagggagaagagggggggagaggacactcctgatcctgggttcacagccccctcctctgtcccaggtgtggtttcagaaccgacggtccaaagaacgccggatgaaacagctgagcgccctaggcgcccggaggcacgccttcttccggagtccgcggcgcatgcgtccgctgggcggccgcttggacgagtctgagatgttggggtccaccccgtacacctactacggaggtaaggggcgccccgggattcgctgttccgcacctgtcctattccgggagctgagggcgaagggtcccggccagcacgctttccgccgctccagaacatcgcccactcgctggacacacgatcacagacacatgtacactcacccacatgtcctggacacaaaatcagatacatggtctcacccatacagtgatgcacacagaagcacacacgagatacagtgacacattcacccacgcagggcacaaggtgcactcacacttgcgttcagagactccagggacacacgtctagacacgatcgcacgatcacgtataggtaaattccaccctctcacacacaggtacactcacggagacacaactccacagacgcgcacactcccaccagtcacactgaggccagtactggcaaatccacatgcatgcggcccccacggacagacgcacagccttcctgccgccctgtgcctggtgtacttggcatgaggtggattccgagcgctggagggtagtgtgaggggaggggatgggggtctggattcattccaagccgcctgctcactagcatcgaaggcagcaactcctgttccatgtggcggggtgtgtgcgcacagcatctggcagtgttagcccaaatgccggcagttgctctgggcaggactgtagtccaccctccagccccgagacccctggggttcctacagactgggggcacaagtgttgggccaaccccagatttccaccgtctttggggctgcagagagcgaggagccccagtttacaaagggcttcagatggtggtaccaggcttgggcctggggtgagctgtccccttgccacctcagcttttcctcctctcacttccctcacactggattggtgagccatcccaactccccctatccgattttttcagctccttaccctgagccgcattgcttgagctcaccaagctcactgtcctgttcttcccagggctgagggctcaagaaagcacctctcctcttctattctgaagcttctgaatttggagagaccccaggactgtctatgtctgagaggcatctgcacttctgagttgtaacgcaggttaggaagaggcaatttctcttagaaagtgggttcagtggcagtgttagcaaggcaggagctaggcacccaggtagacgcagaagggaagggaagataaccccatcactaacctcagcacatccggaagcctgaggggggattagaccttgagaccggaccggggcccctagaaattgtgggcaaaatgccaggctgtgcttttcagggcagagaccccaggcagtggcagggctcaggctggagcgccccagccgcccaaccctggacagccccccaaccctggacagacccccaaccccggacagacccccaaccctggagagcccggatggtgggcgtgtcttccggagtctccactcaccgactctctccacctaaatttgcctctttccctacaaaatctgggcccggagcagcgaggtagtgggggcggtaccggcccggaatttttccccgcctggataattaaccaaggtttccccgaggaccacttcgcccccgccccgacctatcccaccgcctcctctccctgcgcgctggatgaggtggggagctggatactgggggcccctcgttccccgtaatggtggggaagactccccagcccccagcgaggcagccccgcctaatccgcgctgggagatcccggcggtggcgaccggcagcgggcgagaaaggggccgggcggcggggccggcggctccccgtgggagcgcggacaaagccccagctgcggcttttgtgcccttttcagacggcgtttgttccaattacctccggcccggccgccatatgggcggaggcggcgcgcacggcgcgggggcagcggccttcgctggttttccggctcgccgcgggccgcggccgtctcccatccctgtccctttggggctccaaatttgccgctccccatcttccccttcactttcggggagaattaaattaatggttttaaaaagtaattggcaaccgttttagctgttgcttaaactgcctccaagccacgcctccagacaccccccatttggacagatttcagggtttggagagggaagagggtggcagggggcatcaggaattcgccccttgactgagatcccaggactcagcagggggagtggatttgcagaagagactcaggcttctggactcgctggttttcccgccgtacaaagcgggtgcctggtacaaggtggtcctttcgtgacgtcccccacgtcagtccttcagggccccacctggtgggggaaggcaggatatcccgaaggttctggaaaaggggctatgtggggcggtcagagagttgatacagatttgttgaggcagaatgggtttgcaatccggagtccctacacctcctgaatttatgggcaaaattctcatccttgcattttccttgagagagagcccatagctatcaccagcttctcaaaagatctcaatgtcctcagatgcttcagaacctgggggtgctggcaaaaccaacccggggcaaggctggaggaccgagcttctaccccaaggagcccgcggagctctggccatgacccagagaatcttcgtgtcctcctccccctctcccaagtcgctggagctcagttttctctttctcaggctaggctaggccggtacaaatggtctcaccgggatcgacgcggcggccgtacttggcgaggcgaaggacttggactgggttggtagggcgcagggaccgagtttagggcgccaaggccgccccgcccggcccaacccaccagtcgctcctgccgcggcccggatccagtttcccccggccaggtcgcttcccggtctcaaccatttcgcgctctgctctgtccgctggtttgtccctgcccggttcctctccccgggcctgtcagcctccgcttctctggaggttcctgggactcatctctgatccaccgtcttgcgttctctgggcgcatcgacttctctccatcttcgggctcactcctgactccctcgctgccgcccccgggggtttccacgcgtgtctctaaccgcggccgtctttcctctctctgcgtctcctcgactcctccgcgaccctccgatgtctcgggctttcgggtctcagccgcggactccgcgtctctgggtctcttttccgcctttctctctgcccctctgccgatctctccgtctgtctctcgctgtcccgcatctctgtgtctctcaccgaccctaagacacttaggaatcattgtctgtctctgcgtctctggccgcctctgtctctctccatctctaggtgtcagggaacctgtgactgaagtctccgagtttttgccgcgtgtgtcccccacggtctcggagtctctcccgtctctgtgtgtggtctctggcagtctgagtctcttgccctttcgagatctctcattgtctctctccccaaccctccccgtgagcctgcgacgtccaccgtctcaaggggcgccggcctccgcaggtctctctaaccttgggtcggtgtcgcgcgctcccctctctcgcccgcccgggtcccctccccgggtcccgggtcccccgcctacttcgccttctctcaccgcgccctgtctccttcccgctccccctccgcagactaccaaggcgactactacgcgccgggaagcaactacgacttcttcgcgcacggcccgccttcgcaggcgcagtccccggccgactccagcttcctggcggcctctggccccggctcgacgccgctgggagcgctggaaccgccgctcgccggcccgcacgccgcggacaaccccaggttcaccgacatgatctcgcacccggacacaccgagccccgagccaggcctgccgggcacgctgcaccccatgcccggcgaggtattcagcggcgggcccagcccgcccttcccaatgagcggcaccagcggctacagcggacccctgtcgcatcccaaccccgagctcaacgaagccgccgtgtggtaaggccgccgggccgccccccgcgctcggcccccgggggccccgccccgaagcagcctcctgaaaccaaaacgcccgacgcagacgcggtgggagacgtgggtgtccctcgggggttctctctcgggtccgcactcaactggcagctgctcctcggctgggcgccgagggggggccgacccccatctccaccccgcgggctctccaggagcctcagcccaccgccagtactctcccagcaaccgcgagcaatttcttgggaccaaagtcaatactccggagggtcaagagatttcgagcacgctctagactttccccgggcccccacccacccacccagccaccgccacctctttggactgagagagggtgaggccaaggggcggagacggtgtttttccctctctctgcaatccgagtggcattttgtaatcttatttctcgctgtgctttccccgtctttaaaaaaaaagatgataagaaaaggagagagattgaaagagagggagaggaaagggggcaagatgaggaggagatggagagacagcgtcagccagagggagaagacggagagcgagcgaggaactcgcgtgaaccgggagccaccgagagggagaccgagccacctgcacgctggcgctccctggtggccaatcttgaggctcaaggtcagcttctctaggaatagggctgtgggtcaggaagtggccagccgggtccagctcccgctcttccttactttgacgtttatgttgagcccgagggagcaggccggactcgaacacgcacacatcctgctctccccctgggtggggcgccaggattgctgggctcagacccacagaccaccctccctgcccagggcctggaggctgggccgtcaggatgtacaatattatacttttttggaagttgaacgcttctagtttccttattttgtataaagaagaaacaaataaagtatgtttttgtgtttactgtttatttattgtactctagttatccggggttggacatttttatatttttaagaggaggtagggcagagtgacggaggggaagcagaaagaggtttacctaaaaaaaacaaaaaacaaaaacaaaaaaaatcaactttttttaaagagaaagattaataaaaaaaaatcttttttccctcagcgctgtgtggttttctttttttgtccctaccttgataacgactcagagagaatgaaaccattcctttccctggttctggtctctgacattaaacccttgatgggtgcaaaaacctctgctcacccaaagggggagctcttctagtgactcccaggttcatgaaagtgactgtcctctttcgacagctactacgtgccaggcaccgtatctccccatgctttatgtaataccctgctctaacacaggcctgcccagcatatagtaggtcttcagaatgtttgatgaatgaatgaatgtgtgatttgtttgttgccagcacatcaaaagaattagaacttcactcctaactattcccccatgtaatttctggtggcccaaaaaaagagcaggctggtaagctgatgctggttatctgcaaggctatgttaggactgaagtgcgcctcctccccaaagtgaggctgttgtgctctgcaaatcttatgcagtgcatgcttgtctttaggtaaaggcatgagggaaagagtgtccagtgagatttaggaggcctgaggccactacctaaaacaagtcactctccttctttgactcagtttccctacttgcaaaagcaggggttggagagagtgcttcctacattcccttccaactcgaatgtctgtaatcccagcactttgggaagctgaggtgggtggatcacctgagatcaggagttcaagaccagcctggccaacatggtgaaaccctctctctactaaaaatacaaaaattagccaggcatggtggcaggcacctgtaatcccagatacttgggaggctgaggcaggagaatcgcctgaacccgggaagcggaggttgcagtaagctggtactacattactgcactccagcctggacgacagagcaagactgtctcaaaaaaagagagaaagaaaggaaagaaagaaagaaagaaagaaagaaagaaagaaagaaagaaagaaagaaagaaagaaagaaagaaagagaaagaagagaaaaagaagggaaaaaagaaaaagaaaggaaggaaggaaggaaggaagaaaggataaaagaaaaagaaaagaaaagcaggagagggaggtaaaaataaatagaagagtgtcctgcattgggatcactt

SEQ ID NO: 16574 - DNA, 18632 bp, Human
  misc_feature (1)...(18632): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctcccaccctccccactacccttgcccacgtccccccaccccaggcatttcaaccctctcccgccagcatggccctcgctctgactggcatttgacctcggacaagcgccacgccgtttttttatttttatttttatttatttatttatttttaagacggagtctcactctgtcaccaggttggagtgcagtggcgcgatctcagctcactgcaagctctgcctcctgggttcacaccattctcctgcctcagtctcctgagtggccgggactacaggcgcccaccaccacgcccggctaatttttgtatttttagtagagatggggtttcaccatgtttgccaggatggtctcgatctcttgacctcgtgatccatccatctcagcttcccaaagtgctgggattacaggcatgagccaccacgcccagccatgccatttcttaagatccaggtgctccctccccgggcggagaaggacctcctgagggggaggctgagccctgggctgcccttgggtgtgagcggttcacacacccacccaccctagggcagagccagcccaccaggggcgaggaggggccctgctggccgagaggtggaagcccttctcctgcgcccttcctgctgccagaccccaccccaagactaaggttatgctccccgggggtgaccggtgtccctctctccttcccgagcctggacacttggcctttgtctcctcggttccttatcacggcctgttctggtgcaggctgcccttggcgctggagaggccactggccgacgggctcatcagagctgccggtgacaccaggggccaaaggcgtcgcctggggacaatgctgccctctgtccttcctggagccactctggccgtgcctggtgccctcccctgggcccgcctgccccctccgcctcgttccctctgtgacctggttcctgttccaggcctcacctgggctggctgctggccacaggctctgttctggcccctctgcaggacacctcaccctccttaggccccttccagggtcccactgggatggaccccccctcaccccaagccagtgaggccaagatgggaccttcgccccagagccgggtgggtgggtgggctggctgcgctgtggggcccggccgtggcaccttgaccactgtttgtggcaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagaggtgggtcctgcccagcctcctgcggaggtgggtggccttcaggtccccacatgctgagcagaaaccacgtggcgtgggctcactccgtgcagtgtgtgtccagcctggtggcaggaggtgtgctcaggggtctcgtgtgctcacagccccacctgagccgcagcacccttccttgcagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcgggtgagtgtgcggctgcgcggccagggcaggcgggacagtggcacaggacggccccccgcacagtccccacgctgagcaggatcctgccagctccggggatcccccacccaagcacccaccccacaccccagagctcctcctggtggggtgggggccggcgtggggctgagccccgggcctgaggtgctgctctacccagggaatgggtactgccgctcggagggtgtggtggccgtcctgctgaccaagaagtccctggcccggcgggtgtacgccaccatcctgaacgccggcaccaatacagatggcttcaaggagcaaggtgggctctgccggggttccggggtgctggggggcaggtgggagccggggctggggctgcagcactgagccgagccctccgcaggcgtgaccttcccctcaggggatatccaggagcagctcatccgctcgttgtaccagtcggccggagtggcccctgagtcatttgaatacatcgaagcccacggcacaggcaccaaggtgatgccccccccccgccccactcaccaccccatgagcctaacctacgcccatgcctggagaggtgacctggccagagcccctcaccccccatgtttcccacaggtgggcgacccccaggagctgaatggcatcacccgagccctgtgcgccacccgccaggagccgctgctcatcggctccaccaagtccaacatggggcacccggagccagcctcggggctggcagccctggccaaggtaggtggggctgggcttgggggtccctcaggctcctgctccctgggactgggttgcgccatggctgggcactgctgctttctctttgccaagtggaggcgggggcttccccaccaggagcctctgtcccccgggctatgctgcaggtctgagcagaggcactgaggctgacagcagggagagctcgtagccaggctcgctgggccttccctggaggcctgatgccctgcagagcgtctgccggacacggagccgagctggaggagccgcttgggtgggaagagcgaggcaggagcaggcctgggggggtccacggcaccatcagggtctcccgtgtcgcccacccgtccctacagcttcctgacccactagcagaggcctggggacctttagagagaccaggcacaggagccccaacacccatgatcactcacgccctctgccccccaacttctgcagcctctgagatgcaacatctgggccaagggggccttagtgttcaggccacagccaggctttggtgggtccacatcaggctgggaggcagcaaggccggaaggggaggtcttggaccaagctgagggcagggccatggcggctcagtcctcggacccctgtgccatggcagaattaggttggggacaggaagtgcatcggagagggccctggaaccctggccccacatgagagtctcggggaggtgcctgcccccagctcaggcagtggtagagggagtggggcggctgcccatccaccacgtacccccgcaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctggtgagcccacactctgcccccaaggtggtcccttccctggggaaaggcaggcgaactggagctggtggtcccctgaggtgctctctgggacggggatgggcacacagtggcacgggatggggctgagcctcgtgacgtgctctctgggacagggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccaggtagggcccagcctgccagcgtgtgagcaacgccagccccagggctctggctttccctggagcccaggagctgcagtgttgagtccggggcccctgacagcccctttgctaggcagagccttgtgctgggggcaggacgggaggggaggaggggtctcagtggggctgtgtgggggccataggggcttctttcctatcaggagacctgggagggtcgatggggcgcgggggtggagatggcctagtggggccgggggccgcccccaacagctgcacctgctggaggttgcaacctgagtgtcctgttcccaccccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggtaggtctcccggaggggcccccagcacctccaagaaaggaggctgccttctcgctgtggggtcctcacctgcagccctggcctggcccccgtaggatagagtggcccccgctggcccggggacacccagctcggacacagccgtgcgcgagtcccctgcagctgccccactggccccacacctggcagccttgggcctaggcacgtgtccatgggcatcaggcctgcgtggagcccccgtgtgatgagcacacagctgcagcatagcaagaacccaggggctctggtgaagccaacacacgggtcatcagggttccctcagactggtgccctctgttggcacccatctctgagccccatgggccacatgtgggcaggacctggaaagaaccttggctgcagaggactgagggggccaccatctggggactgggctcccaggagctgcccctggagtggcagctctgtaatgacacctccacccacgggtcaaacacagcagggggcgaacctttctcatgaaggctccaaggctgccattaccacacttgtcattactgcccccagctgcaggcagtgtctgggtgggtgggtggctgggagtggctcggtgtccacgctaagcctctgaggctggctctgccataggcttgtcctgggaggagtgtaaacagcgctgccccccgggcgtggtgcccgcctgccacaactccaaggacacagtcaccatctcgggacctcaggtgggtgctgcggcctgggcgggctcctctgtcccctgcgcctgccattgcaagtctggcagggacacgcggccacggtctacgccccaccaagctctgacgggcctggggcatggggcaggtttgtcctcaggtcccttgcccattccctctcggttcccttggggtgaggtgggtgcgccctacctctccgagcctgaggtgggtgcccagccaggatgcttatccaggctcccacgatgtccaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtggactaatacggcctggggggtgcggggcgggccaggggacccacaacccagcactgacctggcccctcatgcaggtgatccgggagccgaagccacgttcagcccgctggctcagcacctctatccccaaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggtaggcccagcctgggggcagcaggcgccgggagcctgggatgggcgcctcagctgagcaccaagagagcccacctgccctgccgcccccaggctgtcctgaagcgtggcctgaagccgagctgcaccatcatccccctgatgaagaaggatcacagggacaacctggagttcttcctggccggcatcggcaggctgcacctctcagggtgggtcccttcccagcccgggtctcgtctcccggagtcggggacggcgtggggtgggtgagcggggctgcgggcccctcactgacccaggccggtggcagcagccctggatggtccaccgcaggcagtgggtgggctgaacccagagcccctggaccccggtgacgggtgtgctacccatgcctcccttctccgtagcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcggtgagcaggggcccggcgggtgggcagactcttccctccccacagacgcccgctctgtgctgaggcctgtgccctcccgcagacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactggtgaggggtaccccaggaccaaggcgggggtagctggggggcgggtgctgccctctgatctccaactctcccgctctgcagggacagtgtccctggaggtacggctcctggaggcctcccgtgccttcgaggtgtcagagaacggcaacctggtagtgagtggtaagcagggccggtggcacgggagctgcggaggctgtgcccgctggccatgccgcccgtcctcaggcccttccgcacctccctttccacagggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgggtactgactacactgctgcccaagccaccggggagggcggtcgtcattgtggggaccacagagggcacccacagctaggcatgcagcttgggagggagcagaggggcccggtgggctctgggaggtggccccagggacctgggagttccacagcaccaaccaggccctgtgtgcaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaaggtagccccgccccagccccagcccagtgcccccacccaagtatgccgcactcacccagcctgtccccacagtggctgacgtggtggtgagcaggtggctgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaagggtgaggtcccagccctgctggcttcggacacctctggcgatgaggagcgatcgcctcccctcacgttgaccccagacttgcttctccacggggccccctttggggtcagcaaccctagcccaaccctccggccggagctcacgatggcgggccctccctccctcccccagcccccagccttcctcgtccctggtcactgttcctcagtcttgaaagggtacttgggggcaaagatgacagattcagcctaaggtcacaccttggctaggcacagagtagcccctgcagctgaatgcggcccctcactgcgtccacagtgggcaggagtcagcctcccagtggtgggcagccccttcctcaaccctcagctatttctcatcctgtgggcagagcggggtggtggccccagaaggacagagtgggtctgagagcccatgccaggcagatgccctggggctttgggaacaccaggcctgcctccctccctccccagggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgggtgcctcctgggcagccaggcctctgccccggacatggtaggacccaccctgacatcagttgcaggagacagcacagacacggggcgggccctgggcggtgggtggggccggccagttccctgtgtggttctgtgcacgtgtcctgtgcggtccacacagccaccgtggagggtccgcccgtgggctccaagaggtgcagcctaggcaggaccccagggacaagaccagtggcatccatgcgtgcccatggctggcaccgtcatcaggttgacggggaagcctttctgccagactgaggcctcatggacattttgcccagccccaggtcaggggcacctgcctggtgtggggctgattccagaattcaccccctacaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggtgcggccgccgggcagggggacagggtgggggccgggtgagggccaggcgggcagggtgctgaccaccgcccccacaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaaggtcaggccctgccccacctccaggccccaccccacctcccaacttgccgagtgtggcctgaccctccccgacccgctgtagggcatcctggctgacgaagactcttcccggcctgtgtggctgaaggccatcaactgtgccacctcgggcgtggtgggcttggtgaactgtctccgccgagagcccggcgggaaccgcctccggtaggagcacggcccctcaccacttccccttccccaccagcctccccatccccagcctgagctccccgcctctgcccccaggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggagggtgagcccccgacactgccctgcccctcccgggagactgcacccgaaggccccgcagcagccccacctccctgtttccctagacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccaggtatgggtggcatggggccgtgggagtggactgggccggggagcagagaccccagcagctaggacctgcctgggagcccctcgggagggaagggcaggcggtgaggggctcagtgccgtctcccccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggtgagtgtgtcgagggtgtgagcctgggccccacgtggatggcggccaggcctgtgctgacccacctgctgcatccccaggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtgggtaaggccccgcccccggtgcctcccgctgccctcctggccccgccgccctggctcaccagccgcgcttcctctcttcaccagggtcggctgagaagcgggcgtacctccaggccaggttcccccagctcgacagcaccagcttcgccaactcccgggacacatccttcgagcagcatgtgctgtggcacacgggcgggaagggtgagtggcccccacagcccccacctgcctcctgcctagcctccggcccagggagaagcagggtctggccctctggactgtggtggctgggcttgcagtgggtgtgattgtctggcccctctggccccctaggcgttgacctggtcttgaactccttggcggaagagaagctgcaggccagcgtgaggtgcttggctacgcacggtcgcttcctggaaattggcaaattcgacctttctcagaaccacccgctcggtgaggccggcagcgcctgggcgggggtgggcatggatgggtgtgggtggacctgtggaaggccctgggtgagcacggcccctgcccgcaggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgaggggaggagtcccggcgcctcgggcaccccaggctctggtccccaggcagtgcctgagccggtgggtgctgcttggacgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggtgagtcggcaggggtgcttgtggaccagcctgggccaggcacagccccgggcccctgagcccttctctgcagcccaccattgtgggctgtcacggtgcctggggtctgtccccctccatcttgtggggggcttgctggatggggctctgcggctgctccccacttccccagcccggcgtgtagggaagagaccgtaccctggcccagtccagcccacagtcctgtgtcccgcaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtgagggaaggccccaaatggggccctcaaaagccccaagaccaagggggggaccctgggtggacgggtgaggccctggagctgcagggagtgctgaggatgcctcccccaggtcttgagagatggcttgctggagaaccagaccccagagttcttccaggacgtctgcaagcccaagtacagcggcaccctgaacctggacaggtgggtaccgcacagccctgctcccgcctctgccgggctctgggctcagggccgtgggagccaaggtggtttgttgacagccctctctggcgtttcctggggatgggacgttgggggctcctggggatgctggccaatggggagtgacacgcgtgcccacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggtgggccccaccctctcccctcgaccctgcccaccctgccctctcccaggggccacttccccacccccaccttctccccgcagccctgcccaccccaccctctcccagtggccactccccaccccgacctccccgcagctctgcccacctgccccctcccccacaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggtgagcactcccagtaggagccgcgccaggtgtttcccctgctggcatcagggtcttgggacatagcagtcgtgcccctgtgcgcctcagtttccccatctgcagagccagggtgcgggcgcaggtgtcactgtggtggtggtgctttgggagatgcacagcccacgcacccctgggtgtcagccctgccgcatacaggccgtccccatgccccctctggagttgccgacccggcgcatcccttccaggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcggtgcgtgtgggtggccaggcgggagtggggtccccgggcctccccagcccttcctccttgttgtctggaccgtgtcccggcaggcataccgcccttcgtcacgggtgccattctgagcgttcccaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgaggtactcccgggccctcctctggaagcggtggtcagtgctggccatcacggggcccgtggctgccgcctgcacatgctgagtgcccggcactgccattgcagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccaggtgagagccaggctggtcctagaggcctacggcaaacgtctgggctccccacctgtgccctggctttgggggaccgtcgcttaggaggccccgccccttccatctgctcagcagtccctccttcctctcagagctaccgggcaaagctgaccccaggctgtgaggctgaggctgagacggaggccatatgcttcttcgtgcagcagttcacggacatggagcacaacagggtgggtcctggacacccctgaggccgcaggacccagagtactgggcaggaacggaagggggaagggaaggatgggatgggacgcgaagagcgttaaaggccccccaacttcacccctttaatagccgatcccggccggatgcggttgctcatgcctgtaatcccggcactttgggaggctaaggcgggcagattacctgaggtcgggagttcgagaccagcctgaccaacgtggagaaaccccttctctactaaaaatacaaaaattagccaggcatggtggcactcacctatagtcccacctactcgggaggagaatcgcttgaaccgggtaggtggaggttgcggagggaggagaatcgcttgaaccgggtaggtggaggttgcggtgagctgagatcgccccactccatctagcctgggtaacaaaaatgaaactcgtctcaaaaaaaaaaagcccacccgcagtgtagcacagggcaggccggtgctgtgggtgctgccagcacctgctcagagcccgaccccacaggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtgcgcaaggggcctgacgggaacggggacagggacaggagcggggtgggacggcagctgatcgcatcccctgcaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctagggccccgtgcccccgcctgccaccggaggtcactccaccatccccaccccaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaccaccgtcctttcttccctcctccctgacctggcagctgcaagctctccagctccaccccacccagtcacggggccgtgaaggggatgccctctgtcctctggtccccagttcccacacacccctaggccatgtcccagagccggggctgggccggggagtgaggaaggagcccgcgtggcagccccgggcttcccgggaaagcgctgggactggcgggggggggtaccgaggctctggccaagaaacaccaccagtgagaaacgtgtaggaggtacagacactgggaagttggcttcagctgaggagaggcccctcgtggagaatagtatttgcttgaagtcagtggattgcaggcattcgccctgccaaagatgccgtcacagcctcaccaagacggtgtcaatagcgccactggctggccaggttgacccagaagacttgggtttaggcaaaggagtggaggctgggagggagcaagggacagggagccctgggcacctggacccccggcatcgaggggtggggtggacacagcctccaggacccataagggcagcaccccacgggtggctgtgcggggggccgctgggtggacatgagcttggggtagaggcatgggcaggagcgagagccaggattggatttcgggaatgggcaaagcaggccagcccggggttccggaaggcacagcatgcccacagaagaggccctttcagtgtgagtgccaaggcacagaggtgggtgggggctgggagagcccctgctggagaggcaggggagggtgtgggcgcaggggccatctcccagggcagggtagtgggccaggactacagtgaacaccacgggcctgctgggggggtgggcctggtgcagcggctgcaggtgggcagtgtccaggcgtgagtgtggacagcaggcgggcatcggagcgaggctcagccacacccctcctgcggtcccccaacactaggcagctgctcccttcagccgtggtcccctctggcctctctccacccctcctccggccactcccaccccagccgtgcacacaggctcagggccaccagggaggacagaggctcacaggcctatctgggggtggcctcagaactaaactgctttagctccacagcctcaggccctgcagggcaaggcgggtagtgcccagcacatgggctcttgtcacccctc

SEQ ID NO: 16575 - DNA, 25198 bp, Human
  misc_feature (1)...(25198): n = A,T,C or G
actacacgtcgtactcagcaacacagcaagacccagtttctttttttttctttcttctttttttttttttgagacggagttttgctttatcgccccggcttgaattcaattgcccgatttcgggttcattgttggttcaaattccgggtttaaggcattttccttgattaaccttagggattatttgggcttttaggcccttgcaccaaggcttgctaaattttttgaatttttgttagagacgggtttccccgtgttagccaggatgttctcgatctcttgacctcgtgattcgtgatccgcttgcttgggctcccccaaagtgctaggattacaggcttgagccaccgctcccggccaagatccagtttcaaaaacagaaaaaaaaaaaaaagcaagaaacaaacaaacaaaaccaccaacaaaaacacacccgacagaactacccagcacagtggcacatgtctataatcccagctactcatgaggctgagacaggaggacacaagaacccaggaattcaagactgaagtgtgctatgatcgctcctgtgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggaagagccatgtgttcattcccttatactgctgtaaatgaggagagagggcacttagagaaccttctattggccgggcacggtggctcacgcctgtaatcccagctactcaggaggctgaggcaggagaatcgcttgaacccgggaggcagaggttgcagtgagccaagatggtgccattgcactccagcctgggcgacagagtgagactcttgtctcaaaaaaaaaaaaaaaaaaaaaggaaccttctgttcttagcattactagtgcccttctatcacagctatttttgtttcaaggcagttctgcatgtctagaccaggtgcaaaacggagtgtgagggaagtaggagtgggtaggaagcaagaaatatgggtgcaaagtccttcacctttccttgggatactaaaatccctactcatctaggcacacttcctcaaaccacacttctgaatattaggtttccactctccgtctttcaagttccaacttaactggctcagagtccagctgttttcctttagcctcttaagttcatcactctccttcctcttccttatgggaaaggatctcttgattcagaccccacagtaatctagtctcaggaatagtgagcaacaacaatggtgcggtgagggctttcaggggatggcagctagcccagattaagaaataaagatgaagtctggctgggtaaggcatgccacagcaacgactgttcacccatatcccgatgctggctttgcccaaggagcccctgggcccctcagcccagcccgtctcctacgcagccaacttgccgcctcagtccttaaattccaggcacaaccctggagcttgggattgtcacctcagtcctcactgtctcatccccattcacggctcccgcctccgccgcccacagcccccacacctgcccccgccctgactccagctccagcgcccggctgccggtgctgcagccgctgccatggtgatgggtctcgcgagaactgccgctagctaccgcgcagctctcgcgcgatcggggaggtgggaagtatcccgggctgggggtgggggtacgccgcacagctccagtcgccgtcgcggcttccggtgctaggtggagggaaggaaggagggagccggggagtgggccagggcagcagccgggctgaagtcggcttggggagccagagggagcggagcggaacctgcggggcagaggcggcggccgcagcggcgcagctgatagcaggaacaggtgagaggctgggaagggaaggcgggtcccggtagagaagaggctcggtcagggtgagggctgaggagatagagcgcctcccgggccccgcccggcactgcttggcgtggggcggtgggattcttcccacccgagagctcagagagggtgcgtcgggccagcttcacgcctgcccccgcatttgaaggacgcagagctggggtgggggtggggggcgcacacggatttgtcctccgcctcgctcaagggggcgacctgggctgcagttaggttgtcgcctgcaggaggtgtgctgttgagggagaggaaaaccgtccgaggagaggtgatgagggggcggtgatggctgtttgtatcttttctgttaaagggctagggaatgctgctttcttctactccctctccctcccccaccttagcaataggagacgggagagaagccttgctgtggttacaccccctcccccatcatagggcaggggtgcgtaggggggttgggggttagccaacagggcaggctgctggggcaccacatgggcgctattgtggtagaggttgcgctttcgagtctagggaaccgcaggttgggaagagggcagcaagtggggagagggtggagaggaggcaggagaaggaggagggggatctgatcttcctgggaggagagaggtggggccttcctccccaggcggagcgggggcggtctcacaggaggagggagcatcttgtcactggccctcagtttgtgtcttccaatccgctttctttctttaggaagtaccaggattcccggaacagaaaatggagccattgcttacgcgaatcgtttgagggaaggggcgggagttggggaggtggagttccctgttaaaacgggccacttgattagcaaagtggtagctgttattttgggggaattcccgtcttgattgcattaaggcgggtctccatctttccaggccaggaggaatgtggtggtggaggtggaggattgtggtatgtggtcaggagtgagaagaaatagtaaggccgtcccggtgagggagaaatgtaacctaaaacctgtctctgctgttgttggattgggtcacccctggtctatggcatgaaagttttattgggaggagatctgctgcaagagtctgattgcttgggtcagtgcaacaggacagaatctagtcgctgcatacctccttccctgtcctcaatcaggtaggtagtaacagtctttgctgccattttgtcttgggcttgttgttggggtaggtgtttccacttgccgtgacttgggacatgggacagtgttatgggacagtggattatcatagcccattggacttgagtttgaaaaacatgtctgtaaaagttcattctaagaaagaaactaatccattaaggttcagcttttcaccgaatgaatgattgaccttggattcagccaggaaaggctcccatgtatcacatattcacatgcgtcctgtttcccagcatagaattattaccttgcatagttagaatttttatagttgtctatcttgcttttccaaagagactagacgcttttcgactgcaggaactggatttcgtctcctcttccacaatgcccatgcaaacagtaggtacccatgatgaatttagaatgtaaatagatagaactcaacaagctttctaactgtagtttaaggaaagggcaagagatggcttggctgtcagcagaagtgcctggaaatagcttagcaagggtacaaagacccttagcctttgtaattaagaagtttttgtgtctctgccttcctaagaggcacagaataggcatagataatggaaacttaagacccaaaaagaaaaatattactagaacacagagtcattatctgcagtcccagatttcctgcttccccattgtgggcaaaggggtctctccatcagacctaagtctttcaaagtgttatatatgaattgggatcctggagagtttggaggagggaccaatatatgtatatgtgtggtgtcaggtacagaattggtaccagtgaatggtagctgctattattatactgaatgcaagtataaaggagagcagactggaaagagtggaagtgagtgaaatactaagtgcacaaagagtcatattgtagtgtgtgttcaccctactcttttacactagagtcataataagaggaagtggactcaggatagagggtgggatttattggttagaaggaggaacttctttaaaaccaggttggttaaagttgagtatgtaactgaaggaaattgtagaatctgcttccctatatacctttatttttatccacccaggctggagggcagtggtgtgatcataactcactgcagcctcgagctggcctcaagccatcctgtacttcagcttctcaagtagctgggaccacatgcgtgtgccaccatgcccagcgaatttttttttttactttttgtagagatctcactgtgttgctagggctggtctcaaactcctggctccaatatatcctcccaccttggcctcccaaagtgctgagattacaggcatgaaccaccatgcctgaactctcctcaccatttttgttgaggtaaatttagaggcagaatggtatagtaattaagagtggatcttggaatcagacaaaattagattcaaatcctgcttctgctaattaccagttgcatgtttcttgtaaaattgcttgtcttctctctttattttcttcatctgtaaagaaggtaatgacatatggttttcaagagaattattatttttttggttgtcagtagaattaaatgagataaatgtaaagcacctggtattgtacaaagcatatagtaagtaccaaataactgttagctgctattaataatccattatcataatcctaataatatgaacactcagggctgccttagaggaaaagaggtttacagaagaacaacttgctgcctgaggtgcttgtgtagagggatgattgttaccatgagtttctgtgctggtcgtaggcttatgagcagcgaaatcttttttcagcttcagcatcagcatcgcagagacagctcctgctgcctgagtgggaggtgaagctggagcaaggcaggggccctgaaccatcaatttggatgtagggtgaagatatgggggcacaagaatagtattcatattagaaaagtcagtgtgactctgagataatggttcactcttccagaaaagagcaccctgatgacctaggtcagggatttagattcctagatgcccttattttaggtctcagtcagtatatggggatcttcatttagtccactcttttcatttagtccaatcttaataaaaaatgtctgcttttgagtatctgtttcagaatatcatggcctagaaattgtgatatctgtagaattatctgtctaccgtaccttcttcacttgaacatctgttgcaaatatagatagagtgctaataaaactatttgataatgaaaagacatgaggagcgtttggaaagggtcccacagatgtttgaaggtttcatattatagtctggtaaagaactgactaaagtagggatttcatgaatgtgttagagctttaccatggacttatgcaaaggatctgccacaccatgtggaccagaaaggaaatggctcagaatgttagagatccaccattattaccatattcctgaagaaagttgagatgactgggtgtggcaggtctcttggtaccttttagttctcccattactgctgaaagcctggcataatccttcctttattagcttatgcacaggagtgtcaagcgtgaatgcttaaacttcagcatgagcttaagatgtaggagagcatttgctctctgttgcaatggtttatgtcctttttttaaaaaaaaaatagtcaaaccttaaataaaattttatttgaattctaatacataaaatggacaaaagtggagttactctctactggtggtggaaaatgggggtggggtataattacagcccctcacatgatctctcctctcttcaagcagaacctgtgggctctgaggacatggaaaccatttcttcagtttgtcagatacagggaaaaggatcagagaccacctatagaatacagtcttcttcaaccccacaagtgttttgccaccctcagtagaaccgttctcaacacgcctgtcagtcactagctataggtcagtcattggtgctggatgctggagacgtgaaatatgaataaggcatagtctgtgctggcaaagagctcacagtctagtgaggtactttccagcctttttctcatcatggtatacacaaaaaatggtaatagtgagacttgaaatctgagatggctggcccaagggctgtagccaccccaagccctgcccagccatccagtggctgataggatcagtatctccagctgacctgtaatgcactagaggcacattgggcagttgcagctctggaaagcaaaacagacaaacgtgaatactgcagcaagtcctagagtagaagtgtgtttgggatgccgagggatcgcaggtaactcttattccctaagtaggcagttctctgttcctctgtgtccttaggctgctctgtataatggttggccttgtccacatcatgtcttcctgtttaagcagtttactgtcagctccatcttgacttgcacaatgggaccagattaggggcagaagattattaggagtctaggctattgatggactttcagtgattttgtgattaggaatttatagtgttctggatatccaagactgtagaggtgggcattggattggtacagccatagaatatcaggagctgtagtggttgtaagctggtcagattctaagaacaaggcaagctgtaatttttgggcagagggcagtaccacagaatgttccaaagaaacaaatgagtctagtttttatcttgtcactgttttatctgactaggattctaaaacagaccttgtcatcttttctgactcacttgctaagggttgtctgtggtaaaagccagacccttcccaggcgttttgggtctccatcagacagggcggttcgggatccttcttcacttcacagctgtggcgtccttcaggtttgcgtgtcctggagtcttttccaggattgttctttgcctagatgggaagctggcataacaattctggcctgagcctaaacaccactaattgagctaataggaacttatttagttaggtacgttttagtttacaccaaaactctagctttggatcctccctcttttcttttgtatgttctatccccattggtgtctatgatgtcttgctctcttgatttcccttctgcctctctggttgcttcttattctttcctggcctgcttttctgcccgctattttatttatttatttatttattttaattagtttttttttttgagacggagtttcgctcttgttgcccagcctggagtgcaatggcacgatcttggctcacagcagcctccacctcgcaggttcaaaccattctcctgcctcagcttatggagtagctgggattacaggcgtgcgccaccacgcctggctaatttagtacttttagtagagacagggtttctccatgttggttaggctggtctcgaactcccgatctcaggtgacccgcccgccttggccttccaatgtgctgggattataggcatgagccaccgcgcccggcctatttattatttatttatttatttatttatttttgtgatggagttgcgttcttgtcaccgaggctggagtgcaatggtgcaatctcagctcgctgcaaccttcgtccaccacctggcttcaagcagtcctccagtcttgcctcctgagtagccgggattacaggaatgccccaccatgcccagctaattttgtatttttagtagagatggggtctcaccatgttggccaggctggtctcaaacccctgacctcaggtgatccgcccaccttggcctcccaaagtgctgggattatagctatgagccaccgcgcctggctcccactactttaaatgttgaaatgtcaggcaggtttctgcctttgcccttttcttctatcccactgtgtacactatccctagatatatcagttaggatgtattagttgcaaaaatagaaaacacacgtgtctaaaacgctgagaggatttattaaatcatatagcaagacatctagtagaaaggcagacataggccgggtgcagtggctcacgcctgtaatcccagcactttgagaggctgaggcaggtggatcacttgaggtcaggagttcgagaccagcctgaccaacatggtgagaccctgtctctactaaatacaaaaaattagccgggcgtggtggcaggtgcctgtaatcgcccagctacttgagaggctgaggcaggagaatcggttgaacccaggagatggaggttgcagtgagccgagattgcgccattgcactctagcctgggcaacaagagcaaaaactccgtctcaaaaaaaaaaacaaaaaggcagacacagaagaacacatattgtacaattttacttctatgaagtacctagagtaacaaattcatagagacaggagaatggtggttgccaggggctggagggacagggggattggggatcctctgtttaacaggtacagtttcagtttgggaagattaaaaagttgaggtgatgaatagttgtgatagttacactacagtgtgaatgtacttaacgctactgaattgtatacttaaaaaaatggttagaatggtaaattttgtgtatattttactatgatttaaaaaaaaagaagccagtcgggtacagtggctcatgcctgtaatcccagaactttgggaggccgaggtgggcggatcacttgagcccaggagtttgagactagcctgggcaacatggcgaaacttcagttaaacaaaaattagccaggcgtggtggtgcatgcctgtagtcccagctactccagaggctgaagtgggaggattgctcgagcctgggaggtggaggctgcagtgagccactatcacgccactgcactccagcttgggtgacagagcaagacccatctcagaaaacgaaagatgccaggcgtggtggtgcatgcctatagtcccagttactcaggattgcgtgagcccaagaatttgaggctgtagcgcaccatgagggcacctgtgaatagccattgtatttcatcgtgggcaacatagtgggaccccatctctaaaaaagaaaaagtttagtttaccagcttgatactgtaattaaggacccaactgagtttttcccatttttctgctctgacatcctggagtttttaatgtctgtctccctctctttatagtctccagattattctagcttctcatccttctacatcatcaacatccaaaggctggacaagagaacattgccataggtccttttctaagattgaggggccaggcacaatggctcatgcctgtcatctcagtactttgggaggctgaggtgggaggactgcttgaggtcaggagttcgagaccagcctgggtaacatagcaagaccttgtctctacaaaaaaactttaaaaattagccaggcatggtgatgcacacctgtagttctagctacttgggaggttgaggtgggaggatctcttgagcccaggagatggaggctgcagtgagccatgatcatgccactgcactctagtctgagtggtagagtgagactctgtttctaaaaacaacagtaataataaaaacaaacatgttcaggccaggtgcagtggctcatgcctgtaatcccagcactttgggaggccgaggtgggtggatcatgaggtcaagagatcgagaccattctggccaacatggtgaaaccccgtctctactaaaaatacaaaaaattagctgggtgtagtggcgggcgcctgtagtcccagctactcgggaggctgaggcaggagaatggtgtgaacccgggaggcagagcttgcagtgagccgagatcgcgccactgcactgcagcccgggcgacagagcgagactctgtctcagacaacaacaacaacaaacaaacaaacatacatattcaccttcagatctgttcctcttgtattttctttctgaagaaatgccacccggccctaggccagaaacctgggaatcatctttgattattctactcttctgcgtacatttaagcactcattaaatcctgtggattctaccattttgatgtttcaaatctgtcctcttctctctatctccacttgtagttgacaacttgcgatttctcacctgtattactatacctcctaagcagtgtctgtgcctccagtctttcccctttctaatttactcctgaaacttctaaagcacatacctgatcacgttactcagcatggcctttaaagcccttcatgatccagtccctgcttatctctccagccccatccctcatcattttctttctttcttttttttttgagaccgagtctcactctgtcacctaagctggagtgcagtgatgtgatcttggctcactgcaacccctgcttcctgggttcaagcaattctcctgcctcagcaccctgagtagctgggattgcaggcccacaccatcacacccggctaatttttctatttttagtagagacggggttttaccatgttggccaggctgatcttgatcttctgaccttgtgatccgcccacctcggcctcccaaagtgctgggattacaggcgtgagctaccacaccttgcctgtactcttcactttaggaggctgagactggaggatcgtttgaagtcagaagttcgagaccaacctggtcaacaaagtgagactctatctctaccaaaaataaaaataaaaaagttagctgcgtcacgatgatttgggcccgtaggtctttttagctactggggaagctgaggcagtaggattgcttgagcccaggatttggatgctgcagtgagcctgggtgacagagtgagacctcatctctttaaaaaaaaaaaaaaagatcatataaatttttttaaagtgctatctgaaacttaggtctttttttctttttctttttttttgagacatattctctcactctgtcacctgggctggagtgcagtggcgtgatcatggctcactgcagccacaacttcctgggctcaggtgattctcttgtctcagcctcctgagtagttgggactacaggcgtgcaccaccacacccagcttttttttttttttttgtagcgatgggcttttgccatgttgcccaggctggccttgaactcctggcctcaggcaatcttgcatcagcctcccaaagtgctgggattacaggtgtgtcctgctgtgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctcttagtgatatttcaatttgaaaattatctaagaacaaagctgtttttactgcactctgcctggcagcagagggtttgggagaccctggtcttccttcccctggacgctgaagaggaggaggtagtgccagatcaggagtcccctcagaggtgtctcatagcacattcttggatcattcactggaatcaggtagagggagtatgtgtggccgactgggatgtgtgactctcaaaagcacctggagattgaggcaggcacgttcctgcaacatatgtaaggaaagatggctgagtagccagttacagcaacagcctgcttctcctggggggatgaggtgggagcagtgagttgtcctcaagtgaggatatccttagatgaggcttaaatcaactgatgtgcttaactgaattcctacagtgtcccacacagattgtactagagcacatatttgggttcctattgttatttttacctgtgataataaagtttctgactgtaaaacagaacctgcagatatctttttaacagagatgttagtatattccatttttcatcttgagccactcactttcagtcttaactgcttattcttggtatccaacagccaatggaaccctggcattttgccctataaacacaggagtaccatctgtggtgaaagagagtaactataggctatataatacatggagaaacaattcatggtttgtttgctttgccattctgcttcctagtgcttttttaggaatgtattgtgaaagtgagaataggctgtatagccagagatttgtattcatggcacaaagcagaaagctgctaccatcttggtggtagggcagcatgctctctggtattagcaagggacagggaaaaccaagacaagaaagccagcatcccctttgaaatgctcatttaagtcaagctccagattatacttaaagaaaagtcatggccagacgtggtgggtcgtgcctgtaatcccagcacttcaggaggccaaggcaggtggattgcttgaggccaggagtttgagaccagcctggccagcatggcaaaaccccgtctctactaaaaatataaaaattagcaaggcatggtggcacatgcctgtaatcccagctactcgggaggctgaggcacaagaatcacttgaacttgggaggcagaagttgcagtgagcaacctctgcctctgcactccagcctgggtgacagagcgagactgtctcaaaaaaaataaataaataaagaggaggagtcataacatccattagtttcaaggtcctgggctgtgccagggagatacatgatagctactggatatttattttttgagatggagtctcagtgttacacaggctggagtgcagtggcgtgatctcggctcactgcaacctctgcttcctgggttcaagcgattctcctgcctgagcctctggagtagctggtgctacaagcatgtaccaccacgcccagctaatttttttttttgagacagagtcttgctgttgtctgcccgggctggagtgtgatggcatgatatcgactcgctgcaacctccacctcccaggttccagcaattctcctgcctcagcctcccgagtagccaccacacccggctaatttttttgtatttttagcagagacagggtttcactgtattagccaggatggtctcgatctcctgacctcgtgttccgcccgccttggcctcccagagtgctgggattacaggtgtgagccaccgcacccggccaatttttgggtttttaatagagacggggtttcaccatgttggccaggctggtctcgaactcctgacctcaggtgatccacccacctcagcctcccaaagtgctgggattacaggcgtgagccactgtgcccggcctttttttttttttttttttttaagacagagtcttcctctgtcaaccaggctggagtgccagcggcatgatctcagctcactgtaacctctgcctcctggattccagcggttctcctgcctcggcttcctgagtacaggcgcgcaccaccatgcccagctaatttttatatttttaatagagatggggcttcaccatgttggccaggctggtgtcaaactcccagcctcaggtgatacgcccacctcagcctcccaaagtgctgggattacaggcatgagccaccatgcctggccagctatttagatattttatcagttattcatcagtcccactgtatattaaatggcaagagagaatcccaccaattctagtcttctagtccttttatgttgttcccaaaccagtcctgcgtcaaatatgtgtggaaaatggctgagaatggacaggatagctaagcaactcgctgtgcattacacagagataccaaatcctactggacagaagaaataatataaggacatcctcagatgaggcttaaatcagccaatgtgcttaattgaactcccacaatctacttggcactagagggaggacagattcaaaataagtagacatagtctttgcacatagggaatacacagcttaacgtgggaagcagtaaatacacagacttataaaagaagaaaaactccacaaggtagtaagtgccacattgagtggttaaggtcattcaaagtaaggccttgatgtggcatgccaggaaataataggtgtaacactgggatcagcttttgaaccaggacttcagcatgacagccgagcaaagaagcaaatcaaaggacagtgtacctgtgttctggggcaaggcatattggctagttatatctttttcagccaccactatactcacagttggtaagcatttaatcagcaatagtttcagtcataaaggacagcaagataaatgtgtggcataaatttaattcagaatctgggccaaagcctgataccaaacctttaaagcaaagtgtcatctggagctgaaggaaaggctgcctgagcaagaggcagaataaaggctagaagactaggaagacttgggaaaggtttaaatttcatgaggtgttagtagtatgaccaaaagtcactactacaaattgccaaggttggtgagagctgttcttagctgggtaggtcgctcaggggtcctcaggagtctgtccacctgggtgggttgaggcaggaagagtagggaggaaggctagcgggtggcttgactgaagttgaaccctaaggttgagctagcccttcttcctggtgtgtgaaccctctaggtcaggggtagggctcatctggggaacctactgagagtgccacgcctggctcattagtggctgtctggggaggccttttgaagatgaaacacttcataagcactcattgtttctgttttttcggacaaactagtactttggtcttcagggactgttgatctggctcagttgcactagtctggaatttgctgcaaactgagaagggtggtgggggaaatgtcagaagtttttgtaaaaacaaccaaactcccaccaaacccccatgcgttagcttgtaaataggattcctccccgtccacctttcacattcttgggtttgggcgcactttgtcttgacctgtccctttggctgctgagtttggggtgtgtgtgtgtctctggttcccagactctagagaatgccagcagctggcatatggtgattgctgaataagctgcccgctgacacatgcctcctgcaggcacagagaactggtttgtatgggtgattctgaatcctcattttattattgtttcaaagatgcatttctgtggctatcctgtgccatagagaagagagggaagaagaaagggaatgaatgaatgaatctgattctgtctgttggggcaatggctggggtgagcagatagacattttataccttcataatgattcttttggtcctgttcatcctttcagcaggtatttgttgttgttattactattattattattattttgagatggattctcgccctgtcacccaggctggagcgcagtggcgtgatctcggctcactgcaacctccaccttccaggttcaagcgattctcctgcctcaacgttccgagtagctgggactacaggagtgtgccaccatgcccggctagtttttgtatttttagtagagatggggttttaccatgttggctaggctgttctcaaactcctgacctcaggtgatccacccgcctgggcctcccaaagtgctgggattacaggcgtgagccactgcgctcggcctcagcaggtatttgttatgtgcctaccatatgccaggcatagcatccagtctgagtgagctttcagtaaagtcagtagagaccctggggattagttcagtttttgaagtactgtgtgctaggcactattcttggtactggagacagagcagtgaacaaaacacataaggagctgatatcttaggcagaataaaacaatcagcaagaaataaatatataatgtatcagatggtgataaatgttgtgaagaaaagtaaagtgggataaatggggtagggagtggtgtgtgtctgtgtgtgtgtgttatacatgtggttgtgggaggcctctttggtaggtgacattgaaacagacaactaactgaaggaggtgaaggagtaatctatgatggttatctggaagagaagcattccaggcagaggtgatagcaaatatgaaagctttgggccaggcatggtggctcatgcttgtaatcccagtgccctgggaggctaaggcaggaggattgcttgaacccaggagtttgggaccagcctgggcaacacggtaagacctcgcctctttaaaaaaaaaaaaaaaaagctttgaggcaggaaaggaaagtgttggggaattggagtggagtaagcaaagagagagtagtagatctcatgagagaagtaggggagtgtaggtcttgtaggaccttgtaagccatggtttgggccttgggttttactgaaaaggagctatgaagccacgagtgggttttgaacaaaggactcatatgacctgagtttggttttaaaaccaccctagatgctatatggagaataggccgaaaggcttagggaagaagcagagaaccaatgagatgactgcctcattgcagcgaccatgtgggacagccccctccttggatgggccacagtaagccaaggatgcacctagctgaggagtaaaggggtagccccgccataccccacctctctactgccagtgcactgttgtttgaacagggcacaacattagcagctggcattccacagagtgtaaaggatcggcttcttttaagagtgcggctttcttattcctcctttattttggtgtggaagaaagatggagttgcaaaaatataggaagggaagaggcagagtctcttgattaaaggagaaagcataaaccttgggaaactggcaagcctgaaccttgtcaggagtcacagagagccactccttattccgctccctcctctcccacccttgccagaagtctcagggtaagtaaggttaggggagggaggggcattaatgatcttacaatgcctttgggtatagggtagaatgtcagaactgaagggacttcagaaatcatctagttcaatcccccttccatttacaggtgcagatatggaaaagtgaagtaacttgcccagagtcacatggttagattactggcagagcagggatccttagtgtttactgctttgtctctgttcccaaagactcagtatgtatctgagtgggccttggtatttatagtcccctcaggctctccgtttgtcatgaatgaactctagccatgaccttgggaaattctatttacttggaagtcctgacaagcaaatgatggtatgattttacatttcctttgtctaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattggtaagagcacagcttggatgtgggctttcacgccggcagctgaggcagggcagggacctattcctggttccccaacctggcctcttctccccaggcaagtccatacaatttgtggggttcagaaaagagggcggtgttgtttagcttactaccaggtgctgaggctgctgtttgcccacctaacctggctctccctgatgcgggaacttccatggcctggcactcaacagctgccctcaggcacggagttggtttcttctctgtgttgtttggaaagcaggtaaaaggctttgatgttcctgccaaaggcttggaattacttgggtttagatctttggtggccaatcttggttacagtttgctgaagggaggtctccctacatttgctatgtagatgggggctccagtcagcattgtcagctggctctgcctttggggctccaggatgccagcttacttccctttcttcactctgcctctcaggccccacatcttagctgaggccgactctggtagccaaagtaccagagcagggctgagtcattttgtaggagggagcaccaaagactgagtggaaaagtcaggaaagttggcccacgttacccaggcaactgtgaacctctcaaccaacttcctcatcctctttgacttctcttaggttttcattttggccttcaggctgctaggttaacgattatcaggtctgaggaagccttagcttttgttccattgttggtgttatggccaccactgggggaaagcagaaccaaactcattgtggtggtgtttgcggggctagtgtttgaggccaagtggccattgcctgttttttttccaaagggttcaatgtggagacagtggagtataagaacatcagctttacagtgtgggatgtgggtggccaggacaagattcgacccctctggagacactacttccagaacacccaaggtatgctcaggcctagcgtgggttggttgggtatgagcagagagtgtggctgtctttgttaatgggtggccaactgttaccctgctgcagctcctgggggcagaagaaagggaggaaagggagcaaatatttggagggtgtcaggcaggtgtggtcttttggttggggggagggggttacctgtcatcttagtgcagcccatgctctgccttcctagggttgatatttgtggtcgacagcaatgatcgggagcgagtaaatgaggcccgggaagagctgatgagaatgctggcggaggacgagctccgggatgctgtactccttgtctttgcaaacaaacaggtgagacttcttcccacccctgaatttgggagacagcaaactggctgtggaaattgttggctcttgggcctattatatggttaacccttttagtatgctctcaatgttagaagcgtgggaaactgagcacttggcttctttatgcccctcttcttgtgccccaccccaagctttatttagcaacatttcagtcctcaggaattgtctcaaatctttctttcatcttgcctgttatctactttaggagaattggcctcactcctgctgtcagacagacctgattctttggtcagtctgaatcacgtctcttgcttccccaccatcctcgtatttggtttccaattcttcagtacagtgacctctagtgctttggatcttgagttctaggtgactaaatccaaagtagctccttaggatcttgttctgggtttcctaaaataaaggaggaggggaaggtgctggtacacatttctttggtagatgggtgttctagaagcctttaaaaaatcctgaggcttctttttatgtgtctcccacgtgctccaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccacccctgacatacctactgtcaccctgccccagtcctaccccttcctctccatgcaagtgtggccagggccctgggtatcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttcaggcgtgtggtttttcattgtcaggatgccaagcctcatccagagatcccacaaatgtcttgaggaatagaccttttccataaagcctccatcctcccatcgcactcccaccactattctgttcctcccctgctaccagtgtctggctccaggcaaagaaagggatggtgctacctttagggtgggtgaggtctgggtgagccaggcaagccttccccaatcttaatattttcttaagctttgaggacagaggtcttcccagcctgcttttgtgggaaagggataggatttaggcatataataagtttgagagccccaagtaccagtgtgaagcatataatttatattcagttacttccctgctgcctcccctgccaattttccttttcagcacttctattattaataggccatcaccctcaaggaccagtgcttccacccatatataactctcaaactactccaaccagacatgtcttatcaatcccaatgactttgaacattacccacctactcctcaagatcagatgacactttcctccttccaggcttctccaaagttctgcttggtgacagggtgctgataagagtatctttcccaagtgttttctttcttcttcttcttttttttttttttttttttgagacggaatttggtcttgttgcccaggctggagggcaatggcacgatatcggctcaccacagcctctcctcctgggctcccgggttcaagcaattctcctgcttcagcctcctgaggagctgggattacaggcatgcgccaccacacccggctaattttgtatttttagtagagatgggtttctccatgttagtgagactggtcttgaactcctgacctcaggtgatctgcccacctcagcctcccaaagtgctaggattacaggcgtgagccaccacgcccggccaggtgttttatttctatattagcaaatagatatctttcagagctacaacctctcataatgataagggagaggactttagctgaatggtgggccactggggggtctttggacccctgaacaacttggggaagaggatgacctattcccatctgtcccttagtactcaatttagaatgccaggaaggaagtagaggggagccctcttgtggcagttgctgaagccttccagttcttttgaggggataggggatgaagaggagactgaacctgggaggtagatacttagcacccagctcttaggacaaacagcaatcccatcttccagaacatgcatagcatcagtcatggactggcggaagacttggacccagggtccacttcaggataatctgggcaagggagcttcccaaatgagcctgtagaaagccagtggaagggcttaggttggctaaggtgggatggagggcaaaaccctccccttcattgcagagtataggggcagtggcagagaatgaatgtatgtgt

SEQ ID NO: 16576 - DNA, 12681 bp, Human
agggccttgcccgcggcgcgttgatggaggccgcagctggtgccctctgcagccaaggcgctcagcccgcctggaggggcgcagtctcggctcagcgctgaccgctcggcccaccgaggcgcagctctgaaaatgcaccacagtggcgaagcggcgagtctggataacccgtctccgcccatgctcaggacccacccaatgtccccaggcgctgctctcactccgggagctgccccggcccgggtaggacagacgcgctcgctcgaagccagaggctcccccggctgaggtgcccaggccgctcctccagcccgggaagagcgtgtgcccctggggtctgcgccagacgcagctcaccccttgctccttcagtctcccgggcggagcccgccctcgggccggccagctctcggggccgagcggagctctgggcggcgctcctcctgctcattcccgcgcggctcggcgtccgggaggaaagccgcgggagggcaggtcagcgagcgccgggccgcgggaggcagctttgggcagataaaaagcctctgccgctcttggccctctggctcaggccgagggctgggctcctctgtagagccggtgctgggagacttcctccctacacctcggggtctcttcgggcctcgtgctatttatttgtgccaacatctttttaaattggtttttttctattcctctttagattctttttccttttaaaaattattggcatggatgctttttctcccctccagattatataaacattaaacacacacacgtacacacacacacacgttttcagtagcgattactgtgttgacaccacttccactctgtctccccagatcagcgcttctgacgagcccatttgcacggggactcggccctctcttttcctggcgaggcttttgaacctgtcgccaagccagtacctcagagagaaggaaatgcagagggacgagaaggatgcatggcgcctgcccccagttagatgttcttcagataatctgcaaccaagtgcgctgataaaatatttaataaagagccggtaaacatcactgcaaatacattaaggcatttcagcccgacagcttatgattatttcaaaacttaaaaaggagatcatagattgtcactgtttctgtactcaaccaagaaaccgaaccttcctgaggtgggtggattggtgggtgagttgctgcttttcgccccctctcctccccccttctgcttgtcgctgtggctctcagcagcagggatttatttatttatgtttgcagtttaaaaggtgggggtgggggcgccgaggacatgtaggatctgctcacaaagcaccagctcaggtgttgtgtgcttttgtattagctggaaaagacagactctggaacttttacagggcgagaagaggccaccggctcgcgctttgtatactttgcacttgaaatcgttacattcaactgaatatttggctcattcagatccgaaaagtctcctagcatcgtcgaattccctcctccgcccctccgctctaaaggggggaagggggggaaggtaggaaatgtttagtaaattccacatctttgaatcttcctaaagcagtggtcacagagcttaaaggtgacacaacagtgctcacgtaaaccaacacacattccccaccccccaagccaacaataaaatcatccccttcaatttgccatgatcgtcgctaccaggagccaggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctgggcagtgataactgccaccttcccactccagctcacccgccgctctccctgatttgggttgcacttcttttcttctcccaccaccctttttctaatccagcaaatattcgcctatttgctgcaagtacaagttttgctttgctaactggcgccccgcttcttgcatttaatctttaacatttatgtttcttttttccttgttttctccccccaccccttaatttaaataggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggcaagtccttccaattaacacattttcttgacacttatttaggtgagaatgattaattaaagcctttgtggactggctcgagcgacttttaaaacgatcggccaatgacttctaaaaggaaacgagggggacagggggacagactgagctgcgagaagggggaggattatgcaaaagctattttaatcacccccagttaataggaagaaagaatggcctaaaaaagccccagttaatgggcttcatggtggagtaaggtgtgtgtatgtgtgtgtgtgtgtgtgtgtgtgtgtgtgtgtgtcctacgtggtgaggagctgggactgggcagtgccaggggcatatgtaaacaatgtatttctttctctaggaaatcgggtctatatgcatccggattcccccaacactggggctcactggatgcgccaagaaatctcttttggaaaattaaaacttacgaacaacaaaggagcttcaaataacaatgggcaggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagccggtctgccccagccagccagccgccagccaggcgagtcccgcggtcagttagcctggaaggcgggctgcaggctgcctccgccggcccgggcgcgcagccgggcgcacacagccacgcgcacagcgaccgcgttaacacgccacccggcgctcccctttcttcccgccggacagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgaggtggccaggatttctaaagactcttcttttgggagttttaatttgggctttgaactagaacagattaaaatctactttaaaaaaaaattctctctttcctttagaaaacaagcagatttccccgtgcattttattcttggcaagctttggcatctaaaaaaaaatttctctctctctctctttttttcatctcagaactgatggctgaaatgaacaaacatcactgttctgggagatcaaaagaacatacacattcatatatgtgaaaactacaataaatcaaattactgagggctatggattgagctttctagcacttgaaccacttctgatttttcaagtttgcaaaaacagattttagtggctgatttgactactaggagtgataggggtttttgtgtttgtttcttttttttacttaaatgataatatcagaaattaaaacatgcttttaaatccaacctgattttaagatgcaacttgtggtttctcaggttgtgagtcagaagcgacaaacgttttaaaatataaaatacttaaaatagtcaacatttagtgatgaattcaagttctccttaaagatttttgtctgaacaagtgcattgtgtgtaacaagcatttttaaaatgtgagtttgaacaaatttagaaaacacaggagagctaattgaaagcagttctttggctataggtatcattaatttaaacatgttcctcataactttcatgatactttctctttttttcctttccactcaatccctcaaatttttcagttaggaaaaccttgctatttaataaattgtaggccttaagcccctgtaaaagtggcagatgatatattctcaaacacccagtcttcacgtataaaaggtgagataacattcattttttttctttgccagattacacaactgaaaatagatcacaacccttttgcaaaaggatttcgggataattatgacacgtaagtaactttgtatcttccttttcaaatagctgtggaattgggctttaggtcaaaggtgtattattatgtacaaggattttgaaagctggaatgtgtgaagacaaggttgttttagaggacttcttcttcttcgtctttcttctttcttcttcctcttcttttttttttttttttttttttggttggctccccttctctctggtgaccttgtggcttggtacttgcgtggtttttggtcagaggtttcctccacctaattttaactttcctgtggattacaaagttgttggtgggcctctggggctggctggctggctggggaggctgccctggttctcgggtgcgagtactgtatgtggcgctgcagatgctcagctcagattgtctatgtctgtctgaaacgggcaattctgcctaaaagtgcatgtggctcctctggcagttgttaacagtctccttagcatatgcgacctttatttacccatttccaagttttgtataatagcatttcctgtgcaagttggctacggactgaatacaaatgtgcacccaccacaggcgagttcatgagcagaaccgctgttatggtcattttaggctttcggaaagattcagacggtgttgctgtgtattatttataagcttcaaaagaaaaatatttcctctttgttttgtatctaggtgtgttttaattaaacatgctggtgcccttttctttaggcctcccttacctccctcctttctatcaaaaggctgttctctggggccaacagtaggtgtaaactgaatgctttctgggcttgttctgcaattctcactcagggtccatagtgcctaagagttcagatagtgtcataaatctaaatctggattgtggggttcccccacgttttctgaccataaaaggaaagggtacatacatcttaatttcgtggcttacattgagcgcctgagacagagctaaaaagttgaagctgcctttgactagcatagattaaatgtgtggagaaagagacaagtgactgcctctattccatctccaagcagataccaaccatccctcctgatattttctaataatttaaaagagagtcattgatattactgcctataaccaccatatatattcttcaaaagtactccaaaggaaccaagtctcatcaatatgattccccagaataaaaacttggctactctattcctcacaatctaaaaaggtgtgcccagcacagtggaaagtatatggctcaagagactagagatgttagaggagagtcctgtagattttgagattttaattctgttgtgaacatctgttcaaaagcattttattttgcacaaatcaattcagtaatcccaagtgggtgggacctggataggcatctaaactgtatcttttgcggactgcttttttctttttaaaatattgtggtgataaacagagaagatatttgcaccttgctagttatgttcccttcctgcctccctctacttctcttatttgaaactggaattcaatttcagaagggaaattttgtgcactaaacagaacggacctgagcagccacagcaaaactctcacatgcccctcctcctctggctgccttctgttggaaaagccactcctctttgatcttaaatcactttaaatcttccataaaagcttctttatctatacacacacacacacacacacacacacacacacacaaacctgagatttttaggggacagagaagagttgagtggttcatgacactcttcctttccccttttacgttggttacttggacatggctcaattttggagaaagagggagaagtataagggttcatggggtactaggagcttgcttggccactcaccagggaatctcctccccaaaggattaaggtctgacaagactgaggctctccttcaaaacagtctgttgactaaagattaaaacatttatgtgtgagctaaataaaaagggaggcatgtgtgcatgtgtatgagaaaacacttctaccaatcttcatccaacccttggtttcctctcaattctaatgggattttctaggcccagggcctaaagttaatctttgattattttatctaaggtaattcccaacaacacaatcactgtcgctggttgggcaagttatttaacttccttttgcctcaatttcctcatcggtaaagtgggataataaaagttacctagctcacagtgcctggcatatagtcgagctccgtaaaggttagctattattagtggtccattgcatggagtaggctgataagtacactgtaggtttgccccgaagtttctgcgggtaacggaccaaaagctaggaaaagaaggtcagagtaaagaacaccttttctcttaagagaatatttctgattgatgactactgtttcagagtagtaattcttgtttgtattagtagaggtgggagtgaaagtttcacacaggggaaacaatagacactaagtactttggaggcttccagcagcaaacctcgggttccagaacacgggtgaaggccagtctttcatgattactgcgtgcgcggctttttcctaggggtttctgaaacaatctagaaaaaggagagatatcacctgaacaatcaaatggacacaggaggtcttaaaagggtggaggagtgagtaccttgcttagaaatttcactcataaactgaccgcagaggaaaggcccactgggcaaagagcatcttactccctaggtaaatctgccttaatgtgcacacatatgttggagaagtgggatgaaagtccttgcttgtgcccctctctcagtaccccagtacacttgacgagagagagcaagagaagagggaagtcgttcccttgatggtctgtatcttgctcaggtccctgcatagacagattggctcctctataattccgtgatttattttgggaatgatagaggtctgtggcctcttgtattctccaggaaatcctggactgcaagtttgtagatggagggtgtgggggtgggcgaaaagtggaggtggccttcccttctgcccccacccccaccccaagggacctccgcgccacccctcggctctctctctctctctccctaccccgcaggatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcgacatcagcaatattattttgccttatttgtttttccccaaagtgccaaatccattactggtctgtgcaggtgccaaatatgctgacaaactgtttctgaatatctttcagtaccccttcacctttatatgctgtaaatctttgtaatgaatactctattaatgatatagatgactgaattgttggtaactatagtgtagtctagtgaagatgaattgtgtgagttgtatattttactgcattttagttttgaaaatgacttccccaccacctagaaacagctgaaatttgacttccttgggagaacactagcattaatgcaagtaagactgattttcccctaagtcttgttatatttgataaggagcattaatccccctggaaatagattagtaggatttctaatgttgtgtagcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaaacgttttgttttttgctcgtttgtatcgtctgtgtataacaagtaaaataaacctggtaaaaacgctaactatggtgtttgaaagcagtttacagtttgaaaataatttaattattataggtgatgatatttaagggttaaggaagactagcccgtccccactccaatatgggcagcctgtttaatggaagccacctcccattccccccttaaatttgttttatagtacttccaggagctacttttttcttcttatttataattatttagctacctatgagccaagtctcacttttctgcgctcattttcttttttcaggaaaacatatgcacttttctcatcatatttatctgattctctctgaagttggaaataatgcgaacaggaaaaggaggttctttaaataaggagttaagaatttctttaaatttcacagagtaaggcgggaggcgttggccaaaagtagggtgtaatttaaatgcatgtcaaaataggatgttgaccgcagatttagtaaattctggttgtacatacgaggccttggaggtgagtggcgaatctgtaaacgcagacacagaacagcctacatttcttgagtggatggtttccgaagactgggcaggggtagggtggcgaaagacacgtagaacaaactcgcgaaagggtcgttttttaaccactgagcttaaaactgcttctgggaggcatctgggctgggggtaggggcactgctctatcccttctgtagtggaatcttatgccagtcctatccctgccagattcacacctggggaacaaatgcagaaatgcgaaatcccaacctggagggcgctgcgtctagtgaagtccgcagaactctttacctcgtggagaagcgatttttgtacttttgtctccaaagagaggtgatccaggcaagaggcggaaaatggttccacattcttgcttagtctgggccagcctcaggttacaggactaaatttacctttacatagacattgtcctgtgtcctttctgcagtttgacagatgtaaggaggcctcaaatttctaattaaaatgaaaattcgtgggaggataaaactaacttgccttccctggacaattccgccactagacggcgttccgtggagttttgtctgccacataaaaaagcgaggactgaatttcctttgtgtttctttcccctcctcacatctaagaactaagtaagaggacaaaagtacaagacacggtgcatgtgtggcgagtgaagtggagc

SEQ ID NO: 16577 - DNA, 10421 bp, Human
ggaaaatttctaagggcagttctgggtatttgagcttctataaccatccatgcctacttaagcaagatgttattctttctttccgaactttgaggtgcatagtggttagaaaagtctagaactccaccactaaatccattcatttatacatgcatgcatttactcatgcattcagtgaatatttattgagtacctactatgagctagatactaaattggaggctgcacttgttcactgtaataaagtctagcacccacttgaacttgctatggctcctgcttcaggtcttgctactgagaagcactgtgaatgctggatcctctaccctgcctggttcctggttcccaaggtgctgactccagacccagagttcactgggtctcttggcggcctcagtgccttgtattatcttcttccccacctccaagctccttggtggccccagacaccactagcttggcccacctgcttcctgctgtggacccctagctgggagtctgttttcccctcacccactatgactcctgactccagcaggcagttacttataagaaagaggcatctggcagctgcactggggagaatgacctcatagcactataattaaagtgatcatctgagtggaaatgactattatgaagcatccttctctgttttattatgtagagccattgtaatgggaatacgggatttcctatgttaatgctgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctgcaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaattggttcccaaggtggcagtgatgggaggtgggacctagtgggggatagttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagcagtatgaggccctcaccagatgcagctgcccaatttggacttcccagccactagaactgtgagccaaacaaacctctcttctttacaaattacccaagtattcagctatagcaactcaaattggactgagacacctggtgtgagcatcagacactccacaaacattctttcttaaacacaacaagagtccctgccttcatacacagcacagatatctgttgagcatctaccacatgcaggcaccactctcagtggaggcatactgcagagaacttaaatgggcctggagtgacctggtggttcaggttcaaacagttccatcccagtcagtgaccaagcagaacctggttcctggtctgtgcacccctgctaggagtcggtgggtgcaccacactgtctctgtccacttgaacccattctcagagctgctcacacctgagcaaaggatgcagcttgggccaaggtgctgctaggcatggagagtcttcctctctgacctcagattcttgtcctctgttcacagagcctgatccggggatggcctctgcctccaccacaatgcatactaccaccattgcaggtgagttctcatcacagagcctcaccataatggaaactgccgtgacttcagatgagctctcatcacagagccctttaagcagccagggttgggggacttggtgaaaacatccaggggagaactgacctaaggacttggacaggggtggctgtggccattttttctctccctcagaggtggttttgaatgtggaatggaggagtctacccctgggtaaataaatatacataggtatgtcatatgtatctgtatttatatttattggcctttctcagggctgttgactcacaggaactcaggagctggagaggcagcagttttggtgagggaggttgagggtggaggtgagatgagggtagactgaccaggctacttagacttctccaccgtctccctcatcccacattattttcttccctgggtccatgacccccaaccctccatcctcaaggaaacttgagcctgcctttgccttgctttgaaccctgagcaacgggctccccatgggtcatggctgtgactgcaaattgtgtttgaagaacaaccaagtttgggaggtgctgtgtgctctgcgaccttctttgagatccacacttctcagcagcttattaataactcaggaaacatcgagaaggtgaggagagagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacagaggcttgctctgcagcttcaaagtaaatgcccaaactcaaaacacccccaccccatgagactgctgccccctcactctcaaggtcctgagtgatctgacccctcctgagcagccttacactgtacttccccacccctctggagtcccagcagaagtgaggggtgactgcccctcgcacagccaacaccttggcattctctgcgttaccctctcccacttcagtcctttgtgtggccaagtcctgctcctcctgcagactcaccccagtcctcaatcgccaggagggaatgggagcagggtaggctgaggagcagtcatcgggccattgaaaaacacaaaccacacaacctgccccaagcacagttaatagcctcatttttccccctgtatagtgtacatacagcaaccagctctgccctgttttctgggacttccctggttttagaatgaataatctccaagcagtgttcttgcaactgttgcaaggaccatgttaaattgctttaaatgttgagacctgcacctggcacctagtaagcgattgttagttgttttaaaggaagaggaaataacagtctcttctaacgctgattgtgttggacaaactgtcctaataaatgctgtcttcacctggaaaatttctgagggcagttctgggtatttgagcttctataaccatccatgcctacttaagcaaggtgttattctttctttctgaactttgaggtgcttgttgattggaaaagtctagaaccccaccactaaatccattcatttatatatgcatgcatttactcatgcattcagtgaatatttattgagtacctactatgtgctagatactaaactggaggctgcacttgttcactctatataataaagtctagcacccacttgaacttgctacggcccttgcttcaggtcttgctactgagaaacaccgtgaatgctggatcctataccctgcctggttcctggctcccgagacccagatcctgagccagtgttcactgggtccctgggctgcctcagtgccttgtattatcttcttccccacctccaagctccttggtggccccagacacccctagcttggcccatctgtgtcctgctgtggacccctagctgggagtctgttttcccctcacccattatgactcctgactccagcaggcagttacttataagaaagaggcatctggcagctgcactggggagaatgacctcatagcactataattaaagtgattatctgagtggaaatgactattatgaagcatccttctctgttttattatgtagagccattgtaatgggaacatgggatttcctatgttaacactgatatttctgtgatccaataaatccttcttcacaatcatctcccagaggaaagaaggcattctgtgcagcagctctaggaaacatcaggtccccaatgtcctagacatcctaccctctttggccaggccattaagctgtgaaaaaacacactcagtaacttggataatgtcatagagtggtccttcccacagcagagtcaatgtaaagacctatgggagggcttcaggaatgactcctcagacaggagccctgggaagggcttctccaagagagaaagtgcactccagaggcaagagcactggccaagtcctgacctgatatcggatgagctgtgtgatcatgggcacatcacgtctctgagccttggtgttcttcctgtgagatgggccaataacaccaggcacctcataggatggatgtgaagactgcatgatagagtagatagaaggcagttaaagcaacacctggtgctatggtttggatgtggtttgaccctgcaaaagctcatgttgaaatctgattcccaaggtggcagtgatgggaggtgggacctagtgggagatatttgagtcacaggggcagatccctcatgcatacattaatacccccttgagggagggagggagttctagctgtcgtgagactggattagtcactggagagcaggttgttataaaagcaaattcagctttctaaactctcttgctttctatatcaccttgtggtctctttgcgaatgtcagatccccttctgctttttgccatgagtgggagtagtatgaggccctcaccagatgcagctgcccaatttggacttcccagccactagaactgtgagccaaataaacctctcttctttataaattacccaagtattcagctatagcaacacaaaatggactgagacacctggtgtgagcatcagacactccacaaacattctttcttaaacacaacaagagtccctgccttcatacacagcacagatatctgttgagcatctaccacgtgcagcaccactctcagtgcaggcattaggcagataactcaaatgggcctggagtgacctggtggttcaggttcaaacagttccatcccagtcagtgaccaagcagaacctggttcctggtctgtgcatccctgctaggagcagtgggtgcgccgcactgctcctttccacttggacccattctcagagctgctcacacctgagcaaaggatgcagcttgggccaaggtgctgctaggcatggagaatcttcctctctgacctcagattcttgtcctctgttcacagagcctgatccagggatgtctggatggccggatggcagaatggagacctccacccccaccataatggacattgtcgtcattgcaggtgagctctcatcacagagcccttcaagcagccagggtggggggccttggtgaaaacatccaggggagaactgacctaaggacttgggcagtggtggctgtggccattttttctctccctcagaggtggttttgaatgtggaatggaggagtctagccctgggtaaatatatatatacatgcatacatcgtacgtatctatgtatgtatttattggcctttctcagggcttttgactcacaggaactcaggagctggagaggcagcagttttggtgaaggaggttgagggtggaggtgagatgagggtagactgaccaggctacttagacttctccaccatctccctcatcccacattattttctgccctgggtccatgaccctcaaccctccatcctcaaggaaacttgatcctgcctttgccttgctttgaaccctgggcaaggggctccccatgggtcatggctgtgactgcaaactgtgtttgaagaacaaccaagtttgggaggtgctgtgtgctctgcgaccttctttgagatccacacttctcagcagcttattaataactcaggaaacatctacaatttgaaaagaaagaaaaagcagcagaagcaagcaatcaaagacacctgttggactctgtgtaacctggcattctccaactcattgcaccactgagcttttattcttcctaggtgatattattaacattatgcagatacaagtgttcccctgaaggcagtaggaagtttaggaaattgttctataaaggtgggacttgggagcagtttcagactttccatattcttcagcagtccctccccaaggcctccaaataaacctgcattctaagaaaagacaggcttgctctgcagcttcaaagtaaatgcccaaactcaaaacacccccaccccatgagactgctgccccctcactttcaaggtcctgagtgatctgacccctcctgagcagcttcacactgtacttccccacccctctggagtcccagcagaagtgaggggtgaccgcccctcgcacagccaccaccttggcatcctctgcattaccctctcccacttcagtcctttgtgtggccaagtcctgctcctccagcagattcgccccgtcctcagtccccaggagggaatgggagcagggtagggtgaggagcagccatcaggccattgaaaaacacaaaccacacaaccttccccaagcacagttaatagcctcatcttttttccccctgtatagtgtacatagagcaaccagctctgccctgttttctgggactttcctggttttagaacggaaaatctccaaacaaggttcagtcctggggtatgattctaacgtgtctgcagagtgcttagagtggttagtagcagaactgtgaggaagaaaaagaaaagggagggaaggaaggagaggagggaagaggaaaggagaatcattttaggaaggcacaggttacagtgccaccacacaacaggttggtgaagcatggggaaggaatgaactggcctgtttggtgttggtacagttgtctccagtgtacacggttcaacttatgagttcttgagtttggaatggcgtgaatgcaaaagcattcagtagaaacggtactttgaattttgaactttgaccatttcccaggctggcaatatatagtatgatacactatattataaaatagtctctgggtcagatgattttgcatgactttaggttaatgttaagtgttctgagcctgcttaaggtaggctaggccaagcttcgatgctcagtaggtttggagtattaaatgcatttttcatttacagtatttttaacttattatgggcttacaggaacctggctcccatcataaatcaaggagcatctcttttggttgtggcattgtatctgtcctcacacaacccctgtgggtcttgaccaccatcccaggccccagagcccctgcctcagactgacccttgcacctcttcccacctgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggcgaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcattccgagtccaacagtattactgtagttatctggggaaagataaacgccacccagggcttgcttttcacctgtgcaatattatattctctgacggggccaggacagttcatttctggctcttgtgggggccagttcccagagagcacagccagtacaggcggctcccaagcctgccaagggaggaaggacaagtgaccagctttcctttccctacaggggcaccagctgcaggaaacaaaaggaagggtgaaatgtccctctagaaatagccgttcccagtggccagggcactagctgaagtgttgattttccaaggtgcagtattagaacaaatggacctgatccaaaaatatgagtgagtcttgtccttccaatcacagtgaccgtggcacccaggggtggaagcagaggctgcagagctccgctcgatggctttgggtcccagctcccctttcctggtcccaggaccttgaacaacttgtttgacccctctggcccccgtgttctcctccctcacgtacaaatgatgctgataatgacacctctgttgtgcctgactcccagcgttgagggtcaagtgctcagacctccctgtcttccagtgtcagcaactgtgtgcagcggtaaacaaacattcttcattgcactacttctgcacacttcctgaggagtagctgtcactcaaaatcacagagtaacaggaagagaagatgaactggttaaccatccccttccaggcgagtttttccaagattcccaacagctcagctgtcactccaaggaccagcagctatgaggttaaagactgcacgccaggtgctggggtcacctaggtactccctggggctcaggattcttgaggctgcaccatctccacttgggagttggcagaaaggtcccaaagatctccctgggaggattacggggaatgtgagctcagtggggggtccacctgtcagaggagctggcaatcctggggccgtggtgggggagatgagctgggagctcacagaagcagtgatggcagaagcctggtccaaaagtgagaccttttcctggtgacccgagctcgcaggccttcatctatgaaataaagggcttggctgtatctgcatggcccacactgatcttcagaacaccagtgtggcaaaaatggcgataaataggcccaatgaatatgcacaagtcagtttagaaaatgatgtatcatgtaaagtgaaagcagtgcaggctcctcagcgtcttcactggcccagtgtggatgctgacactggtgggaggggagctgtgcacatagcctttcccaagcatgttgaaccagagaccccatttgctcacacgatacctgctaggaactcgtggaccaagtggtcctcggagcacattttggaaacactcaggtaaatggtttctaacatcccctcctgtggcaatgccatttcaggtttttgagcacccacatcttccaggtttgggagcacagatcactgtccagtgagcacagaggaggcaccagaacctacacatagacactcattggggtgaaaaggctccagaagaggatgagcccagggctctcgaggcctcctagagagcaggtgcctatgtgggggaaggatgatggtaactcattcctttctccctcattgggcccaggggctgtctatactaagcttgactccctggccactcacctccccttcctcacctccctttatcctcactcttttgcctgcctagtgtcctggaaaacaattgaaacacagtctgctcccagtctactgggtccccagacccagccagaatcaggctcagcagcagtagtgatgacatggaagctgcagagctggtttgtcccaggtggcctagctcagatgccacgaggagggaactgttgcaggctaactgcagaggccagatggccacaccagagagcagggcaacttaaagagataatgcacacacacacacagagtgcacactggtggacacttgtggg

SEQ ID NO: 16578 - DNA, 10421 bp, Human; identical to SEQ ID NO: 16577

SEQ ID NO: 16579 - DNA, 63319 bp, Human
aagcccagactgtgtaggttttgcttttgtgactcacaaatcgggcatgagtttataataattttgacagatgcttttcactcatgcagcgcttggtgcttttgagggcattggtgcaggaaggcttgatgcagaatctctgcttatcatttgctgtctgtgtgacctacatcagcggcgcctcagtctgtcttcctgcagaataagaatacagtcagccctctgcatctgtgggttgggcatccatggatccaaccaactgtggactgaaaatatttggaaaaatacaataaaaagtaagactacaacaataaaataatataaataaaaaacaaggccgggcacggtggctcacacctataatcccagcactttgggaggccaaggcgggaggatcacgaggtcaggagatggagaccatcttggccaacatggtgaaactccgtctctactaaaaatacaaaaattagctgggcatggtggcacgtgcctgtagtcccagctgctcggggggctgaggcaggagaatcacttgaacccgggaggcagaggttgcagtgagcccagattgcgccactgcaccccagactggcgacagagtgagactctgtctaaaaataaataaataaataaataaaaaatacagcgttaacaactatttacatagtatttaaattgtattagctattacaagaatctagagataatttaaagtattttggaggatttgtgtacgctatatgcagatactgtgtcaattcatatgagggacttgagcatccctggattttggtatccacggatgtgctggaaccagtcccctgggggataccgagggacatcatgataataggcccggaagaggacagacgaacacactgggccatggggcagcactgagcggtggtggaagaaccccgagtagccggagaaagagcaggagggccttccagggaagagggaatggcctgtgtgaacccaggctgaacctctcattcctgggactcgatttctccatttgtacaaactgcttggtttgtggtctgcaagagcccttcctgttcctccaggaagcctctcagggacctctgtccctggccagctctgctcctctgaccgctgcgggtcctgcaggccatagccctggctcctgtgtgtgcaccagacacgtctaggcctcttcagcgggacctatctctctgctcaactcaatcaacagttctttagaaatttccaggggcagcaaagtgctgtagcccctgacatgttttagggctgaatgggggtgggtatcagcagactcaatacgtatttattaacttaaaagaagtgtcattggtctattggcaaagctggttagcaataaccttatcttctccaggaataatgatcactaatcattccttcctgctgggggtaggagacaacccggcgtatggtggtggagcacctgggagacagaggcagagatctcgttcctcgatcccggcgcgttggttgtaaagtaggaacagtaatagcacctacctctagggccacggagaccgaatgaaataatgcctgtcaagtcacttagtacacagtaagcactcagtaatgctaggttgttgttattataataaatttttagcgaacgggaagaccaagcaccggttggtactgggctaggcgccgtaggcaaagatgtggagatgtcccggaggcgcctagggtatccgggcgaaaacccgagggccgaaggctgggaggaggcggagcgtcgggcaccgggcaccgggcaccgggcgggaggtgagcccctggaaaaggagggggctccgggcgcgttctcccagcagccgcggctcctctgttcagggccgcgcccccttcgccgcactttctctttgatttcgaaagcactcctctcctccacctagtctcctttcctgggttgcaggagattactgcttgcggggaagaccaagacgccaggccggcggattagtccccgccccggggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgcccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggtgagcgagccggagccccagcagccgcggagtcccagccgccgcggagccccggccacctgtccccctatcctccgaccccggggcctggtccttcgccaggatctggtgctgtcacctctagaggagcgctttcgaggggcttcgaggtccccaggctgcgttccccggcgctctgggtgccctcttaggtttgcgtcctctgtctccccacacccggccggggcaggacagggccccgctttgcaccttcgtggctcggctgcacagcagtggccggccctgctccaggctcttctcaggcgcgcgctccaggctaccccgctttggaggccaagggccgggaggctgggaggccaggtggtgaccctcagctctccaggcccatgcaggcaacctaggctgggccggcgctcggggcgagagggagtatgtccctctgcccctggggacactattcccccggactcccaaggctgcttctcgaaccggcacccacagttccttccttcccactgcttctccactttcgttctccgtgggccgaaggagggattgggtttcctttcccgagaggtgcctgcggcctggaagctcccgcccagcccggccccaccgggagcccagggctacgcaccccgcaaggaggtgccctcgccccagcaggggcttagcgtttccggcggccggggagcgggtggcggcactggctttgggagcccacggccgggtggggagctggcctggaggaggcgcgtggaaggcgccacaggaaacccgacccctcctcgcggagagctggaatgggggatggagccggggcctcccagggtgcccagagcgtgcaggaaatgcagagattgaggggcgggggtctgcacccggtcagttgtctatcccaagccacctctggtttattgaattggatcacgccagctgctgacgccacttcccctgacgactccaactctgaaatctgagattgcagaatctgtgtttctgccagggtggccccccagtgccccgcggccaggcctgccccctctcccacccgctgcgcggccgccgggtggaggcgcagggacaggccggccttcccctgccaggcctggtggctgtttataaacaatgacttttgcttctgagacccgcgggctccctaaggatgcaaccacgtgattgctgggggatgggggagaggggggcgcctagagcttccccatacctccctcagagtcctactgctcatccctgtgtttcctggctaaggaggtgggtgggtgtgcattgaaggaagggccctcagccaagtccaggtttgcccagacccagctccccaaccccccaccccagggaaggaggaggaggaggaggaggaggaggaggaggagggattaaagccccaggaatagctggctgggggctgggaagacttcaggttgtggggtgggggggtggcagcacagatgcagccacccctgctccgggctgccatgactgggtaatccatctgtgtgcctggagcaggcagccctgggccagagcctgcttccttccctaaagggccagggagatgaatgggaagggaggttagctgagctgtgttccctgcccccttcccactggtgtcccaccccttcctggctccccaaggctcttggtgtgtctcctttgccctggttgtcttttctctgcagcagcatctttgatgtcattctcggggcagtaggcaagggctgtgtcccctccaaggaggtggtgatgtatcactgagctcctgagacaccatccctctctcttgagcccctgttctgtggccacgggcagttggctgacagttggtcagctaggcatgctggtcttggccaacagctgaccttgcccatgccgggcttcctgggactggagttgtttagtgttccagctgctctctgcctgccggagactagttagggaccctccccccatcagaaaccaaggcagcatgaccatcatgacaggcatccaggccaggtctctgaaagtagccttcccctccctttgggttgcaggccctgctcgcaggaagccccatgcctcaacccacagcagcctctgctgtgtgccttcctgtagagtctgtgccatcattggagggtcatcctcagtgtcttctgttggtgatcagtgccgcctctaactcccactgtcaatgaaactggaatcctagtctcttacaggcagccccaccactatacctaccttgccttggtgaaatcagtgggtaatagggcaattccagtttccctgtggctacaggaaggcgtttcctgagcaaggatggcaggagctgtgctgggaggctgggagagtcctggcgtcctggcgtaggaagaagggcccgtatcttgcatccacccttcacccccggccttcccacatccacttccagcccaaacaaacatccagactgtgagggtgacagtgtggtcaagggcagcctgcactcttgtagggtccccaagccagctcttttttgactgttgttacctgttgacccttctgcctccaccactggtctggctgatccctgagggcacggcagggcacatccaggtgtgtgcattgaggatgttacctggccccagtcggtgcttagtgaatgtttttgaacaagggatttgggcctgacgcaggctgatggtggattgatttgtgttgtttgttctctgccatcactcattcatcaaatcctgcctggacacaggcccagtgcctcctgggctgagtccccgatgctgtctcaggcagggtgcatgtgtctggcctgtctggagctttttcttgaaggtcccatggcctgtggccttggtgtgaggagggtatgagaataaattggaagggttgccagggcctccagcatggcaccattgctcctggccccctggccactgcccccggaatgcgtggggtgcactgtgtgtgctgggagcttgagcctgtgggcgccgtgaggtcatcttcccattgcgtttggcttgtcgaaccctctataaatgattgtgtccatttttgggcctcagaagagtggctaggcaaagccagtgtagggtggagcctgggtcagatgacggggaggattagaggttggcaggctgggcccctcgcgggatggggcgcctggggagaaggacagctgagggggtggggatctggcctgctggcccctgaaggcccacggcttgggagtcctcatggagccggcctgacggagctgggcctttctctgaccacgctgggctgacagtgagcacaggaggaaggctctggcagggtgggagtgtgcatgctgtccctccctcccggcaggtcctgagcatgctggaggggtgcaggctggatagtggggagggccagctgggcagagggagggcccagggttgtcagtgcccagcacagcgctgacatgccgagaagaggctcgctaaaggaaggtgcagtggtggcgattcctagagccttgatgcatggccatgaattgcactatgctcagctgcgtggtcaaggtctcctcacgcagtagccaccttagcctcctccggaggagccaggcctgtacaccaagcgttatatttgcagcaacctcagaagcagcaatgctacacctgagagtgggtgcatggtccctgtaatagaaaggacaatgggggcataggcaggcccagccacctgcccaagtcacccaggccctcagtgatggcactgggagcccacccagaggccctggtctcctcaccttggccactgactttgcaggggtcccgcccccttcccaggccctagcacaaagatgcccccctctacccacattcccatctctgtccatcttggggcccatctctgtccttctgtccttgaatgtctgaggttcttccctgccggctactgtcttgtctttttctctgtctctgtctgtacctccctgctctgggcctcttccctctgaacctgttcaggctcttcctgtatctctccagtctcagcttcccctggacccgagttacttatgtagatggttcatctcaccctgcagggaaggcttctgagctgggcatcttctgtgggtgggcccaggtgtgtgtgggttcttgggtgttcggtaaaggcgtgtgggcatgggaggttggaagcatggcttccagacttccccaatcccccaggggccctggatggcctgagtacagccttctggctcatgcagggaccaagccaggcacaggctacttgtccaggcacagcctacttgggaggctgcatggggcatggggaaggagaaggcattccaggaggtgcaggcatggtccaaggtgtggagagaggtgtgaggacattgaggatgccagctctctgaagagaaggggtgcctgggtggtagattccctccatatttcatgaagttgtgaaggccaggaagatctatggatcgcaaggattcttggagaagctgaggcttgaactctctgcgccctcttcaagatcaccacatcggggctcccttctcactggcatctgaccaggtccttgtccctggactcagcgtccagcccagctggtcccttacaagctgtgtgactgtccctgaggttctagaatccctgagtcctacccttggaggtaggccctctgtcctcatatctctgtaaggaacagcatgcacaggcgtgcacaggctctgggtttccctgacatgctgcggacccttcctgagccctgtttcttcatgtatcaaatagggaataagaacagttcctcttcacacatgtgttgtgggaagtaaagccccaggcaggtgcttggggcatagcaagtgctcattgaatgccagctctgtggcagagcggcaccttgagcccacatgtggcaccttcttcctgcatggccccgcttcctagcccctgtccccagagtgtccattacaggcctctatagacagctaatccctcctgagcctggggttgatcaggcttatgacgttcacagacccggggcagtgagtgtatgtgcatgcatgtgtgtgggtgcagtgtacaggggtggagggtttgggcttgggaatcagagagctttagagtgaatcttgactactcccaccataaactataagtttttttctgtctctgggcttaacttttcaccactggcatatgatgaagtttgtgtgttcattcctttattcatgcaacaaatattgagcaccaccatatactgggcactgttctagggagtggggacccaggagtcagcagaaccaagcccctgctctcctggagctgacattctcaccaggggagatggtgaagaaaccaccaagtatagtggcaggtgcttagaggggtggtgaggcagggactcacctgccctcaggactttctgcatgtgtcccgtgcgggaggagtgtgctaggttgaggattgagatgtggacgtgactgtgggagctcacacagcaagtggattgggtggagagagtcaggtgggcagctcccgtcccaggtgaggggcacccacgggaggatggcttccttttggatgccaccctggtttgttgtgttttcctaaagctgcctgtttggcaagcctccttttaggattaagagtgcagatgtgcagcctcgctgggtgtttgtgcagggcaggtgggcaggggtacctgtccaggatggaggatgggggaggcaggaggggctgctaaaggagaggaggagggtgtcaaagatggcctctgctgcccagggccacttgtaagattctcatgccaggcagcaactctgggtgcggtagaaagctctagacagctgagtttgagtctatccccaccccccgcacattcctacccttgggcaagtctcactgaattcttggaatcccggtttcctcatctgaaacaggggtcatgatctctgccgctggggctgtggtgaagacgaaatcgaaatgtgctggagaggctgcccactcaggtggggctccaggttctgctcctgcggagaccactggagggactcagcctactgctgttcttgtgctgtggaagaggcccagcacccgggcttctgagaggctgccacctcctaaagaggccgcagggttgtggacctgccaagggctgacaggggtcagggctggggagccgaggagagaaaggcaggctcttcctgctacagggaagcccttgtcaaatattaacttaaacataatggcattgtttcctgcatactggctgcatgccatcatcactgtggacaggtgagagtattatacgtcccatccacaaaggaagaaactgaagctggagtggttgtgtgactccccagtgggccgtctgggcttctacctcccttgtggtcagtaggatcagtagtggggtctggcctggggcaaggccttggagacaagcaaatgagatggaggcgtccagcggactccctgcataaagccctgatggtgaaggggtgtcattgtgacagactttggtccccaagaccctcccaagacttggggcccctgtcggacccccagctccacctggggtctaggcttgcactttggagtgtgtggtagactctggggtgatgggaacacctggggtttctaggtgcaagtccagagatgggggttcatgcacgcaaatgaggacagacaggaccctgtgctgtgtgttttttcccaaatagtaaaagttgtctccagtttattccagtctaaaagaacactcttggccgggtgcggtggctcatgcctgtaatccccagcactttgggaggccgagacgggtggatcccctgaagtcagcagttctagaccacagctggccaacatggtgaaaccccgtctctactaaaaatacaaaaattagcctggcgtggtggcggcgcttgtaatcccagctactcgggaggctgaggcagtagaatcgcttgaacctgcaaggcggaggttgcagtgagctgagatcacaccactgcactccggcctgggcgacagagcgagactccgtctcaaaaaaaaaaggccaggcgcagtggctcacgcctgtaaccccagcactttgggaggccgaggcgggcggatcacgaggtcaagagatcgagaccatcctggccaacatggtgaacccccgtctctactaaaaatacaaaaattagctgggtgtagtggcatgcgcctgtaatcccagctacttgggaggctgaggcaggagaatcgcttgaacccgggaggcggcggttgcagtgagcccagatcgtgtcactgcactccagcctggtgacagagtgagactctgtctcaacaaataaataaataagtaaataaaaataaagtttacgtccctctaattttgtttctgttactgctacagtatttctttaatgagatgatggtcatactagttgttttttaatgttcctgggggggaaagaaccatgctgccgacactgcccccgctaccacacacacacacacacacacatgcaccctgggaagacttcctggggggaatcccatactctgggcactttgctttgcttcctgacccaggcaggcccatgtgtctctggtccctgtggtcaccaaggcatctcatcccctcagcttggctcacagtaggtgcatacttgttgcacatgtggctgcatggattctttaggcagtggggagacagcactgatggctggcagaggccctggaggctccctgggtttgagggtgcagggtgggagcgggagggatgctgtgtctgcaggatttaggttggggctaggctagtgggtgcagatcccaccctgccccggccaccctggagggacccaggatcgctcctcatcacactcccccgtgataaagcagccgtggtcagctgctcagggctgtggtggggcctaacctgagctggtggctgtaatgcttggtgcccacaaatggggttcttgtgattggcccaggcccagccgaggagtcctgcctgattttaggccagatgccaaatagggcttggcctcggtcctctgcaggggcctgtcctataagagaaagctttcaggtgacagcagtactgggcagtgctggctgggggttcagtgtgatttgctggacccagacatcactgtgagagctgctgcccttggacacattttgctggctttttgcaaagcctcttccctctgcttcccgggcctgcaccttcggcccccgttgtgacctagatcccaagtgcgacagcaggtggggtgggattggggtcacagcaacagcatggggcgtgggggtggggtggttgggccttggagcctggggccacagtggccttggggcactgaggactgtcctgtggtgcccctgggagtgggcattcatgactccatactatgcccagcccccactgctgcctccagtctgcagacatctcccctctgctgtgtgaaggccgcagtgtctggtggctgagcccggattgttacggggagtgagtgggtggctgcagcagccgccacaggactgggttgggggcgggggaaggatttatcactaccagggtctgtggagctcaggccttccgttccctgcaggcctccccatcctcagagcccctggggcatccccgctggctcctgaaatatggtccttgttttgtgggtcaacttcttactctgaatgaagtcccccgaggagcctgcagatcacctgggtagaggcagcgatggcttcgcatttacaccctaagtcattctgtcatctgtgacctgcccactgtgggtgcctgctctcaggagctcccagccttgcacacagcactcatcccaggactgtgggttggggagggcactggagcctgaggggctttccctcaggccccagcagtcagggaagcctcctcagaacctgagccaagttcagagggcaaaggaggcaggtggtagtgtggggagagatgcttggatggcagcgggaacagtgcttgtcagggcccattcagggcctgagtttgaggagatgggcagaggctgggcctgggctgtagcccggggcccttgggtgaggcgggccctgccctgggctcttcagcttccctccccacgtgttgcctgaacctttcttctgtctcctggtctggcctcagccaaggactgtatcttaattgtcctgggttgcgggtgaggggatgagcctggagtctccagaaggagtggcctgggccagattagaatccagccatgcccagggtctggggcagggcttgggcctggagtccacccctgttagggctggggacacaggggccaggtgacacctgtcgctggaagggcaggtggaaaacatcctgtacctgccctgtcccatgcatgcctgcttctccacctgctgcacagcccagggtgacaccaggagggctgacgctgctgggcctggaggggtgacgctgctgggcctggagggctgacgctgctgggcctggaggagtgacgctgctgggcctggaggggtgacgctcctgggcctggagggatgacactgctgggcctggagggctgacgctgctgggcctggagagctggcggctgggaggtctatcagtggatccgctcaccctttttagggcgcccctgtatgcacggccctgtgtggccaggccgttgactgggatggccataggggtccttttgttgcagagctgggtcagagctagggaggggcctcagaggagtggtcctgccagctgtggggacccctggctccaggacagacccccgagtggggagtgggcacggtaacgtgaataatgcctcagtctctgttgtgtggatggagatgggggcagtgtctggcagcgaggggtttccaccaggcctgtggctggagaagctttgttggaaccacagggctggcaggagtgggtgccaggagagcctttgccagcccagcccttttttccaacagctgctgctactttctttggacctttgctcagctcaccatctctctggggctgaggccaagatgcctgagtccagggcaagcaggggcccttctggcacagagaggcctgggtgggaaagaccccttgagggtctttggcctcctatccatttggcccatggcagctccccttttttctctggcctgaagtggtatgagctgtctaattatgtgtcaggggccagatgcaggtgatggggtggatggagctcggagctggaccctgggaccacaggcagatgggcaaagggaggggagacaccgaatgagagaaaggggaagaggaaagttaggacatagggaggaaggaattcatccccttggggctgctcccccgctgtgtggcgctgggcaagtcacttgcctatggcttgttggagggtctgggaggatgtgtgagggaagcacgcagctctgccctccctggtgggtgatgcaaacgctctttcccagggagcatctcatgacagcccacgggcgtcattctggctttcgtgttttgagtttgttgtctgtgcttatgacaggtttcttgaaagtgaacttcagtgagcttccctgccattctctccccaccacctgtagaggctgaaaaagctaaattgggagctgatggtctcaccttcccaggacagaagtcagctctcctttgacttagaccctgatagaatggggaggagagggcgaaagattgcaggtggggccgaggctggagggggccagatgaggggcacagggctgggggtggaggtgagggtctggcatcatttattcattcactcacttgctcactggaggaacctgctatgtagcggaagaccacaggctccaggtgggccaccaagcctcagtgtacccacctggggaccgggaagtgggagactcctctctcagcaaaacaaggtgaactcccgactcctgtaagtgagaatggcagcagctgagttcctgctgggtccggctgggtctggaaggttcaggggggcagagccattgcacctctgttgcattatgtaatttactaagaaccatcacacccgccgctttccatttgtttctctctgtgccctgtgaggtaggtgggaccaaaccatggccccatctggcagatgagaacagaggctggagaaactctgggattcccttcctcttgggcctcagacttggccccaagttggcctttcccaggtgctgccacccccatccctgagtccagggagtgggaaggaggtggtaagaagagcttggaagggactgttaaggtgcagatgtcttcattgtcttcaaatgaaaatcagtgtgggggctgcctttgttggggaacacctggcatatgtttgggggtgggagtggggcccctgggtggctccaggaggctggcacaccaaagggaaggtgaacccacagagccaggcccttcaccttgggatttccatactccgggatccaccagtgaccccgccagggaggcatggtgcaggggacctgggtaccgacaggaatccagggacctaggaggatcagatttgaatgaagctggcctgactgtgctcctgagaagcatacctcccacctcccacaaagaaagagttgcagggatcctgggggatgttagtggcttgggaggggactccaggacgaggaatgagctgactcttgttctaaactgagaaacagaatccacaattaattggatgcatttgctgaacctgggacaggacccaaatcttgttctttttctgaaatataaaccaagccaggagtttatttatttgtgtcccctctccctgcaaggactcagtgaagcagcctgtcctggaaggcagcctggctgagctggaatgtcaccgccttccccgagttgacccgcccaccctgttctcctggtctggtgaaccatgggcctggaggaggccccatggttgagggggtcaacctccccaattgagggggtcctttcctgagggcattcggggcagcaccacccgggggctggtgggcagggtctgttgatcctgggctgttctggcctggggccaacttcagaagcctccctgaggaatgggtgtgggctgcagggctgggcggggggagctgagtcagcactgtgggagccctgatcacagcaaggacagaacctgatgccagcgtccggctttgtgccactgcacttgcgggtcaccctgcctgctgcactgcgagagactagggaggccttccccatagtctgcagtcggctccgcgccactccagtgcttagactgtgtgcctgagccatgcggggagagacagagggaccggagctcccaggttgcactggcctcctggctagcaggcagcgggacccccccaggttcctgctcctgctctccctcctcatctccttttgacttccataaaacgggctaacagcaaaccctgtttgctggtctcaatcctgaagggggaggctagacccatcgtgcctgtgttcctggcttctggcacatagtaggcacacagtgccaagtgaattggcatgtgaggcttcggaggataaaagcctttgtataaggctttgcaaagcaccttacacaatgcagcaaggtggaaagaatatgattttcaagtctcagagccccaggttcaaatcctagctctgctcttcctcagtgctttgaccttggacaagttactccccctccaagtttcagtgtccccttttgtgaggtgggatagtatcctgtgtgggagggttgtcatgaggattaaacgggagaacaggtgtctccatttcacacacgaggaccctgaaggtcggggtgccggctcgtggaccagccctgctccagggcagggagcagggccttaggccagtggggggtgtctagctgcacccatgccctccgtgtgtatcctctagggccgtcctgtctgagtttaggcctggggcccccagcactggaggagtccagggagtccaggcctagctcaggatccagatggtagggcttgaggccttgggaaggaaggaaggggaggggattgtccagagagagcggcaggggcggaaacgtgtggtatcgttctcacccatcataagggccacagctgacaccgctctaacgaaagacaggtttccaagagcaaagcatcacatttctttaatcaatgttttacatgacacgggagccttcaacgatgaagatgcaaggaccagagagaactgtctgttttcagacataagttggtgaggaatggacagccgtgtagacatatgatgggacaacgggtgtgacctaatggtgatagtccgagggggaacccagcaaggcttgtcggctcggcttctttccggcctctctgtgttgtgtggcttcctcccacatacagcgcaggacccctgtggaatgagggtcttcaggggtgaagggagtgggagagagtgaactatctgggtttcatggctggctttggggaaaaggggttttggtctttatgcttcaccttgggaaagaaaaattccagttttgatgactcacctgggcagggaaaaagaggggagagagacagaagggcaggagaaggtcacagagagcttacctctgaggcctttcacatgccctttgttcagagtctgcagtgagccacagcaccacactttggggtgctgtgttctgagccccgacagggccttgtgggggccaggctccaggtgatactgtaagcccccacttccccttccgccctccctccctgacccctctctctgtggacagccctagcgtgggggtggctgggggctgacctggcatctgtgggggggcccccaggctgtgccccactcctttggctccctcctgggatttttttttttttttagagggattggcccctctgtctgtctgctcagccccttactgttgaactgtgctgctcttgatggagagagcccttggggaggaggggacagtgcaggaggagctcctcttcctttcgggcacagggggtgcaggcgtgggctgtggcttctgggacctctgtcctctctccttcatggggtccctgcctccccttcccaagtgcactgcactgtgttggcccttccccgggagctttggaggaggactggatgtgttagtgaaggaacctgggcacactctggggacctttctagatgatgactgggactgcagggtggatcctctggaaggctggtgacttgcccggggctgcgggtcagtgggaggcccttgctgccccctgcagcatgcccctgagctggtggctggcctcagggctgagcctggtggtgctagggactgcgggcaggtgtttggggcctttagtcagcagcactgcctcccacacggggcagccagctgagcagcggtcagcctctgtgggccctgttgctcctgttacctccctctaaggttagtgggacctggattatgcccagggagggatggcacctgctgaagtcacacagcccattagggtggggctgggctatgtccacttctgtcccactgtgtgctgacatccttaatcgggtggggaggggcagtgcatttgtcccccacatccatgtccctctagcccttcacatttatgtcattccactcctccttaccacacagcacaggacgggcagggttagggggaggaagcccggagcccctctgctcccctgaacattcattccacctgccagggcctggggcaggggcagggacagggggtagaggtgggtgtaggggtgtggtggagggtggtatgtggggtaggggccaggcggagagctgggccaagagcctggggaaggggcaaggctagggcagggccaaaggtaggggccatggggtagggcaggggtagccacgtgactccctccgcatgttcttgtcccctctggctctccgttccattccccccacccaccagcccctattcttttgttgtttttctgagacagggtcttgctctgttacccaggctgagtgtaatggcacaatcatagcttgctgcagcctccaactcctgggctcaagcgattctcctgcttcagcctcccgggtatctgggaccacaggtgtatgccaccacacctggctaattaaaaaaaaaattttttttttgtagaaatggggtctccttacattgcccaggctggtcttgaactcctggcctcaagcaatcctcccaccttggcctcccaaagtgctgggattataggcatgaaccaccacgcccggtcagccaacccttattcttgatctgaatacctgttgatcaaacacctcgtccccttctggttccttcccaactttcctccagccttgatttcctacttctggggccaaatacagtggaatcagccttggactcgaagtaggtccattctcctcttctctgggactcagaacctgccagccttggcttttgtttctgcatcggcaaagatggggagcccctgtggctgagaacagcactcacacttgtgtggaggggcagggcatgctggacaggccagggtgaggcagggaagcccctagaacagcactgggtagaggaaggcctgagaatgccccggggctggggtgagggcagcctcctcagtactgtgctgcgtggggtgcctgttggtgcctcagtgggcacttctgggtgggcgctatctaaagctgactctgggcattcactcctttgaatagcagaaatgacaacaatactgtttgaagtaataccaatgatgtgtttgagataaacacatacctcccgtaggcaccatttactagttccagtgtcatggatatagaaaccgaggactttgattaaggaatgaatagcctggttgcatgtataggttgagcttctcagacaggaacagacgtgtaagaacctgaaggcatccagaagaacaagtcagctcctgtgcctggagtggagtcggggaaggctgcctggaggaggtgatgtgaagggccagcatagcctggcattgctagggaggcaaagtttcctaatgaagactgtgggagtgtgtggcgacccgtggctgttgccttcccacccagctcagaccttcacttggccccaaggcaggtgggtgctggccagaccttccccctcccctgccctggctgctggggagctgccaccgccccccacccacagctgtgccctggctggggctgggctggtgctctgctcctcccagcacaggctgttcccccactgagctcaggaagcaggtgatgagggtgggaggcgggtgggctggagaagcagattccaccgtgtgtttatggccagtgtcctggagctgggctgagaatagcacccgcacttgtgtggagggacagatgggcggagggctggggccaagggtggggtgcgtgcctgtggagacaggctgtcctcagcgagccccacccagcacaactgaagtggtggagggtcgccctgtgtcactgatgccccgcggccatgcccttgctgcctgcctgcgggggtggcactgggatgtggagtagtagcaaggcccatcagggctcctcatgtggccacagcgggttgcaccaggctggccttgctgcgatggccactgtcttcagctgtttggttgatttccatggggcctcttgtcggtttacccttttcccaaaggggcccagcgtaatggggtggcttgcagggtccttgcagagctgcaggcaaggaggctgcagaggggagcttgattggagagaggaaggggggtggttggtatatgctgttccaaggaactggccatgctgcagtggactgtgagccgcaggagcaggtgcactgggcggcaggtgcggggaaggcttatgtgagctgggggttgggggagtagggcgttggggactagggtgggaagactgcaggaactttcagccctgggtggggggagcaggggggaatccagtgctagcggctctgctgggccctcttacctacatgatcatacttcacctttaaacacccttgagggagttcttggctctaagtgatgagacccagcaggtcagggaggtgagcttacttgcccagggctgcacagcctgggcctgctcccagcaccttctgccccagcagtgtctcctaccagaaggggttcctggccagctgcccagactagatgccctgagctggtcatccagagtgggcagtgggagggactgaggggcaggtgggtggggccggggtgtgatagaaacctgacggtggggtgtgtccagtccaccccagggttcctggccattgtgtctgcaccttcctcctggacatctctgggcactgcaaactcactgtgacccccagctgttaccccaacacgtgtccccatctcaggtgatgaccaccccttccctctagtagctcagatcacagagtccccttgcctcccacctgggtcagtgcagtcagcttctgaacaggcaccctgccccactgcgctcctgaagtgtgtacacgcgccagcctgggagctttgcaggctgcaaaatcaagtcttggctcagagctttccagggttccacgttccatgctgggttttaagggccagagtcttccaggggcctctgtggtcctgggggccgaggccgcatgtgcagtggttaaagctcctcaccgatggacccaggcctggggttgggatcctgggcctggctgcgtgaccctggggagttgttaaggcagtgcctcagtttcctcacctgcaaagtgagaatataatagtatttccttcatgaggttatggaggggtccaccatgaggctatggaatcatgcccaagggctcagcatgaagcctggcacctggtgtttcagggcctcctggtcctccctgccccctgccactctcagccacgccggtcttgctgtcctgtggcatccctcccgtccacctcagggcctttgcactcactgagttctctgtccagtgagttctaccttcttcttccttcctggcctggtgtcttgctccttcatcaggtctctgctcagctgtcacttccctgagttccttcctaagagcagccgccctctcccctcacccccagcccttcagtgtctctctttttttttttttttaagagatacggtcttgctctgtcgccctggctggagtgcagtggtgcggtcctggatcactgcattttttgaactcctgaactcaaggcatcctcctgccctagcctccccagtagctaggactataggtgcacaccatcacactcagctaattaaaaactatttttggtaggggtaggatctcactatgttgcccaggctggtctggaactcctgaccttaggtgatttgcccccctcagcctcccaaagtgctgggattacaggtgtgagccaccgcacccgtccccctgctgcatttttgttcggaggctcacagcacctttcaacattgcctccctcctagagtgctggctcctccagggcagagaccttgcttggcttcccatagagcatggccaggcacactgccaccagggcacgttgctgagtcttcaaatgcctgttgtgaggtgatagtgcagaagaggaagccaccttcgtttttgggtgggcgttggcaggggaggctctgattctgtgcctgtcctgctcttggcacccctctcaaggaactgagttatgagaagatccctcctgcgtctggccagctcacccacagtgtgaccaccacagccaccaggccctacagccgagaggccacgtcccagagccggggtggggactcttcacagtggtgggtctggtggaaggttcctttcttccactaagtgctggctgggtggggaagaagctggagggtgaggcctgggcagctggctgggcgcttgatgatggtctgggtgggcgtagcccttctagaaactcctctgtttgctggtggacacctggttctgctgatggctaagaatagactcagcttgggggatggtcccgaggggaggggagccagtcatgatccagggggtcctccagccctcctggttggaaggtggtggggtggctgataaaatccaagggcttggtagcggtgggccgtgtgcggattctagctcattgcttactgacatgggactctcggtttcctcactgtgaaacgcctccctcccctgccaggatttggagcacatgtggtctttggatgagcggttcctgctctgccgtccgtcctgcactgcccttggctggtccagccccgccggccactgtgagagtgctcaccccagccccctcccagcctgactctggcccctgctgcctccactcacgctgtgtgctctgctcggggctccccaggccaccgcagcccaccctggcttcctctggggtccacgtggcaccaccctggctgcaggccataggcttatctacagaaccggctggaatttcaggcaccctgggagggatgagagagaggacggggagggggccttcctggcctggagtcaactggacactcgttctctggggcgggagccttcccttccagctgcagagatgagtgtggaggaggagaccctgcaacttccttcccctcccccttctttctcaggggcggggctgggctgccagctctgatgcagacaggacctccaggggccggccgggctgggagggctctctgtgttttcgtttttgaccatcaaagcattgtggtggggctgacgtagttggtcaagtttttattgtcagttaaggatgtaaaagagaaaacccaacaccactttttgctctcaccagtatttcacaaaggaaagggaaaatcaccaaaaagaggaaggagatcatcattttagagtgacggcctcccaagagaggccaggcagcttcctcagtcagcctttctgagcaggggaccacggaaaagtgtgatgagtctttgtggactggtgtcaggggacggagcatgggggcttgtcaaaaaggtggatcgccatgtgggggtgaggccaggcgcttcctgggggtcatggacttgttaaaaagacggatcactgtctggacgcggtggctcatgcctgtaatcctagcactttgggaggtcgaggcgggtggatcacgaggtcaggggttcgaaaccagcctggccagcatggtgaaaccccatctctactaaaaattcaaaaattagccaggcgtggtgacgtgcgcctgtagtcccagcgactctggaggctgaggcaggggaattgcttgaaccggggaggcagaggttgcggtgagccgagattgcaccactgcactccagcctgggcaacagagcgagattctgtcttaaaaaaaaaaaaaagaaaaaaagatggattaccatgtgggggcgaggccaggccttcctgggaggaatgtcttcccggttttgtatttcatcgtgaaaatctttgtcagctttgcgttctaatccacaagctgtctatgttggttatgtcacaaaagtgttttctttaccagttcgatctttggatcaaagcaagatggagtgtgaatcttcttcagcaagctccagacacacgcccgctccccccagtgtctgtgtgccccagtttgggagtcaaaagttgagtctgggctttggaactgatcaggtgtggcatcctggctctagagctcattagctgagtgaccgccctgaccctcgatttcttcatctgtaaaataggaccaacggtcatcacctcagggtggcctagggatatgaacccaacgggagggggttcaagggtggtgtgtcccccaaggtgagtccttggaggagagattccctggtggtcatgctttgcactgtgagctttgtggagcttacctagaggggcacatgtgggggcctcaactgggctccatagggaaggaatttgatggggagggagtcccctctgaagtgagagctgagctggcagcatctccctcgagggagggcaggttgacagatgcctgtccctagagccagcccctcctgccaccacctcatatccagcccaggggacatgggggccccaggtatgggggcacagaggagctagggaagggggctgaggcctggctcagctccccctttcggagcagccctgagggtgtgagctgagggggaggaccccattcccccagaggtgctgggcccttcctgctgggggtgcgtctggccaccctgggctcgctcttggtttccccatctctggttttctttcgggctccttcctcattatgggctctccccgggcctccctctgcctcttgcttgtctctgtggcttcttcgtggttcctccactttcctactgtgcccaggagggccatgaacaggtggctctgccagggagggtgtgtgtgagcgtgtgtgggcgtcatctcacactggaggtgcttgctgcatgtacatggccgagcttgtgctgctgtgtggggccctgagggctggggagcgttcttgcctccagatggaatgcacttatctttaaagtcattgtgcctttgagaagttggaaggcatagcctgaagggtggctagccgctaagaagtgtgctgtgtgttctgggcttgcttcctgggactcacttcccggtgcccctgggctctgctctccagcaggaacctgggccacttctcccctttgcagccacagctggggctgctgcaaggggcccagctgcccgtagctttcccaaggagtctgggaccctcattctagcccctctgtccttggctgcaggtctgggtgccctcccctcccaacctgagggtgaagcagcagctctggggtggggcggggcgggggatggagggagaacaaggcctcaatcgtcaccaggagactgctagcttctgggttaagcactgctgctctgaagacgcctctgtacgtgtgacttcactgggttctgaggaggaagagagtttccctgggctggatgagaccaggaagctgccccttgtgcagtcaccagcctggggcaggtgccacagcccacagtcagtgtggcctcctaaggaacactgcaatgggctcagagggcagctgctaggccatgggtctgtctcctttctcacttcttgaagcagacagacctgagtgatgatgcttgttcaccaccaccacaaagccacagaatctgagctcggtcgcttcttcgctgcagagccaaatccttcagtgccgcagcctttcctttcttatctctaaagcaggggtaataatctgcggctctgagcatgagggaacgctgaaatgcctaagagcaatgagcatgcctctccaccgaaggaaatcagggttccttggagaaatggctgatgccagggctggggcagggacagtgcaggctgagcctggagaatctgctagtgccagaaagtaaggaagcgcctggagatgaatgaggacgtgtccgaaacctcccactggtcgcacttgggatgtttgagcatcaaaatgaatcacgaacgcaaaacgaaggactcacgatatcctcaccaccctcctcgcaaaggcaagaccaggggaggctcgtgtttgtggaatgccgggtcacgtggaggagattgggtaacagcgggttccagccaagatgctattgcagtgcttctcagacttcactgcgcatacggtgcgccagggggacttgttaaagggaacactctggttcagcaggtctgcagttttttttctcctccaggctcttggaagactgtcatgcagctgcccacagacctcacactgaatagcaaagaatgatggatagtaaaggcactgtgcaaaaatttcaacaactttttgccttgccacagtgaccgtgattgccctgcagatgactaagagaaaagtgaccttcctttccaagagatctggcaaacacgactcagacccggcggtcaagcctaacacagctgtggtgcggtgggaaggctcagcctccctctgcaggactcttgccaaagcagcctttaacctgaacttcctcacaaggaaacaatcagatggatccagagtgtggggcattctccaagtgattggtttgcactcttaaaaagataccagtatcacgaaagaaaaaaaatggataacattgataaataggcatacggggaatattctggactaaaggaacaagagacccgacaatcagaagcaatatgtgaaccacagttggatcctagacccagacataaagggcatttggggggcacccaaggatatttgaatgcggaccgtgtggtagatggtattttaaaatacattttggatgtattgggggtgcttatggtatcatgggcattttggagcatgttcttgttcttaggaaatctgttggagtatttaggggtgaagtattgtggagcgaaggtcatcccagtgacccttctgctgcttaccttctgttggctgggcaaacatacaaatgcaggaacggtttatatatagagaaaagtgactgggcacggtggcttgtacctgcaatcccagcaccttgagggtgctgaggtgggaggatcacttgaggctaggagttccagacaaaactgggcaacatagcgaggccctgtctctacaaaaagtaaaaatactagctaggtgcagtggcctgtagtcccagctactcgggacgctgaggtgggcggatcgtttaagctcagaaagtctaggctactgtgagccatgattgcgccatgtactctagcttggacgacatagcaagaaaagagaaaagcaaaaaaaaagaaaaaaaaaaaaagaaaaaagcaaatgagtgtggccaagtggtaacagttgattggtgaatctgggtgaagggtagatgatagtccctgtagtatcctttccactttctttgaggtttatactttgaaaataaggaggtgagagggccacatgaaatgtggaggtgagtggtgggcttagaacctcttttcctccctctgctctctcgtcagggctgctgtggcctcctgcatggcacctagattgttggaggccaccgagactctccacccagaggtggggagcaggcttaggtggctccactgtcggagtggggatggggaggtgtgagcagcagccgggagaggggtcctgtgtgtctggttgcagggacagctcgcatttgagagatgggcttggaggaggggttgtgtgctggggaactaggtgactatgggatctgcgggactgtcctcagactggctccctctgcccctgggggtttaagactcccattgtacccctttcaccactgccaccccagcctgatgtgtcagacagcaggcagcatcttggggcaggagaggggaggcagagggccttgtaccccttcccctgcctgggcgcccaccatggcctgcccacgccaaccctggtctcggtgcagacttgtcctgcgatgtccctggtatccccagctgagtgcctgcaaggcctcagagcttgtgaccacggaggccttcagctggccatcctgccctctgtctcccctgcaggggcccctggagcatgagggcggaaagatccccgaggccagccctgtgtcatcatccacagctccccagcttggctgacccgagctgtgtgtgggagacgacggaggaggaggggcaaggaaagattgacagagggacagcccccgggagtcagtgagcgagcctggacccagaggtggggggcgggggtggggagaaggctcgcctttgtcctgttctaggggccctcctccctttcgcctcttggggtgtctccctcgggactgggcccagagaaagcctggccgggtgtctgacagtggccttccccctgcccgcctgcctgtcctctgtctgtgtctgcctgcctggggagcctcggtgtgagaacgccggggcacgagggtgtgcatcctgcctccgtggcccccgaccgcaggctctgctgggaggaaggggcgagacagggctcacttctcagcccgcccttcctgtgcaggcaggtggggaggagatgatgcggaaggtgagggccttatgcgttttctggggtctcagcagctgggtggtgggtgcctgggagggagatttgctggatgaggtcccccttccatgtgtgtgtgggggtggggtgttgggaactctgctgccactgcagggacgaggggtgccgctggctggtggaggagcccctagctttctgcctggccctggccaggaccagagtgactgggaacgcggccctcacccctccttccttaggcttccctcctgggcccctgggctggtccttctgatggccttgggaagtgcttatccctgccctgggccatgccattcagactgtgggtgtgtgtcccgcaagtgcagcaggcccactggtctctggggccgagggagggatcagagaccccaggaggggctgctggggcccagccgggtgagcccgaagacccggccctcctcactgtggcggctagagctcctggcccctcctgactggacggtgtcaggctgtgtcctgatttgtttgtgctcacctgccatctgtcacataaggacacttcccttctgaggaggcggccctggtgacttgaagtgcgtgcatggtgggtgggtgctgtacgtggtgagctgctcctggctcaaacaagacaggcctgggcacccttcctccttctgggttcggtggccgtgcactgcctgtgccccatgactcacgctgtgggtcagggccttgcctgccatgcgggggctgttggagggtggcaggactccctgtacccacagggagcggctgacgccagggccttctgccctctcactgggccatgacaaaggccttggcggagggctggggaggggcacccacccacgggatgctcccactgagcccctgtggacccgggtgccggaggcatggcgtcaactcagtgaaccacccagcctttctagggaggagccttgggagggtttccttccacagccgaggcccagcgaggctgaaccctgtggatgattgcaggaggaggttctggagctggccacgggttcacactttgtcattcctgccacctgccccccctccctgccctgccctggggtgtcccctccaaggcacttcagctccactcacatctggccttgggttgaggacatggtgagaggaagctctgataggaggtgattgggtgtggcactgataaagctcctgggactgttggctctgtggctgcctctgccgcctgggcctctgtgtgtctcgtccgccgccaagttttcaaaggctcccctttgtttatcacagagtgagtgtgcgtgataagtgtgtgatgagtgtaggtggaactgattgtctaaggggccctcacccagtaaccctggacagagtgcaaatcctggcctgtgccgccagaccctcctcctcacccaactcctgctcatccttcaaaacccagcacaactgtcctgcccagctttccttagtcgctgctgggccagcccctcctggacacctggagtcccctgtgtccctcagtggtctgcctgtgagctcggcacaggggaggccccactaaccaagtgtggaacggatggggtgggagatctgtgtcccagggctcacggccttgtcccagctcctgttctggggcagggggtgcccagattgtttttccctgtggtagccacaccaggagctccttgaggatggggaccccaggccacttgcctgcgttccctcatggatgaaatgggggtaggtgcagtgaggatggcatgtggccaaggccagcctcgcccatgggtcttccctgggcctcggccatgctgtggccttgttattcctcccatttccaaggcgggggcactggagcactgagagcttcagcagcctgaggtctcgcagagtggggagactggctcagcctcaggcttgctgtcacccctcagggctgagggctttctgtacattacccttccattttgtctgggaggagcctgaggctgagaggtgggttgttttgtttagggtcatgtctctgccctcaaagcccacagctcagatgagcagcagccgctgagaatatcttgtgtgtctgtcctgtgcttagccctgtgtgggtgttggggacacagagatgactggaacagtgtccctgacctcaagctgttccttcagggtgagggtgtgaggcacacaggcacatcacatagcagtgaggaaagctctaagtggtacagagtgttttgaggaaaggagagatcagggacagttcacagtgatgtcacctgagtgaggttttgaaggatgcataggagtttgccatgtgcaggtagagtgtgcgcgtctgtgacttctgtctcacatcttgggatgccgtcagcctggacccggtgtgagggctggcggtgtcagtcaggcccatcccccacctgtgtgaaggctgctctgaaggccttttagggatttgccatttcttgaatatcatgggccaggtactgctctgcactttatagacatgatctttgtaatccttgaggagggtgccagtgttcacttcattttgtagattgaggctcagagagtagctgtcccttttcccaagggtcttctcactgctgcgtggagtctcacctgggctggtgtctcgttctcaaggctggaagatctccccagttctccagctgtctgtgcagagcacacagcagtgtttgggaactgggtcgagtgtgtgtctgtctctgtacacctcaggagccctggtggccagtgtgggtggggaagactggggaccttttgctggctgagtgtgtctgtcttcctggggagagggagggcagggcgtggaaggggcatccttcctggtgctcttgccttgggagctgggcagtccctgccctgtttctgagagcttctggctctctctggtggctctggtagacttctgggagttcttttctatgtggtggtctattcctctctttggagggggtggggctgtggggtgggtgcctgagcagaggggctgagtcacctacccaagctctttgcagagccgggtgaggaacctccccagctcagcccactttctggggggtcccttctggatgtggctgccagggaggggcagcagtggggagcctgcaagttgtgcagtgtacattttcttgctcatgtgggggttttgttttggtttttctctcatccctgtgtcagcccttggcatccagctgcagttgcccaaggggctgtgtcccgaccgctgtagcacaacatcatcggtggctgcctcccggtgcccacctgccccctgctgccactctcactttcccactccatcctctgtgacctctagtcaccttgagcaattcaaaactccccagtaagatgctccatctttctggtctccttacctttgttgcaacctctcccctctgtctgagctgccacccactccaggaagtctcactgactgcccaggctagaagagatctctacccccagggtcccacagccttaagtgttcccccatgtcaggacagagacccacatctgattcctctctgctgtaccggccaaggtgcccaaggccaggcacagagcaagtgcttggtgagagatggccaagagcagctggccttgccaaggcttctgggcctggctggggggggaagtgcagcagggcagcacaggacctgcaagggccggcagggtgggaagggtcctggctgtgtcctggtaccaggcatccgttggtccaggaccgtggcctgggccctgggccccaaagctgatgttcctggcagcatgggctggctccgggtcttggaagggagggatgtctgcagacctactggcctcagcagatgctgggctggccctttgctcctggggctccccaccgctcctgggcccacctttttctccctttgctttccactcccatcccctacccccgtttccttctcattcttgtgaggtcttgcccactgcctgggagaggcctctgctgagacatcagtgttggcctttctgccgccctgatggaggtgcctctttggctgcagacgggtgtgtcccgccgccaccctggtcttcccctctgctctcctgcaaacccatctggcactcctcatcccttttctgtgccccagctctttgtctttttcttctcctgctctttcctaccgtgccccaccaccgctccttgcctctgtattttgtctccctgctcccacctctctctccgtcatgtggagctctgggattggaggagcagggcccagagagggaagtctgggagagcgtgatggtcagcatatgttctcagggtcctggccagcgccctcctttcctagagctttcccctctcctggtgtggctcctcttctctgcccttgcccacccatccttcatctccccctgccactcatcgtggggggttgagggggagtccacctctgagactcatggttgggagcagagctgtgagctcatgtgtgtgcccttgtgtgttttgtgtgtgtgtgtgtgtgtgtgggctgtgcagagcagagtgcctggggcaggtcacatctaaaaacccagtcagatcagaagcagactctgcgtggcccccggcagctcctggccaccgctcgctgccctccttgttccgggatggctcctgccggttcagggcctgctctgctgttgcctgtggcattcatgggcctgggcccagggaatagagtcatgcggagaagtgaggctgctcctgcttggcccctcccctgcgtggctcacttttcagcttccagggtgggggcggagcacccaggggtgcagtgtgagatcagctaggagggtgcccgatccttcttgccatctttgaagcctccctcctcctggctgtggtcactacgtcaagcctgtcctaagctccatttttggcctattgtcgagccctgggtagagggtggggaggcctgaagacctgatggacccagccatgccctgggattgcagccctgggtgggcaccctgggctgggtgatgttggctagagacttcccagcccctggtctgtgctgttggtgactgagcactcttggtttgaccactctcctttccaaggtaacactctccccttctctcttggcttcggcaggttctccagaagctggggaaggcagatgagaccaaggatgagcagtttgagcagtgcgtccagaatttcaacaagcagctggtgagtgtgggtggcccttggccttagggagtttgtgaaaattcggctgccaggtgaaaaatggcacgagctgaatttgtggagtacgagagcttggaggagggtaatcagtgtgggctgacaagatcatgtaagacttcctagaggagggagcactggcaatgcatgctgggaaggaagagggatggggtatgtatgctttaggttcttggtaggagacatagaaacggtagttgggggagggggagggggagggtgggataggagcaggcaatagattgtggccagacttggggaaactttgcatgtcaggggcaagtgggagctatagaagcttcttgccaggagagtggcatctgcagcggttagcatgggggcggagcaggctgggtttgatttgggcatctgctgagcatggtgtgtgcctggctgtgtggcaggctcaaggctgggctgtggggaggcatccgcagccatctccaattggcctgggagcatttgagagagggctgagggcagctgggagggctggggagcagctgggagggcctgggagtagctgggagaggactgggagcagctgcgagggccgggagtagctgggagagggccgggagcatttgggagagggctggggagcagctgggagagctgggagcattctgggacaggaccaggagcaactgggagggctgggagcattctgggagagggcggttgggggcagctgggagggctgggagcattctgggagagggccagggaacaactgggagcattctgggagagggccggggagcattctgggagagggcggtggggggggcagctgggagggccgggagcattctgggagagggtggtggggggcagctgggagggctgggagcattctgggagagggccggggagcattctgggagagggctgggagcagctgggagggctgggagcattctgggagagggctgggagcagaggggagaggccccagggccaagttggccttggcttgccagaggggctcagcctgacaggcttccctggacagggattggggagcccccttagctgattgtcctttaggccagttatgggaggagtttcaaggcccaggtagaccctgtggcagggatatctactgcctctgtggctctgggcaattccttcccagagcttcttgggcctcagtttcctcacctgcagaatagaggcttgaacaagaaacctggtcttaggttctgattccatctctgggaagccccagggcatgtccctactcagctggcttcatcaggctgtgggttgctctgaaggacctttagggagttgctgtggccatgggccagagctgctgtgtttgacagagatctatgcaatccttgagatggggctgatattctcattttgcagatgaggcacttgaggctcagagaagttaagcacatcttccaaggctatgtagctggtgtgggtgttggggattgaaatccaggctctgtggcctttggttcactatcgagtttcctctctggagctgatcccttgtcctgagggcagctggctaggctggggagacaggttaggggtggaggtggtgggggccccttagaacaggctgagctggccgggcactgtagctcacgcctgtaatcccagcactttggggggccaaggcaggcagatcatgaggtcaggagtttgagaccagcctggccaatatggtgaaaccccgcctctactaaaaatacaaaaattagccaggcgtggtggtgtgtgcctgtagtcctagctactcgggaggctggggcagaagaatctcttgaacctgggaggcagaggttgcggtgggccgagatcatgccactggactccagcctgggctacagagcaagactccggtctcaaaacaaacaaacaaacaaaaaacaggctgagctttggcagagtgagggaagcacagttgggagctgagactctgtgtggcctggccccagggctgaaaccacagtgttgctgtctccactgtccctcagagtcatcctctctgggtctctgactctgggcaaacagtcactcactgctccttggacagaggggttgggcagagagtccagggctaaagatagccagtgctgcgggctgccaggtggctgctgggctgtgggtgtggagcagtcctgagctgggcctctgtctgcccccgggctcaggtttggtggggtggctggcttttcaggggccagggctggtagttggggtggtggttttaaggtcttgttcaaggctggggctaaggcagccagttctggatttgattggtgtgtggggatggcagggtgtggggaccaggaaggaatggggtgaaggtcactgttgttgggggagtgaattcaggaggctgcagtgggcttgggggccctgggaaaggagagagagaatggggcgtgggaagcctggaggtggagctttttcttgcctctgattctgtgagccccaagcctagtgggcccagcactacaagggacaaggatggcaggtgatttagtctttaaagaagtgaacctcccaccccttcttatggggtggggggccctaggagagggtgtagatcagcctgctgtcacctgctctccaaggacccaggtgcacagcccctcctgggcccacctggcgctggtcacagtagcatcgctgccttctgcccctgctctgagagcccatgggggcctgcttgcccctcccccagagtactgcacacctggcacaggcccttctggaagccatcctgggtctccagggcatcccagctcttcttcctagggtccgtctgtagctttccaggctgcagggctgtcattgctgtttgtctgtcactgaggtggggcaagtctgattccttcttgtccccatggcccacccaaggttttgctcaaaatgggcatccctgactattgagtgaaggtcgccccccgaattgatggctgaggggtgccagagggggtccacgtaggagggccgtccctgccccctagacccactgggagcacagggacttgggtgctcaggccacctgtggggactgatgtccagggaggtgcagcgagggcttggggatgctggctgagcccagccgcgctggagctgctccaggaccttcctgactcccccaagtcctgtagctgggacacaggctgaggtgggcagtggctcccgaatcttatcttcccccagctgggctctgtgaactctgggacctccagagaattctttctcagatccctgtttaggggctgagggagccacttggaagcaaacacacactgctctgtactggcctggacgctgccctgcggagggtagctggctggggcctccgtcgggggagggctgtgtctaccctggggactgatgaggagcttaggaagccagctgcagtgggcacagggaggcagtgctctggccggccccttgcacatctgcgtgccacgtgccggcgcacagcccagcgttgtttgggaaacacaaggagccctggtacggcctgaagcccgggggagcacaacgacccaccccatggggacccctgctgtgggggggaggtggggacggcgtgagaggtgtggctgggatggtggaggcctggcagggagagaagctggatctggaagattctgtgacatcagaggacacgatagcatcccatcatgaacacactttaatcctcgtctcgaccaacaaagcctttaattgtgaagacttagggtggctgtgtcaggagtgaggtggacccttcctcattccccggccccgcggggtctccatccgaccccctgatggaattccagggaggtctcagtgtccgtggagcagtcttctgtttcttcactcagtctcacatcggtgggccttggacttggatgtttgtaaagatgatgattagccagtgttatacaccctactctatgggggattaaaggaattttagagatttttttttttttcacacatgctctctttaaattatacatcttatgtgctgctctgaagctccccctgtggatgtctctactgtcacacggaagcattcatcataataggcagatctgtgggttctcagggccgcatcactacccattacccacaaaacaccctgcgggctgcgtgcccaggcttggagggtctcatgggctctccgagtctctgtgtgactgggccggtcgctgaccctctgtccgcttctttgctgtcaggtgggacagtggtgttgagaagactgcctggaaggtgctggcccctagggcaccagggcaggaagagcagccccggctaaggacagggagaggcctgtagtggggagacagaagagggtttcagggtgctgggggtgagcctgtggatgtggccgggtccctgctggccttcacctggaggtggacctgaatggatggggcccaccttccggctcttgcgcaagcatgaagctggccagactggagcgctgcaggcatgctgggtctcctgggaccatggccagctgcccctccttcagggcaggaggcgactggaacatgggtgtccctgaggcttgggctggcagcaggcaggggaggccaggagggtgcccttctactacgaaggtcagcctcagccactgccgctctcccgagtcccctctctgccttgtgttcctgtccttagcatgaaggccatctcctgaggcctgccttcaagctccagggcctggcctagctcactggatctgaggagtgccaggcagggattattcgccttccactgaaagacgaggagactgaggttcagagaggctcactagcttacttagggctgtgtggctagtaagggacacagctgggtctgcatggcctcaaagcccgtgtgcagcccactctttgcacgtggcttctggaaacttctgcagctcactgagcatggtctcagacctcagtgctggcctcacctattgttcacccctcctggaacctggagttctccactcagctttcctggctctggttttgatgtcccagagggacttgaggcctggcccatgcttctactgtctctgctggtcctgctgtctcaggaagcccctggaggacactctccctgctcagggagcttcaccacccagcccactgtcccctcagccttttccctctacatcctatgtccctgctgtcagctgggccagtgatcctggccatgaccaccgcattctgcacccctgctgtagtgccgtctcttccgcaggtcttctgtccctatacaggctcgcaccgggccctcttttcctagtacgaggcagtgggagctctctgtccttgggcaccacctgagcttgtggagcagggggcctggtggtcaccacacctgccttgcccatactcctgtgctcattggtcacttgtctgcaggtgtctgagggcaggtctgtgagtgccggggctgctgcacactggtgctgtgctgtttgtgtgtcattcagccgtacctccagcacgtcatctcggaggggggtctttgtcttcctgccttccttcctgggctgagaatggcatctggaagatggcaggtgcccacaagcatgggcaagggtgcctatggacgcagggcttctgaggcaggggtggtgaccgtagctgctgtcctgttgggaggtcagctgatcagtggctgctgtcaggagagcagcctggttcattcacgtgagggtggcaggaaggagagggtcagggactgggtgtgccaccagtccctgacctggtccttgtccttctctttgcagacggagggcacccggctgcagaaggatctccggacctacctggcctccgtcaaaggtaggaggcaggcagagcgcacctggcccgtgtagagctggtgggtgcagagctggggagggtgggacaagcgctatcagtgggaggcccacatacttcctttctgccccacagccatgcacgaggcttccaagaagctgaatgagtgtctgcaggaggtgtatgagcccgattggcccggcagggatgaggcaaacaagatcgcagaggtgagcatgggacaggtgggcctgcccttctcagagggccctctggtctcagctcctgtcccactctgccgtgccctctgggacaagcctctctggttctcgggcattcgcgtgctgtgtgccctggggcaagctgccctccctctctgagggcctttctcctgacacgccctcacaccaaggtgggtcagatggtgggtcgtggtcgtccttatttgtgtgttatggctcacaactcacaaagcctccctggctgaccccagtcctcagcgtatctgatcctcacagtcaccccaatagggcaggaacatttgcccccatcttacagatggggaaactgaggctctgagaagccactgagctgtgaagagatggggctggggctggtccctgcgaggtgagcgctggggcgggtgtggcccagccctcctggtggcactgtcgtgctcttgcctgtctcagaacaacgacctgctgtggatggattaccaccagaagctggtggaccaggcgctgctgaccatggacacgtacctgggccagttccccgacatcaaggtgagagacccacttgcagatctgccctgctctggcctggagggaactggagagaggacagggcctaggacgtgcggctcaggccaggaggaggctgtcctggaggcaggaagcgcctggcccggtgtttcacccctccggggttgctccctctgccaccagcccacggccccccattcctttcctgtccctttgggtctcagggctatgggaggaagcctcacggcacgtgtgtgtgtgtgtgtgtgtgtgtgtgtgtgtgttgctgcggagtggctggctatatgattgtggaaggtgtagaagggtgagtagggcctacacatgtgtgtgcctgcaggtcccctgtgtttacaccatgggtgcttggaagggtatgtgtgcatgtcacctgttgtctgggtctacatgtgtgggtgtgtgcgtgtggttgtgtgcattcgcaaagcctgctgtctctgccaggcctgggttggtgctcggagctggcagtgtctctggtatccaccgaggcgagtggtccccggtaacgtgcacatggaagcctgggttgaccattgggttggacgagatccccttggtgggcaggatgggggtgtcatgctcatgctagcctcaggggtccccagtgcagatgcctcaagctccctgagtctgatgttggtggctgtggagatgagaagccaggggccaggccaaggaaaagacttggctgacacgtcaccagctggtggacacggacacatgggctcatgtgcaaggaagtggtttcacacagtggggctggacggccaggagggggtgagctctctgccacgaggagggttccagcaacaagggctcaagggttcctgtggagctggggtctcctgcccgccctgcgggtccctccaggatccactggacctggagtctcagcaggggtgccaggccccgcttagtgccctcctctgtctgccccagtcacgcattgccaagcgggggcgcaagctggtggactacgacagtgcccggcaccactacgagtcccttcaaactgccaaaaagaaggatgaagccaaaattgccaaggtaagggctggaggcgggtcggggcagcgtctgcagggggctgagagagggcgggtgtctaggaccccgagggtggaggcttcctcctgcctggccccaggtggctgaactgggggtggggacgatacagggcccaggccggtgagtgagaggcccttgtgggtgcctgggtgaggtccaccctaggcccattcctgccccccgtgccaccctggcccctcagccctgatccaggccacctgccagcctgagaatgggcctcctgggtttccctggaacggcgccgccctgcctggcgagccgggtggaattcgtcacgcgatcccaggcgacctgtccctggctggagcgagccagtaggtgcagagctggccccactcatcctttggtgaggggctggggtggccccgtcctccgggcagggccgtgcttgctgggccccctgtgctgctaaccacgctcaccttttgcctctgcagttggagttcaccccctttccttaccccccgggctccccctaattctctcggcctcaagggcccatatctgcttggggtggcccccgcgcgtggggcgtgtggacctgcatttaatctgtgtgtctctgtttctctctccccacctccctggtctctccaccttcctttgccttgacctccccaccccagcctgtctcgctgcttgagaaagccgccccccagtggtgccaaggcaaactgcaggctcatctcgtagctcaaactaacctgctccgaaatcaggtgacactggcttctaaccttgcacgtgctggcgccttccggtctgtcgtcctgtcctctcgccctgcggtggaatgcagggctggcatctgagcccagctggggcagggtttttcaaaggcctctgctgggagagctctgcttcagaggagacctgaagtcaaatgtaggggtcaaagaaccggctgaggggctctgtgtgacctgggtgggggcatagctatgcccgctccgtggctgcatctgtggtcattcctggagactcctctgaaatcctagtggtccaggaatgcctttgagccattgtcctctgtgagggctcctctggggagggaggcgacatcatcaggcccctgtactgccatgcctgtccttcaagccacatgacaactctgagatcatcttgaatttactgagcagagaaagctgcccagagaggcacatcacagcctcctcccagggccccagagccggttaggggcagggttggggctctcctgactgaagcccctgcgtcattttcctcggacttgtggtccccgtggtgactctggaggagttactgggaggaccctccagtctggatgggatgctgagacgtggaggggaagcatgggtccttggcctttggggattcatggagggcaagtgaccagcaccacagtgttcctggggggcttcccggaggaggcttttttacaaaactcctgggccatctcaccatcctggccatagaggctatggtcttctcagccccctgccctccaaatgggttacagtgtggccagggaccactggatgcagtgccctgtgagaggtgggtcatgtggttttctcgccaatgaaactgaggcacatttcaggtcagtgtagtcacagcctggatgtggccctcacacttctccatattcccgagaggctggcgataggggcccggccccggaggttgggtttctctctgggcagctgccccattttttcggagcctcctcttgatttcatcatcttcattgagtgcctgtgacgtggagagctctgggtgggcttggcatggcttgctgtccaatttctttttctattttttttttttttttgaacgggtttctctccgttcccctggctggagtgcagtggtgtgatcatgactcactgcagccttgacttccccaactcaagcaatccttctgcctcagcctcccgagtagctgggaccacaggcacgcattgccgtgcctggctaatctttacgttttttgtagagactgtgcctcattatgttgcccaggctggtcttgaactcctggggctgagcgatccacctgcctcggcctcccaaagtgctgggattacaggcctgagccactgctcctggcctggctgtccagtttctcacctgatctgctgcctgatttattttaggccaaggctgactttggagacactgagtgttgacagcctcatcctgaggtcagggtgcccatggggaaccaggggctgggggtgatgcctagggggacttcagtaggcctgagacttcatctgcctctggaggtagaggaggaaccaggggctggagtgggtatgccctgccagtcagttcagcacttgggctagaagggaatgggactactgacggagggcccgggtttctgaataattttccctgaaacaggtgaaacatttttttgtggatgggagaacctcttaggaggctatggggcctgcccactgcttttgggctcctgggacaggtgtggttgggattatgctgggagggcctgcctccacgcccaccctgggggagcagcgagagggtgaggcaggtgatcacacctttgggtgctgggctgtgggtgtttcacattttggccaaactagctgtcccatttgggtcccatctttatttgagcacatcctccttgtccccagcccactcatacctggctggaggctggagagcctttggagtggcctgtgggcagctggctggctgtgagatggcacagctgggactccggggctgccctgcttgggaacttgactttggggagatagtgcatcctctctaggctgcaccagggggctggccggctccatgcagaccctgggctagttctgagctgctctccacacctgcctcagcgtcctgaatgctgtcctcgggaccccgggcccatgtgactctgctcttccccactgttagcttcagtggagctggggtgggggcactctctcctcatggcagacagccctcaccttactccctgccccttccacatgcttcctaaagagccagaatatgaggaatgtcacccaaagggaatacaagacacgggtcctgacttccaggaactcaagcggaactgtccccgctcttgctctcggcagcgttgctgagcggtgagagcacggctgggtgcagatgttcccacagacaagctgcggtgctgtcttcactgctgtccccaccgttgccatctggggagttgtgggggtggtggctgcatcctcatggagagggggtcctagtgggtacaggagccgggtggtccaggcaggttcttacggaatgtgggactttagacccactgttggcagttgagggcagggggtatgtgtgatggtgctcagctcacaacagtacccctaggactcactcattttatgagttccatagaaccatggttggcagcccccctgccaggtaatgggacacccaggggagtagggcagggatggcccagccatagcctggagacggaggaggggcagtattcccctcctggtgtggggtgcccagggtccctggatccaagagaggtgtgcatgttggaatagacattcttccccaccccccgctccccattctgcctttaaatttttattagattctgaaaagccaggcaaggagcccacgcccactctagcgagtagctggaggtaacctttcagaagccatggtggcccctcctccagtcccaacccaagtcactgggcctaggggctgacctgggctagtcctggtgtctgaggctggatgggacagctggctgggcttggggcaatcgtgtgctttgtggttaagtggccttccggccatctggctgcctttgccagaaggcggcccagcctgggccccagccccggcctgagaacgtgaggctgctggcgggaagtttccctaggcggggcctgacactttcctgggctgtgactcagaccccgaatccctgagtcactctcgccggcagtgtcctcccgcagtgagccagcacagccccttccctgggcgggctgggcaccgggcagggtctgtgactcacctgctgcccgcagtcccttccccagcactctgtggccgtgtgatggggcctgagcaccactgcctggtgggtgtgagtgcctggaggatgcagggcctgccctggggaaggtgtgggctaggagtgggaccaggcacagcccagctgcctggctgcctcctccctggccctgcaccctcctctagggtccccctgacattcctagaggtgcctgagtggctgcctctggtctccctctggtggggacaggtcccaggagagggctttgtgggaaggaccatccctgggaggtgaagtgaaggctggtggctgaggctgccaggagctggccctcagaaatggggagggagcactcaggggcgggggcaattgggggcagcgacagatgctgccctgagagccagaaggcagtggcagggctggcacctagcctgaggaggttcattgtggaagtgggcagggtccccacttggctgggtctggggtctgcctctgtgcatgtcccgtgtccagctcgccaagccccaggcttgcccctcttgttgtgccctactccacgctcactgccctcccggccacgtgggcctctctttggcaacggctgctcagccctccctttcccagatgtcctcagggtcctggagggctgcagggggaggtcgccagcatgggtgtccacatccagttcagcctctgtcttgcccggagccctggtcccagcgcactggccaagaggggtgggcaggaggtgggaggactggccatggggctgggctggctgggacgcccaacagaggggaatgacccgtgctgccccccaggccgaggaggagctcatcaaagcccagaaggtgtttgaggagatgaatgtggatctgcaggaggagctgccgtccctgtggaacaggtgaggcccagcacggtgcccagcctgcgtggggcagtgtccagtctgcgtgctgcggtgcccagtctgcgtgctgtggtgcccagcctgcgtgctgcggtgtccagtctgcgtgctgcggtgcccagcctgtgtgctgcagtgtccagcctgagtgctgcggtgcctgggccctctctggtttgtgcctctgatgagcgtgtgtggtcgctcgtgggtgggtatttctgagttgctgtcctgacctgcctgttcacctggcccccatccttccgcccttctgtagccgcgtaggtttctacgtcaacacgttccagagcatcgcgggcctggaggaaaacttccacaaggagatgagcaaggtaggccatggggacccctctgaggggccacaccccaccctggccgagggtcagagtcagagtcgtgggaggggcagcctgaactcctccttccctgccaggttcagcacacaccggtgaccacagggctccctcccggccctgtggaacagcccccttcaggagtgcctgggcccaggagggcagcagggcatgctggggaggctttgagagtgtcctgggtccttgcctgggtagaccacctgagaatgtagaccaggccctctcaaactgtgaatgtgttctctagcaaccttggcccagggagtgcagtgttagacaatggtggcagtttctcaatttgtaggaaaaaattactagcattttctcaattttaatttttctcccatgcttttgagacatttaaataggcctgtttcgtctgcgtgaatccactgtgcgacagggtctggtctgattagcgtacctttctctcttgtgttattttcattttaacctatctggcaactaaaacgcaaagctgttgaactttgcagttggagagacccagggctggcacccccgcccccagtggtgggtctgactttgtctcttgggcccagatggatgaagtgatgatggtggattccaggcccagggtcggaggaggaaaagcagcttggggcctcccctgactcacacttctaagtacggtttcctgccttttagactttctctttccttcttaacttttcctttttcccttcgaagattggagacaacttacgaaaagtttaaaaaatagagaaaggtgtttcagagaaggaacatttatataaaattagtctgtaaaaatatatgccacagaacatagttgtttataaataggatgaagattcggctctgagctccctagtggccaaatcaaagagaggaatattctcagtaatgagaatcaccgtgtgtgaggaataaacctccgctcgtgcctgtgctttcagtgaaatatctggcagttgtagtgtggtctgaaagcatcttggcaaaatgaccttaacaattaagattaatggtctgccaaaacaagttttaagagaaaaatgtaaaaacagtgcaagctctatgtggcattttaggatatccctataagtaggaggggaaaagatggcttccagagacagcaggcattagtgatatagcccacttgccccgttttgttgcccccttggtttttcggggtttggtgtgctagttccttgctctcacagatggggaaagaggagcttgttcctggcaggggctgggggtggtggggagaagcagaggtgtttggggaaggtggggccgtttggtggccttggaggccccccacctcctcactgtctctcctgcagctcaaccagaacctcaatgatgtgctggtcggcctggagaagcaacacgggagcaacaccttcacggtcaaggcccagcccaggtgcgtgcggggagagccctggcgcccctgactgtgtgcacggcaggggcagggctccttcctgtgaccctgttggtgccctccctggtcccccatgggtttggccttgggggtctagggaccttcctgtcttggcctctctgtgctcagggaggcaggtgagggcaggtctctgtctcgaatgtccctgcccctctggctgtgttcgtcgaggaaggagcactctggggagtccgcgggtccctgagccggctgaccccctcattgtggagcacgagcatccagggttggggtgggcagcctgctcagctttggggactggggggtgtgaacaggactgaaagactccggggtgtgcagtcctctcagagcagggagatagcaccgcccttccctctcctgctcctggaaaagctcatgtccctggatggcagcattctgctcaaccacacgagcatcctcttcctgtcctcagcctcagcccctccgggaatcccagctgcaaggaggcctctgtttcctgaggggaaaccatgagggaggagggaaatgccttgctttcctggctgtggatcagaggaagcagcgagcctgggacttcccctcccttctggccatgtgtgcatgtgtgtgtgtgagggggactgtgtgtgacaggtgtaagtgtgtgcatacccacacacatatcacagcagaacgcagagaacaccgatggactctgtaaaacagggcgactgtctgcttcttggggtattgcctgggatgatgagggtatcgggtggtggtgattgccccctccttccctgaacataaaatagttgtggctgagagaggggccatggtgacctgaggctgggagtggggaggttaggacggtggcgttgtggtggtggttgggggggtgggtaggggggtgggggttgtggaataaaggccaaaaggtgaattcaaggtcgggcagggagggacagctgcctggcctgtaggcacaggtgggaacactgggatggatcagcagggggtaagtggggccgtcctggccagaaccatggctcccctcaggaaggaggtggagggaagagagaggggcagtagaggcccaggagtctcccttccagcagagaggcctcttgtgcactctgtgctcgcctgggggccttttctggcactctgggcacacctggagctcctggggactgggaccacaggcagggtgactctccactgccccgagcctcctgcccctcaccaggccctgttagcatcacctcgggcacctggccacagcaggggccagtcagggcaccccgggatagcacgcccaggccctgtgcaaggcctctggcacttaggagaggcttttgcccctttgtcctctgagcagaagggttggcaaagagggaaggggacaggccagttctgcacctggcctttctccagaatgaaggcctccacctcccgtccgtccccacagaaagaaaagtaaactgttttcgcggctgcgcagaaagaagaacaggtaccggcagtgagtgctgcggaggggcgcagaggcccgcgccctggctggccctgtgcatgcgccttgcgccctgctcccaggtgccactaacccgtaatctggctctgtgtgcagtgctgcccggcagggctgtcgtgtgcgtgttgggtgggaaggcggaggcggcgcggggcgggctggcctctgagcatctggctgcatttagcacgttcctctgggcgccccacacttgtctagccctggtggtgcccgggccaccagcgcacttagcaatggaggacgtggctgggaaggaggcctggggagggccagggaggtgacactgcagcactgtggggttttttgttttttaaacaattctatgtgtataccatatacttatacatatattctttaaggagaatacattcccataaaacacaaattccagaaggaaagatggtgtcagcgacatctcttacgctgttccactgtttgccctcaggtgactcggtcactggttcctgctggatgcttctagatctgcactgtccagcacaggagccagttaccccatggggctattgagcacttgaaactggccagtgtgaccgggcagcggaacttttcatttgaattacacgtaaatttcattgctttgagtttgcattgccgcctgtggctagtggcaaccgtactgggcagcacttttctaggcgtctctgtgcaggttctggtagagaattttctccctgcaccttcgcccctgtgcctggggtgcacagcatcacaccacctccgccttgggttctggcactgaacgccatggctcaggacctgtcccctccatcgccagctgcccactcctctgtgatgaggacgcctctcttagtttgtccaggccctgcttgtggcctccagcagccgagaggacaggagagccaaggtctagagacatgtaccagggtgctgtgatggacaggcagggagggcagcaggctggggagcagaccccagaacagaggggctgctgcgtgtggtgtgggagactcactgtgcctctaggatgtctggctttctcctgctgtggatcttgggctgtcagcatgggccctggtggaccccatggagcctgtggggtggttggtctggtctctgcgacagatggttccaagggacctgcctgcactcctggggaccatagacctccagcctggagtcccaccttgtgctgttcctgtttctgaggcaggcttcccacttccagccccccaagcccaggtcccttggctccccccaccctcctgctctctctcacatacacacacacacacacacacacagtttcacacctccatatgcacacacctcttcacacagacgtcaatacatttgcccctccgtctcctgtgccttggccccccaacactgggctccctttcttgtcctcccccacagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcaggtaggagtgatgtcttggtagcaggtcccctgccctccctccttctcctccggctttgctgttgtcctccatcctcccactcctctgtcccctttctggcctgggcagctatggacccgatgctttgcccagtgggggttgggcctggacctgggtctcctttcccccatccagcctggcatgcttccgggaggcatctgtgacttgctcgctcctccccagcccccacccccactgcagcgccctccccttccctctccctggtcttttgtctgcttgactctttctccatcttcttttcctccctagcagaggctctgggccctcagcccacagagcatccagatctccagagtgggctgcctgtccctcttcctggcctctctctcttaaaggggcctgagggaggagcccaagccaggtggccatgcaggacctttaaagggacagagagaggaagggctcagaggagggtgtggggtggctaagggggcaggtccctgggcttctggactgtccttgtctccaccccgcctgcccccagcgggccctccaggtgtctgcagggccctaggtgctggctggccaggtgggggtgttctcatagccggggatcctgcagctccccgttttctgctgccgccctgctctgctgctgactaggatagcagggctaaggacatggtgggagcctgtcccaaacagcacttcccccggcctggacatggtgccagtgccttctgtgtattcgttcactgagtccccacaacacccctgtgaagcaggcgctgtcatcacctgatgcatgaggaagcccagcgtcatgggtgtgtgacctgcctgaggtcccccacctggtgggcaggggtgtggcctctgccccatcctggtgccacgctggcttcctctgggatacactcgtctgagctgggctccctgtgggcagccctgtgccctgggaggtggagagaggggcctgcgggaagggagaggtgggcagggggaggctggggcccggctgtctctcaacgactgtttgcttccccagtcttctcaccaggccagtgggagccagcccctcccacagttggccagtgggcagcctggggcctcttctcttcttcgctctccttcctcctctcccctcacttctctatctcttctctctccacacagcgtttctggaccgcctgcctcagtgtccctctcgggggtggcctggggtcttggtgtctatgttggggggctgggagggcagtgactcttcatttgctgcgtcctgctcagtggcctgggtgggactgtggcctgaggtgtgactaaccgtggctttgtctctgtctgtctcccccaaaccccgtgctctgctgtgccttcccgcgcggcccctcacccgccgccgacccacagctccggaaaggcccaccagtccctccgcctcccaaacacaccccgtccaaggaagtcaagcaggagcagatcctcagcctgtttgaggacacgtttgtccctgagatcagcgtgaccaccccctcccaggtcagccgcggccgccgcggcccagctctcctctcttcctgccctctcagggcgtgcatggccttcatcctctatgcttctgtctcaagagccaggaatctggccagagagagtgtcagtttccctctctcaccctttgttccctccatccatcatcctccatcatcctccatcacccatctctgagcatgtactaaggccagatgcagggccacagaggggaaggtgccgcctctcccggcgcagcagttacatcagcagcgccctcgcgacgcagtgggtgctatggcagaggggatcggggagtgtggaggacgtgtggctgtcagggaaggcttccagggccagggagagttggaaggtcctggaatggctgaagcacctggacttcagctcccacagctgctgtcagcccctcgagggcgggggcagcggccaggctgcagggcagaactgccgtgtgcacactccctaagaggcgtggaatgcccagatacagcagggagccacccaggggggcttgggtctctcccgacgggcccttggctcagcaaggagccacgcagagggtcttgggtctctcccagtgggctcttggctcagccgtggaggtgcctctggggagcctggcccacagccccaggtcttacgtccttcatggtggaggtcgggctggagtacctgtgctggaagcgcatcttgccagtgctggagtgggctgacgtgttgtcagatttgcccagaggtggccggccttccccgcactccccgagagctgactgcctcctcaagtccagccctcaaggcctcagccttcctcctgtgggtaggccaggacccttcccacacagagcctcgcctgtagggaaggctgtccagtccaggctgtggtggcctccagcaaacaccttcacacagctcagacgcctagtggggataggttggagggtgtgagtgtggggagtggccgctgggaactgcgaacagtggtcgctgctaggaagggttggggatggtgggcctcaagcccctatgcaaagactaggactagaactaaggaactgaggctgcaggtgtctgggtgggtgacgccctagttcaggggcctggcaggcgcgggagcccctctctgtgggatagtggcagagggcgatgtaggaagagcagtgtgggggcagggctgaggacctccagggctgcttgctgctggcctccccggctcgagcatgcctccgccctggtgatgcccagtgtgtgtgcaggcgagggagacgggatggcatggacactggcaaatactgagcagagaacggtgccagccacttcctataccccattgtttggttttcaatcaccctctgggaggacatcatgcccccatttaacaggtgaggaaaggaacccagggcctgtgccgcgggcccacgccagagcaaggtgtgccaggccaggaggtggtgcagagaccacccgcacccaggctctgagcgcgcctatccctccataccatacctgcctccctggccaccgcgtgtgccatctccaggcaactggtcttcccggtctggtctggggtcggggagccatgacctttgggtggggcatggggcaggggtgggcttgcctttgtccatgacacgggtgcccacgggcttcccggctgtggggtggtgagtagcctgtgtccctgcatggagggacagtcccgggcctgcatggcgaggtgccacctgccggggcagcacagcgaagggatggtcagctctctggcggatgaccctcccctcagcacatgacggatattgctgcctgggttggctgacttttctgagacaggagggaggggtgttgctggggcagggtgggggccactggggagagatgctggccgcccgctggtgggaggcacctcgaggctgtgcaccggcgtcctcagggctccttcagagacggccggttatggggcagagcagtgacctccctgccctgggttccccagacagggctggacctaaaggaaagtcagctgctgggattggcccagggcagggcttggggcctagggcccctggttctaggaagtgagtccacttggcctgagctgtctgacaccttggcttggccatgtggaactgctccacgccttgtcccctgagctgcaggacagctgggtcctcttaggactgaggaccttgggtctctcccaatgggccctcggctcagctatggaggtgcctctggggagcccggcccacagccccaggtctcacatccttcatggtggaggccgggtgggagggcgcccctgtcagtgtccggtgcctgtcaagagtgtgtagagccgggaagccgctggcctgggctgcggggctggagttcttccagcactgcctgagggccccggaggggagcaccccggccacgtccctctccttttaaacctgggcaaagttctctctggcccccaaagggaagccccaggtacaagatggagaccgcagccgagccagtccctgctcctcagaaggcagcttgtgccctgggcatggatgctgccccagggctcaccggagtcattgtctccgcctgtgccgggggctctaaggaagccccttcctcccatgctagtctggcccagcttatggggaggcttgtccctgtgtggccagggccaccgtgtcccatccctggggccatgcctgtcacatgcctattcctgggctcactggaaggagatcttggcgaggggctgctgggaggggtcaggggcctgcagttttaacccaagtgccccgggtggttctgaagcccccgaatgttgaagaccccactttgaagcttggcctgttgggctttgtggctggctccactctttctccgtccctggagctgacggctggtggtgtcgccagagagtgacctccctgtctggggtggaggaaaagccagtgtgaagtctctgcctttggaactttcccagtcgggagcactgagggtggctgtggcatggtgttactctcgccactggggggtagcaagatcagcagaactcttggcgcagggagcggagaggaggttcgggcattggtggggaggggcccaccagtctgtggatggtggcggaagagagctggggcctggtgctggccctgcggggtggcggccacgggcggacctatgactgggagtttgaggcgggcactggggtcgtcctcctggtgtgggcgggagcctgtgccggggcgcgtggctttgggcagtgctcccgtgtgtgaggtggatgagttggtgcctgggctgtgtgccagcgtgtgtgcgtgtatgtgcgcttgctctgcatgcgtggtgtgtgtatgtgtgtgtgtccacgcgtgtgcctgtgcctgcagtgtctgcctggggtgagggctcccagcttaacactaactgcttcctcctctgctgctgctgctgctgccaagtttgaggccccggggcctttctcggagcaggccagtctgctggacctggactttgaccccctcccgcccgtgacgagccctgtgaaggcacccacgccctctggtcaggttggttgtgcccaccactgcccatgggcccaccagcttccaggtgcccaaccctgggctcatgttgcctattggccacgtgaccccagctaggcctgggtcactgcccttcccctggcacctcagccttcagccctcatcacctcctggttgtagggcaggaagcagcccctgatcagctgggagaactctcagtagggggttactgaacacttcctggcaactttgtgctcatcgcttggggcagaagcatcctggcttggggtcttgaagctccctgagaggtgtcgggagctcggccacctgcaaatcttggagtctacctggctccgagccactcctgtgcctgctgggctggatggcctggggcgagcgggggtagggtccctggggactgcttgccgccctgtctctaacctctgtgctaactgtccttctcgccctcactgctgcgctcagtcaattccatgggacctctgggaggtaagctgcacgtctgctctttgtccagcccctgggggagccactcttccgtatgtgtccaggcccacatgctcctagcctgttcacaggtgcatgcaccccacacaccccccacacgcaggacacacaggcacgtgctcacgcacagggagctggtgaagccacccgcctccagccattctgctgcttctccctctggcaggcccttggaaaaggggatcttcggtttagcttgagacaggggtcccctgagatctggtcctgttttcacagcctgtgagtgtttgcctccagacagaagtgggccggtcacccaggatggacgagtgtcctcagggtgtggggcaggagggcctcagggtagaaggttcttgccttctctgagctttttggcagtggggagctgtttgcgaggaaggggagaggggaggaatggatggtttgagagagtcagggaagacagggtgtggctgagtgccttctgagagcagggcctgcaggcaggtgcaaggccatctcacacagcaccatgtcactgtcacctgatagctcaggacacagaggctcagggaaggctcagtacttgcccaagaactggtcatggtagagccagaattccaacagggtctcctgggctctgtccctgagaccccctgatacaggcagagatgctgggaggggcaggcgggtgtgcaggcgcccttggggcatgcgctggcagcccaggctcctgggagctctggaggctccaccgcaggatttccctctggaggaagccagaaagagccagcctggtgcgagctggtagggccattttgacaagtggatttcggtaggtgctgagcttgggcagcacagtcacacctgcctgtccctttgacagtggtaggagagaggatgtgggaggcgggtggctggccgggctccgctggtacccaccctgcccccaccaaccccagccgctggtgacattttctcttgtcttgtgatcctgcccattgcctttccaccccggcctccccgccccctccctgttctctcctcgtggcctgttaccagcccacagagagtccagccggcagcctgccttccggggagcccagcgctgccgagggcacctttgctgtgtcctggcccagccagacggccgagccggggcctgcccaagtaagtgcccacctccagcccctgtctggcttgtccccagtctctaggggtgcagcatggaaggagagccccgaggaggggttgcaggagggaccaggccaccatggatgtgagggtgaggacagggtcctgagctaggctgccccagcacgggcttgtcaccaaggctgccagggatgagtgagcgcagctgggcgcatcagcccctcctgcttgcccaccccagcccagcctcccagcgcaggaggagcatttagagcacctactggtttatgccaggcactttccagaatcttctcatttaatcttcgtcatcacctttacagccagacacttcctccttttacagatgaggagatgggggctaggagggttgagtaacttggttccagcactcagaagtggccaagtctgagtgtcggcccaggtcagcccagctctggggttcctgcagggcctgccgtggtgcccgtgctgcggtgcccgtgctgcggtgcccattctgtgccacacccttcttggatttgggctgcgcacaggctgcaccgcaccacctgcgctgggttgtgctcaggctgggacagatgtgtgttgctgtcccctgccatggactatctataggtgcagcaagatcctgccacctgccgggtcaagcagggtgggcgggtggtggctgtggctgggcgaggtcttggtgccgagagagcagggcctgtgaggcggggttgggggtggcactctggggcttgcactgggcttcttcacagcattgtcactcacatccctgggcctgccagcgcctactcttcagctgcttccccggcccagggcccagcttgtccagcagaggctccctggattcttcgaggcactgggcagctctagaccctgctgccagccaggcgatgcccccggccctgtcgcttgggtgctgccctcctgtggcctgtttcctgtgtcctggctgtgtcctgtcctgtgtctgaccccaagccggcatttatgttgcagccagcagaggcctcggaggtggcgggtgggacccaacctgcggctggagcccaggagccaggggagacggcggcaagtgaagcagcctccgtaagacagcagggacaaagccctgccttttcctccctgccgcccgcctgcctgtccggggctcccctgtggcccctgctggtgctggtccaggcctggctcctgttgaggaagctggaggcgggccggtctggcaccaggcgcagacacctttctcccctccccgcccctcttctcctcggtggccctggctgtccctggaccacctccctgctcagctgacccgtacctctgccaccagagctctcttcctgctgtcgtggtggagaccttcccagcaactgtgaatggcaccgtggagggcggcagtggggccgggcgcttggacctgcccccaggtttcatgttcaaggtgagcccacagcctctgactgctgcagtccctcggtgccctggtgggcagatgagaaccctgagcctcaggagactctgtggtttgcccaaagttgtgcaggcgctactaggtcactcccagccagcaaggtggcatctgagccccatactgtcctgctgcttttgagcactcctggtctccatactgccacctgcacctcccacacgcaaggcccgtgctctgtgcagggctggaggtgggacggaaggtctgacttgcgatccgcatcctctgcaggtacaggcccagcacgactacacggccactgacacagacgagctgcagctcaaggctggtgatgtggtgctggtgatccccttccagaaccctgaagagcaggtgagggctgggtggggccgccagagcgcagggggaccacaggcatcctggctgcggctggcaccgccgtggcggagacaggccagcagggggcagcagaggcccgcgagcaccagggctcccgcgccaactgctcctccccgccctccacgtcgggctttttcctctctccctctcctctcccttcccttggcccctctcctgttaggcctctctctctccctgtccccatacccgcttcttcctgtagcctctgctttcttctccccacgtcccccctttgctcaggcgctctcagctctgcctctgtctctccccttctcctctcctggcagctgtgcctgaggcctgcctccctcctgggacaggatgcttgacccctcctgccccgcccacaaggtgcccaccctgcagccagccggagcactggttgggctcatgaagccccgtgtgccgtccctcgaggcgggccctgccctgtgcacgcagggccatgggcttcccagctgtgtccccggctgaggctcacccacgatgccttccagacccttctcctcctgctgtggcttcatgttaatctcctggaagtgagggctcctgttgagcctgggtgggtgctaagtgtgtccctcctaggtctgggaccctcctggatctgggtcagttgcccctcccagggggccttggactcttggcaggagcctccccgctgtgtagagccagctttgcttgtggggggtcggtggtgccatgtgggcatctggcttcctccacggctcagcccctgagcacctcgggctgtgcacagagggcctggccggcttcttcctgcttccagagaacatgtttagccatcaacgcttctgtgtgaataggttatcagagcggctgagggtgacagtgggtctgcctgggtcttggatgaggccgaccctactgggggtcctgggctgggatgtaggggtaccaggtacttattgaggtccggggcaggaggcctgagtgatgaggaccttgtgggcctggcactgatttggccctttctcctaagcccccaggtcttcatggacctcctagtgggccagccctggctgggtaggatttcaagcagactgctacccagagcccacagtgagaattggcctggggctgctggagggggctcagatagggcatgagtagggtctgtgaccaggctgacaatgacacagagggaaataacaaagacccaggtaggccccaggcacagcccagctgcaggggcagcctcggcccagccactggcaggagtggatggccatacggctccccgtgacccacctggggccaggggcctgtcagcactcccagagaaggccctgcgggtgtcaggattgaagcaaagggcaagtcgaagttggagggactggtgggatggccccaagtccctctagaacttgtaacttgttgtcactcccaaaactttctggggttgtttgagaagcctggaatcctggaagggctgatgtgcacatcatgcatgcagtgggactcatcaaaaccagccacgaatggttagatccacctgcggacgacaggctggctcctgtggtgcctctgggcaggagcctcagccagcaagcatcagggagtgctgcctggaggaggtgttctcaaggtgggcttggcaggctgaggcaccaacagcaggaggaggggccgtcttcccagcaggttggagtgggatgcgtgccctgtggggtggagccccttgctcatccctgtgcgacctggtgctctgcccctcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctcagaaaacgtgtgtgtatttgttctccctcttcttgtccgtgagtgcggatggaaccgtgttatctgtggctttcttactgagatggtctgcccccgaaggcccgctgccctgggctggtgcaccacagggcttcagcccctgtcccctggggttcttaggggtggtcagctggaggtcagggactgggggcttgggtgaaggggcttggcgagccatctctgtccgagaaatctgctgagtgctatcctaagtgacctttttattttattttgtttcattgttttgagacagagttttgctcttgtcgcccaggctagagtgcaatggcgagaccttggctcactgcaacctcccgctcctgggttccatcgattatcctgcctcagcctcctgagtagctgggattacaggcgtgagccaccacacccggctaattttatatttttagtagagatggggtttcaccatgttggccaggctggtcgcaaactcctgacctcaggtgatccacctgccttggactcccaaagtgttgggattacaggcatgagccaccacactcagtgaccttatttaatacgcaagagaacctgtggttcaggtaccaggactccctttcacagatgaggaagctgaggcccacggaggtccagttaccggcaggtgagtgatggcactggactgtgggtctgagcacttgaccccagaccaagggcaatgcttgtgtctggtggggtctgaagggcctgggtggggggcaggcatgctggcctggcttgtccctcatctcttgacccctgctgaccccgctctgggcgcttcagttccatcggcagacttggacaggtctgagcagcagctttccaggagctgcggggactgtgcccatgggcccagggagcagcctgcacttccaggtggaaggagctcacggctctctttagtaatagttaaagctggtgagtgaggtgactgtcagagtctgagctttattttggggtaaagcccctgggctttgctttaggtggcaggattgtcattgctgtggccctgcctggtcctgtggggggcagatagtgttggctctgccatccgtggcttccaggagcagtggaagtcatagcagttgggacagagcctctttctggttgcccctgcttggagatctcccacctttcctaccttccttcactccctccttcatcccttcctccttgacagcctcatttcccctgcccaaggtccatagtgcattgtgggtggagccggcttggagcccagcccacttctgagcctgggtgcacgtgccctgggctctgtgaggtgtgaagccacagtgccatcatgggaagtctttgcttttatttcaacctgaaaattcaaaacaaaacaaaaaaacaaaaaaacccacctcatctaaaatacattatccaggagaaagcatttagattaggtttttgacaatataagattccaagatatgttccatggcagctttcagctttacccccagccctcgccgctggggtaaggagcggccctgctctgtaccacaaggtcagggcctgcagggagcttcttgccagagggagcagggccaggatcggggctggggagcctgcggatccagagggagggaggccaggtgtgaggttcccatcctgctggggaggggcagcggcccaaagtctgaactgagatgtgtgtctgggagccggggagtcaactaggttcatggcagtgcagggggcattcagagccaggcagcgtgaataaacaggccagtgagctgaagggccgggcagagcagagggcccaggccaggacagggtggaggaaatagcaacaggtggggtgaaggtggcccatggtgggggccgggagaggtgcgggctgctctccatgcctggcagctggacgtgcaatgtcccggagggcttggcaatctggcttgatttgggctgacgtggccacggaggcccagaccctgggcagggctcctgact

SEQ ID NO: 16580 - DNA, 23716 bp, Human
aaaaatatgaccaatgtctatgataaggatcacagtagatagtgatttgccactggcaatgggccaattttaagggaagcatatagtgctgtgggaagcaatgcaatttaggcactaacgatagtcccggatacaatctacagtggacctagtccaaagggaattccttcacaagtccaccaccggaattttggcaacaccaaagtgctgttttgaatcctcatggcatacagctcattgattgagcatttcattcattttccatcttatatgcttacaaaactgtgtttaatattaaatataaattcacagatataaacaattatatgcaaatctttatttaaaaaataaagccacattacatataagtaactatataaactattacctagtggtttcttactctgaagttgggcacacagactctctctctttgaaatggagtcctgctgcatctttttgtttcattattatcccagctacttaacctttaacaagagctatataaagttctggcctgtttttaagtaattttgtggcaaaaaatgaattttacctgagtgctgaaatgttttgccataggtgttatgcggagttcatatattgtgaaatactgactatgtagcccttccaataagatatccattaaaacagtgatggatagtaatctatatacatacatatatagacggagaggaagagagaataggctctaattaaagcatcagatgatataatttgattagattctgaacatctttcacttgtttcaagcatccagggcttacatgctaacaaaacaacaaatcgcttttttttttttttttttttttgagagggagtctgactctgtcgcccaggctggagtgcagtggcgcgatctcggctcactgcaacatttgcctcccgggttcaagcgattctcctgctttagcctcccgagtagctgggattacaggcgcatgccaccacgcccggctaatttttgtatttttagtagagacagggtttcaccatgttggccaggctggtctcgaactgcttacttcaggcgatccgccagcctcggcctcctaaagtgctgggattacaggcgtgagccaccgcgcccgcccataaatcacttttaataatatcctttcgtacgaatagcattgtgcaagcaatcttccataacaccgagtaagcacaggggagcatttctgctagtgcctagcaagcccctggagaagcgacacgtcatctaatggcccaccaaaggtgctgcatcccaggcaaacgccattacaaccgactacccaggtccccggaaaggccttcgtttactcctaacgtgttttgctgggatgcactgacccagcgttccatctcgcgacgaaagcccagaagacaaaggagcccgcccggcgggagaggagcgggtgtttggacgtccccgcgtgttcctaaacacagggctcggggacccgaagagcgcaccgcagccccctggagcgtatatatccggggtctcaagcttcaggaccaggcccgggagactccctggaattctgccttcgtaattttagaatctttttcttaaagtgacccagcccccaatccgtcctccccacaaaggcttaactttaggcctcaacgaccctagacccacgccggacaatccctctaatccctctctcccggcaagaaacggcctcctgctaaggacaaagaactgcggcctaggggccagttactacaggctggtcagggccggcaggggcgggcgcggagaacccccgggagcccaatgcctgtgcccacgcgggagcggggcggagccgggcgggaagggggcggaccctggaagggacaggggcggagttgggccgggacggaggcccgcagaggagcagcgagggggcgtagccggagctacggcaccaaggctccgcccccaccctgcctgccccctcgctggagcaacgcaagcaggaggcgggggagtcggaggaggtggcggcgctggagctcctcccggggaccagcgacccggggagcgagcacgtcgctccgcaccgctcttcctccagccgctgagccgtcccttctcgccatgtcccagagcaggcaccgcgccgaggccccgccgctggagcgcgaggacagtgggaccttcaggtcagcgtgcgggcagtcagggccccagggccgggagcgttgggcggcagggccggggcgcggggagccggccctccagaggcattctgggtaaagccgtgcccggcgcccacgcctccgcggctgtgggtgctcggccccgccctctcggcggcgagggttggggtctgcggccgggccccgcccctctcgtggtccctggcggcgcgcggggcgggcggaggtgacgctcggtcggcgcgcccgggaagggatcgtcaggttttccctgagaggctgcggcgctgctgccagccctgttctgttgagaatctctcctacccgcattcaagtgctctctctaaagacctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggcatgcaaagcacacctttttgtggtttttgcagtttggggaagatgataacagctaagccagggaaaacaccgattcaggtattacacgaatacggcatgaagaccaagaacatcccagtttatgaatgtgaaagatctgatgtgcaaatacacgtgcccactttcaccttcagagtaaccgttggtgacataacctgcacaggtctgtatacacagttaacctggatgaccgagtgggttggcagtcaatacttggtgttgcttttcagttcggaaaagttctctttttgccagacagctgtgaggaacaggctctgaaactgagacctctcatctcaggtcgttagggcttttcagctgcatctgattctcttcctaattttctcttccccacataccaaggaagcttagaaactaaaaagttacccagccggatggctggatcctgcatggctcttctcataccctaggatcctcctagggttcttcttagaattagagggaagcaggaaaggttcttggagcagtcatagctgggtcagtaggtactgtgaagtttcatagattatagcggatgccaggaggcatgaccccagaattttctgagcgtctctcctctctgtatggactcatttggcactttaggtccattgtgctacttttgattctgtatccaaacaaaatgaggaaggggagaaggtcctcatatattacataataacttctagtttttgaaactgaacagatattttgtatattatccactttttaaacaagaagaaacaggttcagagagattataagtaacatgcgtatagcaatgaagtcacaaagcaatgaaattttaaagttcatgctttcttttggtctgtgagcttgagcaaatgataactaaagttgctcatttgtaaatgtggacattatttttcttatgtatctatttaattgcaaacacagaaaacattggatgctaaatttaatttggaagaatgccaagaaaaaaatttagtaggaaggctcaagttctaccatctggaaaatctgaagacagcatttgtttgtgtccctggaagtttggagtcttttattttaattgatgccactttaagaaaagtttaaaactttttgtgtgaggcagttagattgtaggtgctggccggaagggtccccatgggaaccatagagtcaacactgcattacttactttagctagtctatttctagataggaagaattcaagaaaagggagggtttttccctctcaatgtgttttagaccccaaattaacaacctatggcaaccgttctgcctacgccctcttctcacactaccatggcttcctgtgcaagcttatctgcctccatggcttctgatactgtctaaagactaatattctgaaatgtctgtctacatcccaagcccagttacagaatagtgtatcagtctgtgcttgctgagcatctttgcctggatgacacagaggcccctcaagcctctcattgtcccaaactgaatccatcttttccctcaaacccattcttcttgcattccctttctatgtaaaggctccacaatcacctagttcagtagaaatgtaggcttttgtcttcctaactacttcccgtctttctccctcttgtccagtctgttattaaactctatccattggcgtttaataatccactaactatccattgaatctgtcggcttctctcttctggccattgctactgcctaggccaccatcatctctcacttggattgtagctgcagtcttgtagctacacgtttaccttctagtcttgtgatgtccttttgtcacattacaaccagtgttcattcttttttttttgagacagggtctcactctgtcacccaggctagagtgcagtggcatgatcttggctcactgcaacctccgctacagcctgcacttaggcttgttgtaacatatcccattccatacttcaggtgcctattaacagacaaaaatcccacactactctgttggctcttgagggcagggaccctgtatgctatatccctaatacctgtgttagcagataaatatatggtttctgtgtcttcttacacttgagggccacacttgaaggccacacttgaaacttattccatgagggtatgggagtttgaacttaaaaggaaaaagatggaatttatcatttgccattgtgattgcttactgaaattagacatcagtcttatccccagtcccaacttagctacccatgcagaagatacagaccgtccagaagatacataacaagctgtcaccttattccataaaactctttcctgttgtacccaacacataatcatgactgctcagcctagcaaagcagtttgatacgttataggacaggctgtcagaataaaattatgcacattttgctatcaaacaattctgctgtaaatggttcctttaaaagaaacttcttgctgcagaagaatttcccctccaggaataaaggaagagtaaaatactaatctgcatttcttcagaggtgtgacacggtctactttattaccatgttatataataaacatatataatgtagaaataaggatttttatgcaggtatgcatagaattatatagaactttaaaaagttattttttaaaattttttcacatggtgaatattttattacagtatataaccatgtagtatataacatgtacatatttttatgtacagtatataacgtacatatttttattacctagtatgtgtatgtaaaatctatagtgactttgttttgtgtattgaaaacatctttgtaagctgcacatttttgtgggagataaagacttctttttttaaatcttaattcaggtgaaggtacaagtaagaagctggcgaaacatagagctgcagaggctgccataaacattttgaaagccaatgcaagtatttggtgagctaaatttctttgtattcagcagctcaaaaatatcatggctgaggtaagattaaaaatttgaacatgcttacaaaagcaacaaagtgaacagttgttagcatcctacctctcaaattctatttccttatgaaaacttatcatccattaaagaaaactttatccaatcaaatccagcaattagctattaaatgaaggtgctcatgaactaggctttactgtttttttttttttaatgggatacaacagtagaaaatcagtgcttcttgcaaatattaatattaacattttgtatttagactttgattatttctacattgaagaaaacaaagtgtgagatggagaaagatccactaaaagtactcttttgggaattctaattttgaagaagcaggcagaggttttcttttattatataatgtataccaaaagaagagaatgttaagtgggatattaattcttgacatatctttctaaagtaagatttttttttttttttttttttttttgagacggagtctcgctctgtcgcccagtctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgccagcctcggcctcccaaagtgctgggatagattttttactactttaggtgtttctagatagaatattggtcctggagcatctcacatattaaagtagtgtccactgggtgcactctggagcttggcatgctttcaagttcttcttgtgcatacacttacatatgcctgaagtacgatctgtgtaatcagcttatagttgacagtagagacccagggaatttgggatgggttttttgttccctagtcatagaaaggcttttggattaggggtgtagttaggttctcatgtagtattcctctctttttgtaaatcattctaaaccgtttgggtagtttagaactaaccagtgacatggcaaccctctagataagcagctgcccaagacaagccttgcatttcacaagatgatgcttgattctctagggtcatgcattataattgatctatgccaggctgggcggggtggctcacgcctgtaatcccagcactttgggaggctgaggtgggtggatcacttgaggccaggagttcaagaccagcctggccaacatggcaaaaccctgtctctactaaaaatacaaaaattagccaggcatggtggcaggcgcctgtaatcccagctacttgggtggctgaggcacaaaaatcgcttgaacccgggaggcggagattgcagtaagctaagattgtgcccctgcactccagcctgtgaaaccctgcctcaaagaaaaacaaggccaggcatggtggctcacacctgtaatcccagcactttgggaggccaaggtgggcagatcacttgagtcaggagttcgagaccagcctggccaacatggtgaaacctcgtctctactaaaaatacaaaaaattagccgagtgtggtggcacgctcctgtaatcccagctgcttgggaggctgagacacgagaattccttggacccagtaggcagtggttgcagtgagctgggatcgcgccattgcactccagcctgggcgacagagcaagactctgtctccaaacaaacaaaaaaaagacatgccaaatgacatggcaggtattgggttctcccccactggtgatggccatgctgtttctgtatagcctgaaggtgaacccaaccattaagtacatttgtagaaatgaggggtatggagtgtcctttctgcatcttggcactttgtcagcaaaaaaagctaacaaactttactatatttgtgcttcttgacagataaaatgggaattactaagctgtaatcaggcctaaagtggcctgacttaatacagagactttctcacttctccatcacaattatttgggtagcttcggcatgcagcattgtaagtgaatactcatatctcatcagcctatgtaaagcttgaaattctcacagttggaaaaaaaaaaccttgaggaagtggcaataactaaacctcatttgtcatggaaaaatgactccagttgcctaggtggtactaaccttgaaatgccgcttattcagttttaagtactgacctgctaagtaactagtaattccagactccctagaagaggttgttctctttttccctaatcataatccccacttgctaaaaccaaattcatctaagccatctattttctgcaggatacatgtaaatcttagaggattatcccagcactgagcagatgatagatcaaacagatctctcttcatagttctgtggatgaaaaaacagtatttacacataatctgtattattcacattgccaggctaaattttctggatcattgttactcttctgttttttgtatagttgtaacagagtattctttaaatacatttttatggcatgcctattatgtacaaaacaccacaaagcttatgtaggtaagtgatacataggccctacctcaaggagcttactgtctgaacaggggagaggtgtggtgaaggatggacaaattatatgtatttgtaagagtatataatttatggtaaaacaatttcaagaaaggattaaaccatgtgttataatgtttcaaagaagggagagattataaaccactggggtaaaaggataggcttcttggaggaagtgacatttgagatatatcttggatgaccgatcagattcccatagaagaggtctgagaaaagggcattccatgtagaaggaatgacaagagcaaagacatagagagttaattagaaaatgcttgtcatttatttcataattcgggggaaattattttgttttataacacttttaaaaaatatttagctttgcagttcctgaccccttaatgcctgacccttccaagcaaccaaagaaccagcttaatcctattggttcattacaggtaagttgtacagttctttgcctactgatgaaatatataataagtttgtaatgtcagaggggctaacacaaggaattaatattttaaagacaagatagtgatatattttgttttccaacttacgatcattagattaacagagctaacttgaaattattttcctatttatgttctgggttttctttcatatacagtatttgcctttggcttatagaattctcatttaagatcaacaggccctcagtgcacatgggtaaagtgttttatactttaagaatagttcttgctactcttgtgacaaatctctttctacttctgttgagacagaagactttatagagagcctaaatcaaatcagtgaacctaactgaagaaaaggagtctatttgcttattctaccaaaaaaaaaaaattttatctatacacacacaaacacacacacatatattcagctttgaatttctatatgcagaatatccttcttgcagattatccatgtgctctgttaggccatttccctccccattattcagccagtcctttggtctccttttcctgcacagtgagcttttctatagttttcttcaccttctgtcccccactttatgcaagtctgttgtttgctgtccctactcctcatgtgttcttggccagctgtgggtttggaagtctatagctaggaggggagggactttaggaactgatggcagtgaaacctgtagatggtctcctctggtgttgccaaagagggcggtagtagcctgtttttctagttgatgtctgataccagctcactgtggtttaatgcaagaacaccattcgtagcacaaaactgcttcagttttggtattggggtataaaaatataaaatgcgggaatgtctttgagaaatagagggtcttccctcttttttctgttgcagaatatcactattcttttcaaacatatacatagaaatgggatcaaaattaagaaaacacttatgtgattgagccattgcataaaattactattaaagcctcatcttgattttataggaattggctattcatcatggctggagacttcctgaatataccctttcccaggagggaggacctgctcataagagagaatatactacaatttgcaggctagagtcatttatggaaactggtacttatttcttacaattaaaggcatttgaaatattttcagatgatgaatgactatcgaaatttctgtcgtaatgttttcaaatatttctatgcagaaaaattgatacactcctcttttattgtctctgactttctgaggttgaacttaagtataaatatttggcttaagatacttagtcttcttaatttgatatttttaaaaatcatagattattaatagaaagacaaactgttggctctgtactttaaacagtcttcattgataaattactgacttaaaaaacctcaatttggagaaaaagctatagtaaatctcttggattttaacagctattctatctagaaaataggactagaggaagattacacttgaaaattatatgattaataagagactacatggcaaataattgcagtgagataaaaatgaaaattatctttcttaattatagcaacttctatgttataaaggatataaactataagaaacgctgtcactttaaaaagtactagcgagaattcctgttaacttctctggcatgtttttgttattttcaaaagtggcttaaaatgggattttagcttagctagataatagtttcaagtaataagaaactatttgcctttgggaggtagtgtggccagtacagaaagcaccaggccaaaagcaggaacctcagcttccgtccttgatgcagtccttgattcgcgaagttaagcaaattacttaatttctctggacctcagttttttaatctataaaacaaaagcatggaggtagatatttatggtatctttcaactccaccatcccctgtgcctttcttattcctgttaaaaggaatttcatataatcgtcagtttagagaagatcataagcaggaaatagacattgagagagaggagttataattcagatgtattttaataaatctaaataattggtcagaattaaaccaaatatggttcagtaatgctagacataggaaaatacaattattatagaaaaacagaaagcataactattaaagaaaaacttaaaacaaatgtcttcaaaagtgtaagaattagtaactatacaggcctggcacagtggctcacactgataatcccagccctttgggaggctgaggtgggccgatcatatgaggtaaggagtttgagaccagcctggccaacatggcaaaaccctgtctgtactaaatacaaaaaatcagccaggtgtggtggtgggcacctgtaatcccatctacttgggaggctgaagcaggagaattgcttgaacccaggaggcggaggttgcagtgagccaagatggtgccactgcactccagcctggtgacaaagtgagggtccgtctcaaaaaaaaaaaaaaaaagaattaatagctatacaaacaaaatagcataacaaacaaagttatcaggtcagtaagaacatagtctagtatataataaaaaccgtgaggttctctgattaaacacagtacttcatacgtttgatcatcctctgtggacactaatttcttttctaaatctaccatttctttttctttgttcaggaaagggggcatcaaaaaagcaagccaaaaggaatgctgctgagaaatttcttgccaaatttagtaatatttctccagagaaccacatttctttagtgagtaatgttgacagctatgatgttaatgtcattaagcatttcttgcagtaggaaactttccttgatttcttattctatagctacttcagagttgtgatttttagaaatctcttcattattcagttataccctaccccatttttagctgcttcctgtttgtgagtcaggatcacagaggcaattaggtaagagagcttgggagacacagtcaaattcagaataataggacgggatctaaagatgataggccagtagtgccatttttgccttcaaagtgacagcgcatttccatccctttgtttgttcattcattcactcagcaaacatttagtgagctcatactgtgtgctaagtgttgtgttgggtactggggtgcagtgaataagcagtccctgcctctaaggagtttatagactactgaaaggaaggaattctataggctagtccttacagagtgtgatgtgggaacatagaagaaggcatccaacaaaaacaggtttggagacagattccaggaagaagtaatgtctaagccaagacctgtagaatgggggaaaagaattccagagagaagaaaaagcgtgtgcaaaggccaggagtgaaacatcgtatgcagtctaggagccctaagtgatttgttgtgtgtagaacatagtgttggagggagggagtctcaatgaggccagcaaagtaaagagggattaaatcttaaagggacccctatataaggaaagtgaactttatcccaagggtagtacaaagtcattaaagaattttaatctgggaaggacaggatctagtctatacattacaaggaaatcacttggctgcattatggtaagtgagtgaaattaggatcaaagagacctgcgagagtgctgttacagaagacacgtgagacatgacagcttgaactaaggtagtggctgggaaaatggagagagatgggtagattttaaagttatttagaaaactgaggtaaaggggcatggtaattgattggatgtgggaagcaagggaaagggaggaaattactattttaaacttggcaatagcaagaggggagcagataatgaactaaatatattgaatttgaagtgcttatggaatagcttatggaatagctaagtgaatatatcgagtagctgaacaaataaattcagagcttaagagattggcctacacatgatatataacttcagattctgatattcacagataggtgtgtcatgtggtacattatctgagagtagtgtattaggtgggaaataaaaaagtacaactgtagcaacttcttcactgagcttatgataaaataagggctcattctttagaaaaaaatcaaagactatatacaaatgagtaatataatttgattttacatttttaatagaaaaatataaaacactgcatttactgcttttggaatttgagtcaacagtatcaccaaaattacaaagcacagacagatttacaggtgaaattggttaaatcttcaaagaagagatcattttcaatgctatttaaactcttttcaggcaatgtatagataacataaaggaaacttttaaatttattctccaaaaccaacataatacaccaaaacctgacaatagcaagttcaacagaaaaaaaaaaattacagatcaatatgccttatggtgaaacacctttgtaaaatgttcagtacaatattaaaataatgatatagcattgacaagtagggtttatttaactaagactatttcaaggttaataagttggttactttaattaaccacattaatgtgtcaaagagtaatatataatcctctcaatggatgccaaaaaaattttgataaaactcagcaatcattactgataaaaacttggaaaaaaaccaaaatcatggttatatatttatacattatactcattcccattaatatcagaaataaggacgcccaccaacaccacttttatttaaccttgttctagaagtacccaccaattaaaaacaaattagacaagagaaaacagtacgaagttggaaataagaggagataaaatggttactaactgcaaatggtatgattgtatccctttaaaaccctaaagaaaaactactagaaacaagagaattcatcaaggtaactgattatgaaattaatatacaaaatcaataacttttccatattgcccagagttatgtaggtaacaaccagaataattaaaaataaaaagctaaaaattattgtatctgggaaggggacctgaaggtggagaaggggcaaggcagaggttgttgcttttatacttctgtactatttgattttttgctgtatgtgtgtatcactttgacaaaacttacgaagcttcataacattggtcattttatagaaaaatagaaaatcctattctgagaaaatatactagaaaaaagtcagtagttttcttatttacaaataataactagaatatagaagatcccaatttaaattgtagacagggataggctatatgaaaataaacttagaaagaaatgcgtaggaccacgtgaggaaaagtctactaaagaatagagcagaaaacattgtaaatatatttaaatgtaatgtggtctcactcaaaacctaccagcgtttggccaggcacagtggctcacgcctgtaatcccagcactttgggaggccgaggtgggcggatcatgaggtcaggagatagaaaccattctggctaacgcggtgaaaccccgtctctactaaaaatacaaaaaaaaaaattagccgggcctggtggcgtgcgcctgtagtccccgctactccggaggctgagtcaggagaatggcatgaacccgggaggcggagcttgcagtgagcagagatccacgccactgcactccagcctaggcgacagagtgagaccccaactcgaaaaaaaaaaaaacctaccagcgttcattttggaccttgatacacgtttattgaagtttatctggaaaaaaaccctcaagaatagccaagaaaactgaaaaggaagagttgggagagcaagggtgtgctgctttactagagaacaaaacatactgtaaaactgaacttgtcagacaagttactgggccaggaatagtcagaggagcgaatagagaatccaggcgtagatgctaatccacataggaccatagtatatagcaacagtgagatttcagatcagtgggtgagaggatggattattcaataatgatgtagaaacagtttacatccacatttgggtgggggctatatatatatatttgttgatgtgtatgacatctatttagaatgcttccttattccttacaccaaagtgaatttcagatggatcaaagatttgaacataaaaatttgaaacagtataaatattaggaaacatggaagagtttttctttttaaaaatcttagcatggggaaagcattttaacttaaaacctaggttaaaagattaatacatttgacaacataaaacctactgcacagcaaaaaatctgtaaattaagacaataaaaaagtgggaagaaattattttcaacatagaactataaaggaactgttttcagtactacctttaaagctcttttgtacacatctgctgcacacagcagcacatgcctgtagtcccagctactcgggaggctaaggtgggaggactgctagagcccaagagtttgagagttaagccacacagcaagatcctaactcttaaaaaagagaaaatttaaaaagctcttatgcatcagttaaaaagacaacccagtagaagaaatgcaaacgattaagggaaaaaaagaaaaaatattcaactttattcatgcaagataaaatattttcaccttttagattggcaaaaactacaaaatttgataatagctggtattagtgagggtatgagaaaacaagccccctccaagacagttggtaggagtataaattggttcagaaatcagtttggaagtatttatcaaaattaaaagtgtacatgttctttgacttagcagttccacttctagaaataattctacagagaaactcattcaagtgcaaaagagtgtttattgctagtaaaagcaagaaactagaaacaacctaaagctcacagttggagatccgtaaggtaaatacagtgcatatatgtgcactgataaaagaaaaatgaacaagatgtagaggagtaagttatcatttgctttaaaagattgtgtgtgcttgcatatgcatagaacatttatgggaagatactgaaaaatgtttaacagtatgtctaagaaatagaacagaggtcttcagggaatgggtggtaaggaaaagagactgtactcttcattatatatttgttcttagtgcatgtatatttttaaccatgtaaatagtgttctttatttaaaaacagtattttaaagtttctataatgtaaatttttatttggtaaatctaataaattacttaattccatatcatgccatctctaaaatcttttggaaattgcctcccctctgtcgtgctcattaataaaacaatattaagagtagtaaccctacttacttcagaaagtagttgtttttattaatggcatatgaaagcaatttgagaaccataaactaatatggaaatataaggcattctaaggacagagatgaaaagggaaggatataggggaggataaaggaaagaggaaaagcagaaagaaaaaggaaaaaaatactcagttgggttctgggatagaagtctgataagaactttttgacatcctgtcatttatttgaatgacttgttcctcaaacccaacgcgcacatttcatgttttttttagtttttttttctgttttttttcctgtttgatagctgtcagttatagtgattggtatttaatacaaaaaaaaccaaagatatgaaaattgttctatattttaatctgcaaattgctccattaggcagatttaattatttgtggatttacttatggtgcttccagatatcttgtacctcttaatgtgaccatcagaaaacttgactgagaaacatttgtactatacaaaatacaaaatgctttcagtatattattgcaagtgcttcttaaaaacatatagtattgttaaatgtgtactttttaatgttgtcttgtttaaattggaaaattaaccaaatgttatccatttaaacatgctttataacatattaaatgtgagtgcttaataagtacttttaatgatactggtacgggtgttggaacccagtcctagtcaagagtctaaatcttcatctctgtttttcagacaaatgtagtaggacattctttaggatgtacttggcattccttgaggaattctcctggtgaaaagatcaacttactgaaaagaagcctccttagtattccaaatacagattacatccagctgcttagtgaaattgccaaggaacaaggttttaatataacatatttggatataggtatgatttttttttctttggctttcccaagacatgtttatttaaaaatgtgtttgaggaacaaaaatgtgtttgaggaataaaaatttctattacaatttattttattgatcagggattctaagtatatataattactaggccagtaatatatataattgatatgtcccattcttgtggatagtaataatagctaacatctatacagttataacaaaaacaacaatagcaaagatagagttttactgtgtgccagacactgttctaagattacacgtatctacttactgaatcctcagactaactctatgaagcaaattctgttatccttatttataagtaaaggaagaaaggcacagaaaggttgagaaacttgcccaagatcacatagctagtcagcggtagagcaagatttggggaagagtcccagaagataccctggctgttaaactagccctgctgggcaaatgaaaaggcacctacatttctagcacaagtacaagtttgtggtgcccagaccttttctctctactttgtcactgtatgctgattctgggaggtaaatggaaccaagtcaatttatagttttatcccatctcagccatcatcatctgtattttctctagcccttaatcatttggatagacaaatatggacagatgggaaagcaagtcagtatggattttcttttaattcaatttatagagctaattagttgtgtgtgtttggtgtcttgattttttttttttttttttttttttgagacggagtattgtttctgttgcccaggctggagtacagtggcacaatctcaactcactgcaacctctgcctcctgggttcaagcgatcctcctgcttcagtctcccaagaagctgggaatacaggcatccaccaccaagcctggctaatttttttttttttccccaagatggagtcttgatctgttgccctggttggagtgcggtggcatgatctcagctcactgtaacctctgcctcccaggttcaagcaattctcctgcctcagcctcctgagtagctgggactactgctgtgtgccaccacacccacctaatttttgcatttttagtagagacggggtttcaccatgttggccaggctggtctcaaactcctgacctcatgatccacccacctcggcctcccaaagtttttttttttttagtagagatgggagtttcaccatgttgaccaggcttgtctcaaactcctgacctcaagtgatctgtacacctcagcctcccaaagtgctgggattacaggtgtgagccaccgtgcctggccaaagtatcttgatttaacatgtgtgagaaattttatatccctatccaaccacagaaagatgtggggaccttgcttgtcagggtcccctgaccctgggaaagtagggcacttaggggctcaaagaactcctgatattctgtgctactttgggattgaaggacgggtgaagtgcattgtctcagtaaaccaataatgatgcagaacctgggaagtcagtgcagacagatggttagaaaaggtggctgatgaaaaattagctgggtgtggtggcacatgcctgtagtccagtctactagggaggctgaggtggggacaatgacttgagcctctgaggttgaggcagcagtgagccatgatcatgccgctgctctccagcctgggtgacagagttagacttgtctcaaaaaaaaaaaagaaaagaggctggaggccaggtgcggtggctcacacctgtaatcccagcactttgggaggccaagtcgggcagatcacctgaggtcaggcgtttgagaccagcctgaccaacacggtgaaaccctgtctctactaaaaatacaaaaattagccagacaaggtggcgtgcacctgtaatcccagctactcgggaggctcaggtgggagaatcacttgaacccgggaggcagaggttgcagtgaaccgagatcgcgccactgcactccagcctgagtgacagagtgagactctgtctcaaaaaaaaaaaaagaaaaggtggctgatgagagaccattcatccaataaatatttattactgtctacagttcattgagggtttagaatacagagatgaacgacccatgtcatgaataggactatggaggatacagaatctgggggaaaaaaggaaacccaagataaatttttagattatgaattaatgatgcctctgaaacatttcttcccagttttgagaactaaatagttcttgtagatatggaaagccatctaaaaaccacagtctgttaatttggctagtttatatgcagctaccttcaaaagaacctagatattctccaaaggagatatacaaatgggctgggcaaagtggctcacacctgtaatcccacccctttgggagactgaggcatgagcatcgctggaacccaggagtttgagaccacctgggcaacatagtgagagcctgtctcaaaattttaaaattaaaaaagaaaaatgaccaaatgaccaaaaaatacatgaaaagatgctcgatatcattagtcaatagagaatgcaatcaaaaccacgataataaggtaccacttcaaatccactaggatggctatcattaatgaaatggaaaatagcaagtgttggtgatgatgtagataaactggaaccttacacgttgctggtgggaatataaaacagttcagcctccatggaataagcttctcagttcctcaaatgaattgccatatgacccagcaactccactcctaggagtataaataaaaaactggtatttaaacaaatgcctatacacacaggtatctgtatattcatagcagcaccattcacaaaagccaaaaggtagaaacagcccaaaacatccatcagtgaataagtggataaacaaattgtggactgtccttccaatgaaatattattcagctgtaaaaagaaacgaagttctgatacattctacaacatggatgagcctcaagcagaagctggagggtcaggagaaaagaacctagatactagaactagaaagcctctttactcattaaataatcccattgtatctggatattttccactaaatagagtatcaaaaataacatttttattatgcctacttcaaataaatcataccgcacacgtttctatttcttcctctttgccctcatttcagccatctttagtaagagtggctcatcagttgatgggaagaacgtttgtttcctgggtcaggtattgtttttaaaataccatgacccatttacagtataaataaagaactagactctgcacagacttaaaacctaggaacatgaatggacaacagcataaatacatacaattattatgtatcaattaaacatttttttttaatagaagacacaagggaggttttgccttgaccgaagttattcctggttcaaatgcctcctgaaaatgacttcctagtggaaaatacaatctctccagtcctctagcaaatggttctttcccttttgagaaagttactgtgtggttcagtaatttccaaatagtgttcaactaactatattagaattgccttgggagctgttatttttttaagtgtaggaatcagccacccccaactgtatatttctgattgagtgagctagagtgcagcctagatatctgtatgtctttaacactgtcagatcattatgaagtgtaatgtgtttgaaaactgctacagctgagcagttgtggttttttgtttgtacaagcaaaacaaagattgcgagtggtgtagtataccatggaggcttaaaaagaaagacaataataagaattgtattgtttttacaaagggatccactttatacatattggacattaatcgtcatccttgaatgtgtcattacagatgaactgagcgccaatggacaatatcaatgtcttgctgaactgtccaccagccccatcacagtctgtcatggctccggtatctcctgtggcaatgcacaaagtgatgcagctcacaatgctttgcagtatttaaagataatagcagaaagaaagtaaatctggagcaacttaaaaaatctttcagtagcacataaaaagttcccctctggccccttcccaagtaaaacttttaccgtagtgtttatgtcttgtttctaaatctcttcatagattccatcaacactccagatttaattatctcctcatagttgttattaagctctttttaatggcttcaactttgtatcagtatactgtatttataaactttgtaccacaagagagagtgtagcacccattttacagtgccatgcacatcagagaaagaaactgcatgtttgttgttgatgatgaaataaaaatgctagcgacagtctttcttactggtgcttaagctcttctttgcacaaagctttataaagggaattcaaaggaagccctttagaattagagtcttgagggacagcactaacaggcctttattaagtatgattgattgttaaatttcagggaacatgattggtctgctgtgtatttgaattcatgtaacaaagaactgttacgatgggattctgctcattttattaaaaagctactgacttgactgtcatcctgttcttgttagccattgtgaataagattttaatgttgataattctgttatttacatatctctaatttactttgaaattcaaaggtgaaaataaaaaatgatggcctaagtaaaatttacaaacatacatgtaatgggttacttccttactttctctaagcgtatgcaaccttgtatttttctttgacataaccatacacaggtgaattactagtttaaaaagcatttgaccatgcatgttggctcatgcctataatcccaactctttcggaggccaaggtgggaggatcccttgaggccaaaagtttgagaccagcctgggcaacatagtgagtccccatctctaccaaaaagaaaatcaggtgtggtggcacactttgagtcccagctactcaggaggctgaggtgggaggattgcttgggcccagaagatcaaagctgcagtgagctaggatcacagcactgcactccagcctgggtgacagagtgagaccctgtctcaaaaaaaaaaaaaaaaaaaaaaaaaaaaagcgttagtagaattacccaaaaaaccttcccagcttattcagttcagttgcaagaatgttccaaagtgatgagtgattaaaaggttaggaaataagtctaatgaacagattttaaccttaccttttgtgtttccatatataatcttgtaacatctcaagtcttccatctgtcagcgccggctcgtgctagctttctacattaggtggaagtctcagctctgtgtttggagtgcagggaaagcttcatagaggaaacatgaatgaaggtaggtctcatgtattcatacagaaggaagcatgtagcaggtatttttgtctggaaaaaaatcatatctggaattctttgagaacaaaactacaaaataaaggaaaaccagtacatgtaacttattttaaattctaaagagcacttaccatagttccatattctaagctccatttgttaaaccatagaaacaggtacttttttggcaaggtaaggaatagacttaaaagactggaaaaaaaactaggcataataggatcttgtgactctttaaagactgaactaaggttttagtaaatggtcttggatatgggggaggcacaatgaactctccaagatgacattagacttctgcatactgaaatcctgacttggataaattgggggaaaatttcataaggctgatgaaaaggatattacgtggttgtagacagtccgtatgtattgataaaatgaggtctgaggataaggtgcccagaagataaaattgctgctgcctctgctttccctgcttctggctctggaggaaagtgcattacactgttcgaatgtcacttctcagactatccagaccttctagggagttagggattttcttggaccatcaggtgtattctttaacaccattttgtttagccctctgctaaggctcttaaccaatctaattagtcaaacttgttaaatataggttaatttctcaaataggctcaacaggtaattgtgtcatagtcatcttcatagtgtcagttctaacaagaacatccattaagtgataagtgactttaaaagatgaggatggcaatagcacaatatgataatactaattcaataagttattgagcactaatgtgcccagcactatagcagcctctgggaatatgtgggcccatattgtgttatttgatgaagagccgctcccttgttctcggggtgtgctgtgatatgccacacagtccccttccctacagaggattttgttttctcgctctggcagtgtgcacccaacggccctcagctgtcagtagaattgccctcttaagtgaaaagagccacctcatctgaagtcacacttccttcttgggccaggctgcatgcaaagactagtcccattgccccatattagaacaatctgaaagaccatcctagcttcagagttccccttagtgtcagctaaggccacctttgagattgcatcatagtccatattcttcctccacccagtggagtttcctttctttccacaggtggcaatccaaatctcctacccactaatcttcatctcagcatctgtgatacttggtatcagaagggttgcaggaaagtaggtgctccagtg

SEQ ID NO: 16581 - DNA, 12438 bp, Human
tccagacttggggaaccaaagaaggcctcttggcccatctaagctgggaccccaaggatgaggaggtctttagcagaagaggagaggggagaaagtgaaggtttggggcagtgaaaatctgctcagggaactgaaggaaatatgaggtgtccagaacccagaatgtgagaggggacaccggggaagcaggctggagagcagagctggccaggcagggcatgctccccagtggcctggaaggccctgccggaggggttttcactcagttctgaatatgctaactttctaacgggcggtggcgttctgctttttaaacagcagaacaaagtttcctgtgaaagcacaacctgtaatgcaggtgagagcagagcagctgcaggggcagcgcctgtggccctgaggggagccagggaatagggtttaccgggtccggctgtggtctgtgcgccttcaagagagatgggattcagagcagccatcttcgtccatagctcatcactagcgggttccaacagtcaaagacactgccctcaaatgccctgtgaatgccttttctcctgcagcatccttcagaatcgcggttcagcactcactgagggagcacccactgtgggaggcctgggagtgtggatttgaagggcacagacccaggagccagactcacctgggccggtggcttgttcaccgtgtgacctcgggcatagtacctaagctctctgagacttctttttcccttctgtaaaatgatgatggaaccaagtcattgaatttttgtgaggatggaatgagttcatgcctagaaagtgctgaggagagggcctactgcataatggaggctctgtaggtggcatctcgtttgattctcaacaaaaacttggcatggctgccattaacctcaaatgaggagactgaggctcagagaggtgaagcgacttgtaagatcacacagcagaaaggtagaggagacaagagggagcagtcagatgtgggtgactgtgcgcctggtgctcttggaaggctttctgtgtccctctttaagactctctgtctgtatcaccgtcactgtcacttctttttcgtgttcatttgttttttgagttcccagttcccagcacagagccagacatgaggaggtattcagtaaaggtgtgaatgaatgaatgaaattcatgggtggatttgtacatccctagcacttggctgatgtccttagtgagggagtgagtgagcctccagcagcactgggatttaaccctgctaagggcctgtgcggtccccttagccccacccctggctgctcttagagggaagggctggcccaggaggccggagtgtggcttcagtgaaagtacagggcctgccaggctgctcctggggaagtccgcagagcagtgccggggcagccaggcctcctgtgggacttcctgccaaggcccgggcccagcccttgaacaatggcaagggctcgagaatcagagaatcaaaaggaaaagggcaaaataaaggtgggggagtgggcagaaaacgaggaattgcatgtggggactgaagagctggtacggaggacttgtgtggcctgggtggaaatgtagtcagaggcccaccctccaaaccccctctacatctccatgcccccagtccctggccctgagcatggcctagggtaacccttagggtctgtcagccttctgtgcatcccctccaggctgtcttccgccaggtggggtctcttgaaaacccccgtctgaccaagtcacctgccgcttaaaactcttgcttcccctgggtaatgggcggctccttggcctgggtgagaggcctactatgatgggctgcaggcccatttcccacctggctctctgccctgctcaaagcatctttattccagctccagccgtgctctggggttccctgagggcaggcacagaatgggtgggagtgggggctggcagtgggaaggagccagtgggcttacagtgttcccctttcctctccgccttacacagagccatgagaccccagatcctgctgctcctggccctgctgaccctaggcctggctgcacaacaccaagacaaagtgccctgtaagatggtaagatgctctgcccagacagggtgaggaccacccccacctccctgccctagggtgtgctagtgccccagccccagaagccagaagttagaagagtcaggagaggaaagggaatgtaccttgcatttaatgagcacctactagaatgtttaaacaccttatttacccacagtcctgccaggtaagcaccattattctcattttgcaaaggaggagactgaggcttggagagattgggccttgtccaaggtcattcagctgggaacagtgaggctgatattacactgtattcccccaagctgtccccacagagcagtaggcccagctaggggatctagaatatatatatatgtgtggggaatttggggtaggccagctgggaggggctcctctgtgctcatccctcttggagacaaatccccttccaagctgggctccttgacttgggactgcccgctggagtgcctctcacttcttagtgcccagatcaaatgctgccatctccaggaagcctccccagcccctcccaggctggcctagtctgatcacaccttcctctgggttcctgcggtccccaggcttccccctatctcaatactgagaagactgaacatgtggggtggttggtgaaagggtccaagcctgtctcacctgccagaccatgaacttccctagggcaaggaccaagtttgatttgcttctattcctttttcctgtcccaagccagggaaactagccctaaagttcttgtgactctatgagatacagggcaaagagaacacctagatccacttgtaaggccgggcagtcactgaggccagagcctggctggggaaagggcagggcctccggaagcccctcttggacctgagactcgaagaagcttatgacacagaaccggcagctgcttcaggaggcaggaagtgcaggcagctgcctgcccgcagcccttccctgggggtgcaatgtctcctgttgccaccacctttcttgctcttcagagcccttctaagattcccggagcccagaattgcgggcagagaaggcctcagatgtcaccaaatacaaacgcacattctacctcagggagacgaggctcagaggggaaagtccttgactacccaacaggcagaggggaagcgggtgaattttggagtctggggaaatgagataagagataggaaagcactttctgaaccagcatgggaataatacacacgggaagtaaggagaagatgtgtgacccaccagggacctacaggattcgaacccagctgcctttgccactgttcactgcctggtgcctctccctactctgctttcctcccatgatcaggtggtgaaatggagttggatggcaagtctttgcttctgaaaaggaagctgggcagtgggtgtcctgatagcccaggacagtgggtgggagctctaaactctggtcaagggccaattcctccaattccctccgacggtaagtcaggcaatgctgggagctcagagctgaaggaggcatgaagaccctggaagtggagctctgagcaccgccctggacttcaagcttcttcctggactggactggagatctgggcatcccagtgcagccctgcccaccatcaggcccccaggcttctagagcaggggtcttgggcccctgaatggaaagccagtcttgggctgtgggcttggcaaactttgtgtcctggatcaagtctcaggggctggtgccccagggagcctttgcctatccagaggcagtatgcctctgcacttgcccgggggtaacacgcggggcacagcacggtgccccccacactgtaacagtcagtaagtgggtccatgatgctctttgctgtgctgaccagctgagggcccagtggtcagaacttggctggcaccaataggaaaaggaatttgcaaatgggagttttgagcccctgactgtctgatcttgggcagcccactccccttagcctcagtttcgttaggggtacaataggaacagggtgaacaatgcctgggaagatttaatggggtagggggtctctgcactcagcacgcagcctgacacagctggggctccatcacaggtcattttgttgtttctgctttaagtaaggaatgccccagggggtaagggctgtgaggaggaggctatgtttagtggcccctgcagacagagaggttgtgagggaggaagggcaaggatgggcaaggcagctgggcaggtttcaggttcacacaggtgcccaactgacggggcatccctgggcctcctgaggcccctgtgaagctgcctcccttggaggctacatggagtcactgtgctgcatggagtaagaagagccacacggaggcctgaggctgggcaggtctcttcctccccctactcaccttggggctctcaggaggaagcgcagagctggaccaggggaggaacacaccggcttgtgttccctccctaccagctcagccactggctcactgtgaattcacgcaagtcactgccatcttcaggcctcagtgttcacatctgggaagtgggtcagctgaactcttcttgctctacccgtctttgactatattttgaaaatatcaattatgcattttctttcctcctagagaagtgattgattcagtgcctcagacctttactaaactgatgatgtctgggactcattcattaggaaaaattgacttgctagtcaggtccaaggcatgcacatccaccaaaccagtccctgtttgctctgagctcgctgtctagcaggtcctcacacacacagccacaattcagcggggcaaagctctgagaggaagcacagtcagggagggctccctggtggaggaggccctgaagctcagtgtgaagagttcatgtgtggatctggttggggatggcataaccagctcagggagcaggccccagcagtgggtgtgggagcgcatgatgggcagtggtcagctgtggtcactgcatgtgggctggggtgggaggtgggggacaggttggcaggggctacaaacagcctcgaaggccctgctggggatcctggacttcaccgtggagaagtttaagccaagctgcctcattgtcagagtagagcttttgagcagttgtcaggcatttagcagtgagtgggtcagaacgggttggcggagacagaagctgggggcggtgagcctgagcccggtgattgtggaagtcagacctttttctgggaaaggctggggttcctggaggcctggaagagaagagggagacctgcatttgcacaggaagaattttggtcccagaaggcacatctgtggaagaacaagagttcggccttttgttgttaaaaaacctgggttcaaatcccagctctgctcctcaccagctgggcaatcctggcacctcccttcccctccctgagcctagatttctgtaaataggggtgatcgtatcagatgggcaggctgtggtaaagaccaatgggaccatgggcctgaaagtattaaccaagatgtcaaatgctgagtggctgctggggaagaacgtaagaaaacagagtggttatgtgacttcctggaggtcgcacagcacaaacacagtctcatcaccaaagactgtggatttggctctggccatcttttccctggcccttcccacctccaggggcccggtcccctgacccagcctgggaagaaagccacctcctaggaggtaacagcaacagagaggaagccacatctcggaagcatccacaaggaaggcaggccccaggacccaggctctgcccatgacacgagagcctgaatgaggtctgaggcagggaggccaagataaaaactgatgacagagcacaaattacagttttcccttttggaaacatttctcccaaagtggagaaattcccatctaccaccagaaatttaactatctgtgcccatagaagggacctaggacatagaatcaggagccctgggtcccagctctgccctgctgctcactggcttggggtcactctgtgggatatatggctgtttcctgtaagaggggtaataataagtacagggtttctctttgttagtttatttgtccttctatctgtctatcatctctccatctgtccacccatggaaccttcatcgagttccttccttaatgcccattactgcgctgggtgcccgagatggggcagggagccggatgggtcatccaggcatggggtgatcaggctgcggtgggggaaagttgagcattctgggagtccatgggagaagggttccccagccaggcagggttcctggataaacatgtctggtttcatcccctaccgtgcccacttatgccagctgtctccccaccctacccctccccaggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctctcttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaggcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagcagtgtggctgccagcttcctctttgcaatccgcttcattgcgtccactagaaccctgccgctcaatcccattacggtcgttcaatcatcatggcaaatccctggggacactgagactctgggccagcaccaccctggaccttgaagccgcagccactagcatggcccctgctacacctcttgccccacactcaacaggcgactgtgctccccaccccagggctgagaggctgagggcttccgtttgtttccttcctgctacagctacaggccccctccccttctctgtgctcagccctctgtgccctatctcagaggctgcactgcccctcctccttggggtccccagccccgtcctctctcccttaccccgtcatgctctcttctgcctccagcctctccctgtttacgtcttcctctcagacttcagctggactcaagtcttgtccgtcttaaaaatagtgagaagcccctcagccactttccccttcgtcctcccactcttcacaggccagcttcttggtaaagtcacttcccttcccgcccctcccgttctcaacccgcctggagctgccttcagcccctcccagctccatgctgcccttgctaacagcgtcaagggtatcctttgccaaactcagcacgcttttcagacctcctctccctaggccctgtgcagcaggccccccacccatacccctgctgggcatgctctccccacagctgtgatcccacacaggaagccatctcctccctcccaggccactccttttcaggccactctttgctcatcttccttgagccagctttaagtggtgatggccagggctccatcctaagcccttttcccttgggaacactatggcctcattgctgtaaacaccccattgctctgatggcccacatctctgtctccagccccacctctcctgaaagtccaattctgctacccagaggccttcccaggtagagggctaaaggtccccagggactggagaattcagtgatcagccaggctgcagatcaaggttgaacttggaagaaaaccacacctggttcctggcttggagttggagggtgagtgtcgggtgtgggacagaagcagcctcacctgggtaggggagcactgagaggcgtgacaggccagggcagagcatgcagagcagggggtgcttattcctctggccctcacaccttccatttcgccctgtcagcagcctggcactgcgcctttgcccttcccttccctgactgcctctcccccaagctcctgctcagtgatgcttctcctgcccaccccgagtcagcctggacccctccccttggccctgcagcccctgggcccagcgttggcagctctgcctcctggagattcttccgtttctctggtccgtgccctctcacctccccattcctgctcctggctcccagtctgcaaagggaaattctaaacacctatttcatggggtagggctgggggagaaaggagagagccccaccccctggcacacgataggtgctccgtgaaggcctaaggggaaagcaggagcttgggctgagctcgcctagggtctgcgggcctctgctccagcagggagcccagcaggcccctgaccccttttcctgacaaacagggagtttgctcacctggccaagacccccggtgaggcagaaattcctgttttcagccaaacgtggacacagcagccaactaggtcatcagaacatccagcttcccgagctcttagcttgcagggagaggggaggccctgccactcccaggtcacagtcagcctgaggtgcagggcccaactcctggggttccatgcgctggcgtggcactccaccaggaacgggtcccgggacgcgccagcaactcaccctctcagacccacaggctggccacatcctccaggatctgggacccaccgtctgtgttctgtgcccctgtccttcaggcagttcactgagcccatgaggcccatctctctcccgccac

SEQ ID NO: 16582 - DNA, 13852 bp, Human
cagctgagagatgtttgtaaccattcccatttcccccgccacacacacacacacacacacacacaaagcttcgtcctttacaatttatttcttccttagagtttggatcacttctacctgtcacacaccatcttccttacgatcccagcatcactgggatgtagcagggaactgacgccatcctgtctgccttccaatgtggaacaatggcacacagtagagcatccaaggtacatcaacagtgacaaagatgacttgaaaattcacagggacatttgagtgggagtaataagtttggtttattaagcttgtggcttttcttaatctggctcctccttatctcaccttctgctctgacaggaagtcactgctctgcgttggttttgttcattctgtttaacatgtagaaagctttactgttgccacacacctgtacaaggaaagcaggttttttataaaattctgtgttctgggagggtactcattcacatacaacttaacatacagggaggtcaggcaggtgatttggtctaggtcataagctgtgttgccttgggcaaattacttagcctcttggaacttatttcttccattgtaacataagttgtcctgctttcctcaaagacatagacatgaaaccataaatgatcatataaaaagaattttggaaataaggtattttacttatatattattaagttataatgaataatacataattatagtattattttttattattcctactctttgtgctagaaaacaatttgaaaggagtctcttgcaatctgccgagcataatagctctggattttaattctcctttctaaaatgaatggaagataaaatgcatacctcttaaaagaaagatctgttgatttaatgcaaattttgatcagtgttactaggaagtgattggcattctgatgcgtgatctgtttgtattcattttatatttgcactgctgatcagtgtctggcacaaacagaatcttgtagaatcttgagtctaataccttttgtattgaaggcctggcaatgcattgtcatctgttcctgggaagaattacaaaatgcagtcctttatttttaaaagacattattattaagtccctggaaaaacacatggccattttcaattaaaaatgagtaaaagagagactctgaatcaaaaatagttgccaatgttcacctttaacaacattatgaaatctcacaaaaatgtaactaaaatttaaccaaatttgggcaaacttagagaaacgacatgagtagggatgtttgctgcaaaacatatggttttctctggttggtgctcaggctttagctaagccacattgtgaagtaaccataatctgtgcaaggtccatgtctctcttcatcataaatctatgtccaaatgaaaaagagagaagaatgaaatatgataggcaccattttgtgccaggaaaaatagtaagtattgcttgagagcaatggacatctttgaactctgtctgcaacttcattacattcttatggcatggatatttttcatttataaatattatatacacatatagtataaattttctttatagcataagtactctgatacaggtattagagatggtatctccagatatgagttctttatggcatacatacctctcccaaaaaagtgctaaaagcaattagccggatgtggtggtgggcgcctgtagtcccagctactcgggaggctgaggcaggagaatggcgtgaacccaggaggcagagcttgcagtgagccgagatcgcgccactgcactccagcctgggcgacagagagagactccgtctcaaaacaaaacaaaacaaaaaagtgctaaaagcacagacctgaaagtccccaaactgatacataacgtttacacctaggtgtgaaaaaaaatcttacccctagagcacctgtggtgagaaagtcaaaacttacaagaacaaaactcagtcttcagaatcttcttccttcatcacaggatcaacacatttcatctgggcttcttaaatctaaatctttaaaatgactaagttttcttccttttctctgtttttcctaatagttggggcttatatgactcatgtgtgtaagtatctcctatatctacatgtaaacattaaatgaatttctactgactatattgttatattatagatgaaaattattttcacaatcattcctatctttctgaactgtaatgtattatacaaatttttcatcagtaaaattattgtagcttttaggtagggttattgttgttttttaagctttgaaaataatatagtgactgtcattggaagaattacatgaaacagtagtttagatcttttgtgtgaaaccttttggtctacttttgtaggtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtgagtcctccacacttttccagacatgtgttttttctgaaagttattataggtacaagagaagcttacctctcctgaatgagaatttgatctactgttagcttctgtggttactgaccaactggtggcgtttatttaccttcttccacatccacgctttctgtcttgggttttccttttcagagagaactgagctgcttttcccaggcaagacattagacaaattcaagtcctctgtataatgcagggaacacagcaacagtaatacttgaagcagcagtactcttgaccttgttagatcacactgctcaaaaggaaatcagacaacctgagcttgctctgtgctctgagcttccccattttacaaaggggtaataatcatatcatacctgctttgtgggttttgagaattaaatagtatctgtttaagtattttagcatgcttggcacatttagtaagcacaaaaaaattgcagctattatcattagtattatacgcatgagaagcctactttgccactcctaacagtagctacctaacagtagctactcaccacttacaactttcctaggtggaaaaaaacaagttattgatgacttctagaaagagaaagataatgagagagttattttctaggatacttagaatgaaagcttttctgaagacagagtaaaaccttccaaagtccatttcagcctaggattctcttacttcagctaataaagcacaaaacccctcttgggatgctgcaaccatcacaaaaggaaatgccagtagaaaactaatttggtatttgttgttttgtttgtttgcttgggtttttggttttgtttttttgtttgtatatatgtttccttatgtttcttacctaataagctgaaatggagccttctccttttctttcacttaaagatctctcttagctgtaatggtttgctctccaggcattgtctatatctaaacagaacaattgaattgatttgcttttctatgctttgggggttttgtctgattaccccatttaaatggaactgtttgatcacaaattggaagttttgaagcctgcaaactgggagatcttctgctatctctaaatagcaagccactgatttccaatttaatatggttacttcatttacacagggttcttgccctcacagaaatcacactctcatccccatcacttctctcttctccagggcatttgccccctcgagatcagagagacagagtggggaactgtcagcgaatgttcatttgatgcaaaatatgcacatcttcaaatatgctcataatacacattcaaatggtctataacctccccagacacagagcttgacttctaaatgttcaacaaactttggatggaaagaaagaaatacactgaaagatctttctttctttctttctttctttggctaggcctgaaacatggtgtatgaaaaagtgcttcactagccataaagtgttataggaaattaaataatatcactaagttgaattttaaattttgtcaagtggatttaactcacgagaagcggattcccaaattggggaaagagattattgacaaaagactggagagaggtcttggagttttttctgttttgtttttttttttcttaaaacaaactattgctaaatatcattttaaatggctggggtataaagaactgcaaaatatgtagatcaaatttcctctacaggacacttgggtgtaaaaagtaggcagatcggtggttggaaaaatattaagctttatgaaattcaaaatatttacaaaatagctcaatggtggcttcccacaaatgtactccccagtatcctgtgggaatagtttgccccaagcctctctctcagcaaaattttgaagagggccaaacctgggagtgctcccttctcaccagccatccacacatctcctccctcaatattctggcccctttattagttgccatgtcaaatataaaaggaaattgataaaaaatgtcctgtacaaacttattttcagcattttaacttaccagaagcaaaactctcaccagctgttgtaccctgttctcctgattctctcccaggcccctctcacagagcacttcctcctgccccaacctgcctagcaagttgttagatggaaccttccacagccccttccacatggcctcactccatctcaaatgctcaaggctcctggaacaaaatggttcaatgttcaggctctagattcaagccaactgagctttaatcctgcccgaatttgcctcctggaggcaaaggtcctcaagtttattcgtttacctgaacctcaatttcttcatctataaaatggggattgtcataatacctatctcaccacgctgttgtgcggtttaaatgagggaagctttgtaaaatgcttagcacagaacacaaagaacttaatagatgttatcgagtattgttatacaattatctgtgccttccatggtaataaccaaggaactaatctgatgttgacgagataagactgggaagacctccctctctgacagccaagttcttctccctctctcttaggcaagagaaatctccaagacatagggaccctgcctttgctgccagacctcaaggggcgggtctaagcagaaccactgttgagtgtccaggcgcgctggcagagaaaagaagaggcttgaagggggttggcacggggttcaaagagggattgaggaaagagcactggactgggagtcaccaaaagccaaatttgggtcctgattcccctatttatgaggtgtgtcaccttggaccagtcagagaacaatcttttactggtaaggaatacacagcccgtcagctttaccagccttgaaaaaggttattgttaggctcaatggagacaatgtttacagatgtcttcagcagacccactataagccgcactgtagttctgctccatatatgaatctcttccaggaaagctcagggtgggactccggaaaccacattttaaaccaacacctccaggtgattctgaagcaagtctgaagactgcatttggggaaatcctgtgctgtgcaactgaaaaacactggcattattacttcctctttgtgtgaattcagacttcagtttagctaaggaggtggcatcccagaactcaagtaattccaggtaccctgtgggcagaaaatttgacctgagtagcacagattacagttgaaggatatctagaaattgaaaggtcagaaggaataatggtctgcttgggttgtttttggtcttaacatgtcccagtggagacaaaaataaccaaaacatttcaaaggcaataactagccgagtaaattagtaaaagacgaaagaaacccagacattttttcagcatccctcccttagtgagaatccaccctccatacctctcatttgtacctcatagccttctttgtgtgagtcatttaggcacgtgcccacctttctgttagagcattcatcctgaagatttttatgtcatccttctcctacaaagttttgggtttagtgggtatgttgaatttgaattcaaatcaatcctaggaaatccagtccacatcctatgagaaatttccacccggtcctgattttgcaataggcaaacttttcaacaaatagagctggaattcccaaaataaataaaaataaactcttttggtagaaaccaaaaagtggtcattccaggcagtcacagctctgccataagcaaacccactctaccacaggcatttgccattttcaaatctgaaacaatcatgtcttcctttttctgtatgtttctgtgctctttgtaacttttattaatctttattaatctatatgcatgagtatgtgtgtttttactgcaatctactttggtagcttttccaagtagcaaagaaatagttacatgtaaacaaacaaatacaattaaaagatctgaggtggacttcataaagatagacactgtaatggaatgtatctgtagtatacaaatggctctacggttctgccaaaatctccaaaaaattatttctactttatcactgctgtaaatgtaattttatccaacaaagagtaaatcagatcaattgtggcactgttgaaacactggtactagaactgtgtatgaccagagatttaaaaagcaaaccttgccaggcacagagactcacgcctgtaatcccagcactttgggaggctgaggccagtagatcacctgaggtcaggagattgagaccaccctggccaacatgatgaaattccgtctttactaaaaatacaaaaattagccaggtgtggcggcacaagcctgtagtcccagcctctcgggaggctgaggcaggagaatcgcttgatcctgggaggcggaggttgctgtgagccgagatggcgccactgaactccagcctgggaaacagagcaagactccttctcaaaaaaaaaaacgttaaaaaagaaagccaaaaaacaaacctatttcttcacctcactcaccagttcgtatcctctaaatctccccgatggaatggctactaaccttaaagtatcttcattttaaattagcactgttttcttaccttgaggaaagttttcctttcttgtccaaatctttgttctaattgaggggacaggacatatggacatatctgactgtcatgtaataggccttacttccccacattgacctgagatgaagtctaggcatgtgggtgagcaagtgtagggtggggatctttgtggtttttgtttgtttgtttgtttgtttgtttgtttgtttttaagagatggggccttgttctgtcacccaggctgtgacacttcagcctccagctccaggactcaagcaatccctcctgcttcagcctctcaaacagctgggactgtaggcatgcaccaccatgcccagcatgcaccagtgtgccccttaatgtttttttagagatgggggtctcactgtattgcccaggtttctctcaaactcctggcctcaaatgatcctcccacctcagtctcccaagtggctgggattacaggcatgagccaccacacctggctaccttaattattaaaacacttaatgttgggaagataaaaaaagttctggggttctggagatgatagtggtggatgaacaacaatatacatgtccttcataccaccaaactgtacattaaagaatggttaaaatggtaaattttaccattcttataccattatgtatactttaccacaataaacaaattttaatggtagttggtgtaaatctcaaactacaaactcaaggaatataatttgctttatttttacataaatgaacataattttgttttaaacttgatctaagtcaattaggatttcactcctttttcttcccccagttggatacaagttctgatattcttttgcaatgccagggaattggtttagggtgggattaagggcaagtcatttggcccttaatatcaattcatgctgggctccactaagacctttgtcactccacctaatcttaggcaggttaccttggagatagcccttgtttctctgtgtatacaaccctctcgaccatcaccactccccactgggggatttggaaatcattctgctgctttcattgtctttgctttttttaggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaaggtaggtagtagcattgtcttccttctattttgtcaacatttttatacaggatggctcaattagttaaatcacctacaaaatgcattttgctagcaccctccccatgtttgaggtgattatgatatattttataagggcccatgttattccatatactgtcttgaaagaaacaagaatttatcacaaatgcaccagggctgtgtttatacaaggaaaagcaactctgatactcaacatatgtaggaggggaacatcttaacaggcccaaggatccacactgaaagcttttctcccaaatgcttttctcattagcaagtaaaaaaatacaacagttgtttatacaacagagccaaccaagtgacttcgggggctcagcagtgagttacagcttagtctagaccacacttaatttagtccgaacttggtctagaccatactcaagggtcctatccggcaggaagcagcccagccctcaaagtcatgacctatggatgttattccacacaaaaccatccaatgcagggcaaaggccagtttgctcgagactgaacaaattcctgctctctataagctcccgccccaagcctcagtgagctcctcggggagtagagagcatggtcagaaaagcaacaaccacaaatgcagctgcaggccaccaccaaagtagatcccagaacagggacgcccgcctaagacagagggaccacacatacgacgcacaggctagcatcagaatactactgggaaagaaataattccatcttttttcaatctgtcagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaaggtaagaatctctctttcaaacaggcatcttggagcgctgtacagtagccaagcctctattgctcactgacactgaggaggagggaggggcatggagaatacaaaaccacaattctaaacactttctcttcattcctgcacagcattctctattctttttcatctaccaatgtggatggattgtaaaaacttccccaatactttataagcacccactaaatgtttgttaatcaggataatagaccatatctgacaacttttacaggcttcctatgagaggtgttatcctccttacaaagtctaccaaccctgaagtcactagtggtgattagaagataacttatttaaagaaccaccttgcagattaatcaataaggaggccttataagactcaaatgcaaaaagctcaaatatacagtatgtgtttcataagtaatgctgactgactgtcttcgtctgtttgggctgctaccacaaaataccataaactcggtgtcttataaataacagaactttattctgttcaagatcaagatcaaggcaccagcacatttggtgtctggggagggcctactttctggttcataaacagcttcttttcactctaatctcacatggtagatggggtgaggggtctctcttaggcctctttaataagggaactaatctcattcatgaagccttcacctccatgacctaatcacttcccaaaatcaccacctcctaatactctcaccttgggagtgaggattgcaacatatgaattcggaggaatcagactttcagaccataccactgactaacaaaaaggaacaaaaggccgggcatggtggctcacacctgtaatcccagcactttgggaggccaaggtggatggatctgttgaactcaggagtttgagaccagcctgggcgatatggtgaaaacccgtttctacaaaaaatacaaaaattagccaggtgtggtggcacacgcctgtagtcccacctactcaggaggctgaggggggaggatcacctgagcccaggaggttgaggctgaagtgagccgagatcttgccactgcattccagtctgggtgacaaaatgagaccctgtcttaaaagaaaaaaaggaacaagagtcattatgtttttcaaaatcatttgtttattgagatggtaaggaaaaaaataggtgttcatgtttgtatgaactatactaatatatagcacaaatgaattactaattttttaaaaattagaatacagtattcatctcatactatattaagtataattgggggagaggatatgatgacttcaaatgtcttgtgcatctgcagtacccaagaccatcaccctcctaaacatcggttatcatggttgaccaaagtataaggcactgcagtttgcaatgtgaacattagcaaagagaaaggctggtcttcaaatgtagaagccagctcttcatcaaaaggccatgccatcccctctatagctctttcccttcacttgatagaatttagttacatgctttgctgttagagtgtcttcaaaaatcatttcattcactaagtatttactaagtatggtacatatacataacactatgtccaaccatgtgaggatgcaaaaaataaataaataacagagaacatataattcctgccatgaagacatttactacaatacattgctcttttctgctagcctcaataacaactcgattttaggtctgtgagcatcaaaatgaaatctacaattttaaaagattattttatttcagtggattatttaaaactttatccattctttaataaatagtcaatagtcattgattcccagaggaatgtagacatagatagggacaaaacagagatatagacatggacactgagacagaggcagaggcatagtcatagtcatagatagagacataaacagagaagcaagtaggcagaaacatagtccttgacagagacaggcacatggacaacctataacgagtaagaggcagtgtcagacactcttctggacataaagaaagcaaagacccagatgataatcccttgagcaatcagcagttggtggttaaaaaacaaaaatatcccaacagcttcttaccacgtatttgccctttttcttccttccagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactctctgtttgtcttttatcacatgaagtaatatctgcccccattgcacccacactcgccaaagggcaataaggtcactgaataaaacagtaatggtaccaccttcaactaggtgtaacttctgctggatcatcctaagttgttgggttgttttcttttcattgttgtgataacattgaacatgagataggcccttgcaacaaatgtttaagggtatgatacattattgttaactataggcatgatcttgcagtgcagatctctagaactgcttcatctcatataaatgaaactttatgccagttgaatagcagctctctatttccccaccacccccatcctctggcaaccccattctactctaagcttctatgagtttgtattttttaaatataaatcataaatataaatatcctaattcaagcaagcagcttatacaaatatttggacagtatttcttatttatatatgtcatattttgttccagaaaggattgaaagcaatgtacaacaacgcctgcaataaaacaaaatgcagaattaaaaataaattgatgaaggtattgggacaatggggaaatgagagtaagaaagagaagatgaaggccggagtggtcacatggtactgatagtgccagaagtttatttctgtacatttgctagaaggattcaaatttggctctatgctttggccaacgcaagaaagagcaacacaatcaattatatgaattacagtgtccaggaaataaaaataaattgtttacccagaagtaggacccctggtgctggaactaaaactagagagaacttttttccacggtcctcataagaaggacgctgtgacggccgggcgcagtggctcactcctgtaatcctagtgcatggaaggccaaggcaggtggatcacgaggtcaggagatcgagagcatcctggctaacacagtgaaaccccgtctctactaaaaaatacgaaaaattagccaggcttggtggcgagcacctgtagtcccagctactcgggaggctgaggcagagaatggcgtgaacctgggaggcggagcttgcagtgagccgagatcacgccactgcactccagcctgggcgacacagcgagagtctgtctcaaaaaaaaaaaaaaaaaaaaaaaaaaagaagaagaagaagaagaaggacactgtgccatgtgtcccatatccccaccaactgcatcagaaccacctctaagattatttgtaatacaggttcccttgaccccttgcctagaaattcagattgaataggcttggtgtgggcctgaaaatctgcgtttttttcaaagcaactcagttgatgctgataaatgggcaaatctgaaagccactgataatgaacatccttagtgacttcttataataaagacaacaattgatgtgaagggattgttacaaatctctcattgtgaactgatggcttcagaccaaagtgcaattcagtaagatcactggaggatctcagctgtctcggactgtggtcgtccagtgattagagaagtaacagtttctaatttgggcggaggagcatggtgggagattggtgggggatggcgtcaacagtcagaagccaaaagattaatctcagcctctatatttaatttgagtttggggggacaaatagttctcgtttccaggcaacatcaagttctcttacatgcatatagaaatagatgcttttggtagtttgtttattggcttatcttttgtcatggttcttagaaacaattaaccagcactaccccgcactatgaatacttagagaaatggaagcactgggttaaaaaggcaacctaactaaaattattgagaataataatttttaaattattgagaaaatagtaaaagaaggttctttaaatatctcatcttgtgtcattttgatttattaaaagtatactgattatgagactacattttacaacaaaagaaaaggaaaaaattgtagattctctggacttattaaaaaataat

SEQ ID NO: 16583 - DNA, 11338 bp, Human
acatagtgttggaagttctggctacagcaatcaggcaagaaacagaaataaagtgtattcaactaggaaaacagggagtcaaattgtctctgtttgcagatgacatgattgtatatctagaaaaccccatcatctcagcccaaaatctccttaagctgatgagcaacttcagcaaagtctcaggatacaaaatcaatgtgcaaaaatcacaagcattcctatacaccaataacagacagagagccaaatcatgagtgaactcccattcacaattgcttcaaagagaataaaatacctaggaatccaacttacaagggatgtgaaggacctcttcaatgagagctacaaaccactgctcaacgaaataaaagaagacacaaacaaatggaaaaacattccatgctcatggataggaagaatcaatatcatgacaatggccatactgcccaaagttatttatggattcaatgccatccccatcaagcttccaatgactttcttcacagaattggaaaaaactactttaaagttcatatggaaccaaacaagagcccacattgccaagacaatcctaagccaaaagaacaaagctggaagcatcatgctacctgacttcaaactatactacaaggctacagtaaccaaaacagcatggtactggtaatggctgcacaactatgcaaatatactaaaatccattgactcatacactctaaatgggtgacctttatggtgtgtgaattatgtctcataaagttgttagaagtcaacataaatggaagagcaaccattcacataaaaataaacaaaattgtcaatgttttaagaatttttcagtaggtgtagttaattacaatttgacttttttaagtctgcactaaaattactcaccaaaaccaatagcagggtcctcactgctgttactgaaaatgattaacctttgatacacttgtaatatctgagaaaaagaaatgcaggggtctcagcagggctcccttctaaggtcacttgatttctaaagaagtaaccactaggtttgaagtcatcaggatgttaactatggggatggttggttcagtacccaacatcctgacagcacatctgaccatgtatattgtatcggagaccacatcctcagctcagaaaaagagctgaactcatttcaaatagaaagcacactgcatactgttcctccagggactgaggttgactcttcttagagtgagacattccccaacattggaacaaaaatgactcccacttcttttctcacctaaacctgttcagaagaaagtaaggaagaaaggcaggaagcaggggtcggggggggcggggagggagggaaactcggagatactttcagtatctaaagttgtgaaactagacaatcaggaacgcacaatcagagggctgaaaagggccaagagcccctaccctcctccagcccatgttcccacacctgccacagaccaggcaggagcacaataaacactcaccacaaagtggggaaggaaaatccaggcaggagcctctatgtaaataaatctccctcctgtcctcagcttgcacttggcctactaattcttatataatccaaggagacagctagaaagaattttgattggtgaccaattttgaggacttttattaaaattctaatttaagtcttcgagagtttccagtcatggatactacagataatattgcagatgatgaaagcgtcttcaaaatcatagctgagacactttacagtcttccctggtgtactctgatggcaacaaggtcccttgcccctctcctaccctgtagaattccagcgcccccctcagcagtcctagcaaaggaaagcctgcctgctggcagtgagccatcatccaccattctcacttatttggatttggtttcctaatgctaaactttgaaacttgaaaaaaaaaatgaaaggaaaccacatcctttttactctcagtatatagatagaggcagttaagaactgaaaacagattttcaggttgattgatgtgggacagcagccacaatgaggaactcctatagatttctggcatcctctctctcagttgtcgtttctctcctgctaattcctgaaggtaagactgattcttctcatttccattatgaccatgaagcaaaatggagcagactttcaatgaacttttggcaatattaccttcctatactgaaagaagatgttttcccccaagccttataatgtttagccaggcacaatggcacatgcctgtagtcccagctactaggaacgctgaggtggaaggatcacttgagcgcaggagtttgagtccaggctgggcgacatagtgagaccctgtctctattttttttttttaaatagcattctttcttggattttaaatatgtctgtattttagaaaaaaaaaatcttttcttctcataattattttgcaaaagatagcagaaccaccaatgcttattgctgccaatttgtaacttgaaaattgccaaaaaggacaatgtaaaaatgagttaacaaaactctcttgttcgtaaaacaaatagtaccttccaggaaaggaatagtggcaacttagtcagctcagcctttcctgctgcagaaaatgcatagataaagacaattaagacaaatctgacctagacaccaaaagtgaatcaggaattattagaatttttatacttatttctctggtctagagactctttggcaataaattaaggcgtgaggccagttccctcattaaccctttgggtgtgctatagtattttttattaagctaattttttgtctaccaaatggtaaccaatatttctgcttttgtgtgagttgagcatgcatgggttaaaatgctgtataattcatggtattaccactgaaagggtgacagctcttggggagctctagatttcccttgaagaacctgctaggaagtgaggactactctcaagctgtggcaatatggagccagccacggtttttcccaggattcatcagcttttggaggcagggacttatgtaataacctgccttgccaggaattcccaaagaactctggtttatcatatttaggtgcatatctggtttatgcacctaaatatgagaagactttgggaggctgaggcgggtgtttcacaaggtcaagagatggagaccatcttggccaacatggtgaaaccttgtctccactaaaaaaacaaaaattagctgggtatggtggcacgtgcctgtaatcccagctacgcaggaggctgaggcaggagaatcgcttgaaccagagagttggaggctgcagtgagctaagatcgtgccactgcactccagcctggtgacagagcgagactctgtctcaaaaaaaaaacaaaaaagagagagagagagaagaaatataaaaataacaaggctgcaggacatttgggacaaaggttggctatgttataagcagggcatagtatgactatattcaggcatgttaaatcctccataacagaaaaacacagggcagataaatccagccatatcttttcttcaaaggaaaacaacaaaagcaacctgctgtgctcctctttgtttcctgtgttcagagagggcagtgtgggcccatataaggaacagacagcaaagcaaggcacagttgaaatctatctgtacatgaatcaccctaggaaaattgggattgggtgaaggtcttttgtttctataagctctttacccttttgtttctagagcctagaatttcttcctcccagtttcctttttaaaagcagagacctctgctttttcaaatcacactagccacatttcatgtggtcactctcctccttgctcttaccctcatcaaatcttacgaaaggcttctatagctgtcattaatacttgcctgtgaatttggcaatgacttagtcctaattatggaacaagaggcactgtgccctattcaagaaaccatgagtctcagcaaaactattttgggagaatccaagaacatctggtgcaggaggtggagcactcggagtgtatcactaagacataaggttctctctatctgcatgtatggtttgccttgtgtttagttctcactgttccttaacaatgggtctctacttcaagactatcatcaaggaaatgtcacttaggcagaattcttggcatatggtatcttctctcttctcttccctatctcattggaaaagaccttagattaaaccccatggtttggtctagagattgaaggggaggtgcaatcgatgttattttcttaacttatgagtgagaacagtgcagtttaataaccaaaagtctcataatgaccaaaggactgaggggtagggtcacagctaaacgatgctaatatcggttcataagctatatttttgcaatggcttggggttaaaagggaagttatgaggcttctaaaagtcttatctatttcccccaaattaatagttagccaaaaagggtgggagcacttgaggttgtcactaccactggcatttcctgcagcaactgttgatggtaaagaccaaggcagagctttctgccctggggcctgaggttgctggtttgtgacatccagcctaatgatcctggaacagtcaatggcctcgcttctgtgggtggaaaaacaggaccctagagtccaacaggaataggatttgcatcagatgtctgcgggtctacatagagtaaaagcaggggaaatgctctcatccagacttcctctctgagtgcaaaaagcatggctggtcttagaaacatgactttgtgtagagctctttgggggtgagcaccaatctgatttgtctttttccattgaacagatgtctgtgaaaaaattattggaggaaatgaagtaactcctcattcaagaccctacatggtcctacttagtcttgacagaaaaaccatctgtgctggggctttgattgcaaaagactgggtgttgactgcagctcactgtaacttgtaagtgcctgggtttttaaaaaaaagtttgtaaagatactctaatttggggaaacattaataaaaagagtaggccgggcacagtggcttacacctgtaatcccagcactttgggaggccaaggcaggtggatcacatgaggtcaggagtttgagactagcctggccaacatggtgaaaccccatctctattaaaaatacaaaattagccaggcgtggtggcgcatgcctgtaatcccagctactttggaggctgaggcaggagaattgtttgaacctaggaggcagaggttgcagtgagccgagatcgcaccattgcactccagcctgggcaacgagagtgagactccatctcaaaataaaataaaataaaataaaataaaataaaataaaataaaaaataaaacaaaataaaataaaataaaatataaaataaaataaaataaataaaataaaataaagtagatcccactgaagccatgggaggttcatatgtatcttcacatcgcttaagtctttgggcacttgcttgagcctaaaaggaagttaggcccacacttgccacaaagaatcaggcaatgaggaagcagcatccacaagctctttctgtacatctccactgagccattgggtacaggtgctgcagagctttgcttctgtcatgactgcgtgaccaggtagaactagcctcagcatggaagggtgaaactttcagtgccccctcagagccctgggtgcaaccatcaagtacagaaagcttgtgtccaatgaccttcttgtatgcctccgtgaattcctctcacatctttggccatctcttcactcctgtcgaccactacattcaaacctcttcccaggcctggtcttttcctactctctaaatcaagcctctaaacctaggccattcaatatgataggcactagctacatgtagctatgtaaatttcaatcaattaaagttaaataaaatctcaaattagttcctcagttgcactagccacatttcaagtcctcagtagccacatgtggctagtgcagattcatagaacatttcatcataaaaatatgctctactggaaagcactgttctaaggtctttttcttttattttttaattatttactttttattgacatataatagttgcacatatgttggggatacatgtgatcatttaagtgagactaatctcagctgatgtaatggaaaagaggcagtgtgcataatctggttggtgtagtttatactaggttatgaatgatagccttaatccaatcatcagtacatcagaaagcattttgattttgataaccaaaatgaacctttaagagaaaaaaagactcctggacccctccttcagaccaccatcccttcaacacactcaatgccaagcacactcaatgccaagcaaatagggtcctccatggggcaatctgtttctgaaagttttcccatttgagtttgttgttttcttgaaaagatcccttcagtgcattactttacaactattggctgctttttgcttctgtctctggactactgagatctttgcttcccatcacagctaataagtaattctccatcacagctaaataaggcaggggtagggggcagataagcacaagacttggctttgctgccatggaattctcttgtttttcaatgaacctagtttagctttttataaataagctggtgatgatgatgatgacgataaattcataaacattcttttattcataaacattcttttattctttaaagcacacattttctttctgagccacaaagaaatctccccacctccatatttacaaatgggacaatgaaactgatcagtatatatgctcaactgccaatacaaagaataaatccagtaaataatgttgtgtctgttctcaggaacaaaaggtcccaggtcattcttggggctcactcaataaccagggaagagccaacaaaacagataatgcttgttaagaaagagtttccctatccatgctatgacccagccacacgcgaaggtgaccttaaacttttacaggtacgtatctttgattgtcttctcaaaagtcatagaaccttctacaatctggccgccgacgtgaaaacctttccttggtgcccctgttgtaaaaactcacaataaagaggatcctgaaattttggactataatttaaaatgtaaatatttatcttatcccattaacactttatgtttttcttccaacagctgacggaaaaagcaaaaattaacaaatatgtgactatccttcatctacctaaaaagggggatgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatgtaagtaaaataagatcccacgtttcagctattgaattaagtcatgcagacagagaaaatgtaatgtcatgctttgttttgtcatggcactggcttctacaggatcctagagctttttgaaataagtttaataaaaccccagtcaaataaatgaatgctcgcagctcaagtgagtcattaatcaaaaataagaagttcactgctagtgcatggggtgacctactacatatttttgattttttacaaaaattactaagaagcaatgtttggtctcatttttcatgttaacatacgtagatctaaacttgaagatatacaacacttatgagagctgaagtcagggttcctcaaggccactcagtactctttccccatttcagtacattccctctccttccccactacgttcctctgccatttaacatcggcatgtctgaaatgtctgtcaagcctggctgaatatttccagccagaccccatagcttcctagagcttagtttaatctgcagcaaacttcaaagcatgactcataccagaaaatgtgtaagcttccatcctagaaccccctgagaagaggtgggatagggccatgcttaaagatgagaatagaagaaacattttgcagatttttaaactgagtactaccttgcatttctcatttgtcccaaagaccctatagagccttacctgaagaaaggtgtgcagtatgcatggtttggcagttaccagagactgagaaatccaaaggtctctgtccttccctagatctatgtcttgctttcagaaccaaagctagccaaatcccaggaaaagaaaacatttgtcttcagtacctgtccactttctcttctctgccctagttcccccattccctcccttgtccaccaccctgggttcccaggaacccagaaccttcatgcttttggaacccacatgcagcatcctaaggccacggcagcatcccaagacgctagtccccatcccaccagccacccgccaccaccgaaacttggcaatccttgcctgttctctcaacaccctggaattggctattgatgaattaaacctaaaggactaattctgcaaatgccagttactgtaacaggcaggggaaataaacctgttcagggaggatcccgggttccaacatggttctttatttcatatctttataaggccaacttttgcctgaaagggactgatttggttttgtttcttttggaaggcaattatctgctagaagaaccagaaaacatagtgtttattctttgcttcaatgtatcatctgcatttgactattttgccccttgagttattaagcattttgagaaaacgacaaataaacaggagactttcctttccaaaagcagagcaatagtctcaaaattagctgataacatgtacaagtttcacttcgattttcactggctcataaataaaccaagtgaaccaattcaaaaatattaaaatatttccaaacattttaatttttaaaattaaagcactatcttcaattaagtcaaggttggtcttaactgcatattaaatgctgcagaatttcttccatttcactagtggtaatgctgaacactgaccccacaccctacccctcttgttttcctccagggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtacctgtttctctcttgtaaccttagtgggcagatctgcgccagcaaagtgaagcagagttacatggcagccttgtagataatgcaaggattacgtgatcaatgtcaccagagtcatttgtgcgtcaagtgacatgggaatgcttcctgaattattcatctctctgtctccatgaaatccagcaagaacaaccctaagatcaggtctaataacaaatgcagtaaaggcctccacaattccacaggaaacagaaacagccagtctggaacatttgtgttaaaaggaaatatagggcattgttccacattaacacctgcttttcatgttatacacaagaacctgagtctatgggagaaaaagaaacaagcaatgccttacggtattttccaaattctagggcatacaaataaagtgcttgggcagccaagaaaattatacaatagagagtcagccttctttctcagtgccttgcatttaagccttggattacctaggtgatttctcagttctctttgttcttgagacggggtagatccaatcaacatggtggttacagtggctgccatcccatagtagggagtgagtgttgacttgtagccagaaagttttctttggaaaaaaccgtcataatattttttcaacatagtgaatttagtaggtagtcatcagcctgcagtcatttcaagatgtgattatgtgaacagattctttccatttctatagtccctttagtaatataaattttatatatgtatattatatattatgtaatacaaatttcaatatatacatatattatatatgtatatacacatacacacatatatatacacatatacacacacatatatacatggataatacatattcaaaccaataacatacagcaacacaaagagacaggctcttaaaataaagtgcaaaaaaaaaaaaaaaccaacaacaaaggaaggagcatagctcaaagactggctaaaataatagtaaattcgttttcaaccatggtagttcattagactcaccaagctctttaaaattaccaatgcccaggtcccacctctagagattctgatttaattggtatttggtgggacccaggatgtagtattctttgtatgagctctccagtgattctaatatgcagccagggataagaacccttatactagaaaaggagatctggtgctactatataaaagagaggctctgagagagtaactacgatgatattttaaatacttgctacaatccctcattgctagttaggattttaactgcaaaaagaggatggaatattccctactgtcaatatgtattacagattttgaactctgtttaaaaaatggttgtatggaacccttgttaattgctggtagaagtgtaaattagtacaacttcataggaaaattggcagtgtctactaaaactcaacatatatataaacctatgacctagcaattccattcctgggtagatcccaaacacacatgagtgcttttatccaccaaagatgtgttctggaatgtacacagcagctttattcttggaagtcaaaactagaaataactcaaatatccacacacaataaaatggataaacaacgttacacaggcatacaataaaatattacacagcaatgaaaaagaacaaacttcagttttatgcaacacaaatttaatgttgaggaaaagtgagataaaaaagaatatgcatgatgagattccatttatctgaaagttggcataaggaaaaactaatccatggggatagcagtcagaaaaatgtagagctgctaactaggagggggtacgagggatccctttagggtactagagatgttcgtatcttgatctagatgttggttacacacttatttattcataaatttaaaactcatcaagctataaagacttatgtgctttactatatgtgaattattattctgtgaaaaaattttaattacaaaatttaaaaataaattgtagcccaggcttttgtgtgctat

SEQ ID NO: 16584 - DNA, 6100 bp, Human; identical to SEQ ID NO: 11939

SEQ ID NO: 16585 - DNA, 36532 bp, Human
  misc_feature (1)...(36532): n = A,T,C or G
taaataactgaatccctgtaatccaccatgctcagccccattagtaatttttatagcgtctttatttggatctagctctttcatcttgtgtaactcttttaagtaaatgactcctcccttctggtacaggttgaatatccataaaagggtgccttggcatgtgctcagtcctgaaattctactttgatctactgctctcatctttgaaactgctctaaacactcccccaaattattgatcctatgggcctgattatgaacttggctcttctgacaatacttctcaaatcctgtacctttggtaacatctctcctgactggcagagtacccagacacttaattaatgctgatgaaaattaagatttaagcaaagaagaaattggtgtaagaatgcaagccttaggatctgaaacttgatgactgtgggatctaacttctgcttcttttgctacaagctctgtttttgaataatcaactttcaaagacaaattgcttgatgaatctctgtattgtcagaatgtttctttgatttcccatcaaagccatgtatgtgtaactagtaattaggtacctacgacctgaatataaattatcattatttcagtagccctttatttgtttttgagaaagggtttcactatactgcccaggctaaacttgaactccttggttcaagtgatcctgccgcctcagcctcctgaatagctgggagtagctgggactacagggatgtgttatcatgcccagtgaaagccctttatttttaaaagttcattttcctgatctttacatgtattttaatactaaaattaaatttaaaaattttaaaaagtacctactaaccaaataatgccacccaataacaatagcattatttgtattatgttctggtaatatagtggtgaacaaggaagacagggtctctgataactgtggaattctccttgatcacttctcaagcctctcttccggatactatttcttggatctacagctgtcttccttccccacttctgtagttcagtctctcattattctctacctccaataaaaaggggcctcctaactggtttcttatgcaactactcaacatggtatttctaaaatgcagatctttcgggatgattttcaattgctcagagaataaattccttgactttctacgtaaggccctgcaggaccaggcccctgtcattatctctgagcactctccatcttgcacccaaagccccagcaatatcttactgctttcagtaaatacacaccgggctatgtggggttttgtctggggaaaggggatgtgagttgtaactaagagatttatagtcaatcttgaagggaagagctcatattggaggcaatggaatgcctcaagctggctctgaaagtacacattttttccagtcataagtagatcacatttgtgtgatcttgtgatcctctctctagcagagccgtgcagactacctacttccggccctttcttgccccacgaaatttcacatcacaacgacttgtggttttaatcctccgtttttctgcttctgaagttacttcagcctggcaagtcctttacctccccgtaggcctggcgagctgcatcacaacattcaagattcaccctagagccatctgggaaactttcttctccaggtcgccctgcgtcctcgcctccccaccccgttcttctcgagtcgggtgagctgtctagttccatcacggccggcacggccgcaggggtggccggttatttactgctctactgggcccgtgagcagtctggcgagccgagcagttgccgacgcccggcacaatccgctgcacgtagcaggagcctcaggtccaggccggaagtgaaagggcagggtgtgggtcctcctggggtcgcaggcgcagagccgcctctggtcacgtgattcgccgataagtcacgggggcgccgctcacctgaccagggtctcacgtggccagccccctccgagaggggagaccagcgggccatgacaagctccaggctttggttttcgctgctgctggcggcagcgttcgcaggacgggcgacggccctctggccctggcctcagaacttccaaacctccgaccagcgctacgtcctttacccgaacaactttcaattccagtacgatgtcagctcggccgcgcagcccggctgctcagtcctcgacgaggccttccagcgctatcgtgacctgcttttcggttccgggtcttggccccgtccttacctcacaggtgagtcggacttgtcccgccctgttcctgggccctgagagtgcctgcctggggacagttcccccagggctccagagacgccctatgggcttttgtccagccctctgatcacaggcactccacttcctcctcgagctgcattaggttttcatccaaagataactactataggactacggttcaatcaggagattaatttatggaaaatactgtgccagcagaaatctaaggtgatccttctgaccgtgttcaagctagccagggtcctagtgagactgtgagcaagggctgagtagagaccagagaaaacactcaaaattggggagacataatacaagaactatgcaaagttacatacaagtttctggcacatagaatgtttggcgggcggatcacgaggtcaggagttcgagaccagcccggccaacatagtgaaaccccgtctctaccaaaaacacaaaaaattagccaggcgtggcggcgcgcgcctgtagtcccagctactcgggatgctgaggcaggagaatcggttgaacccatgaggtggaggttgtggtgagctgagatcgcgccactgcactccagcctgggcaacagagcaagactccctctcagaaaaacaaccccccccccaaacaaaacaaaacaaaacaaaaaaagtgtaaattgtgaaagaaatcatagaacataaggaagtgagtttccagcggccacttggaatgggatggtagatgtaattagccgggactgaaaagagggtattccaggcaggaagaagggcttgagcagaggcacaaagaattatgattgagttcaaagttcaggtctagtggatgtgatgagttggggctggggattgaggagggatgagggtggggaaaatgtggggttgaagagtcaagagcgctttagacattggtttcacataaaatggaaggggctaacagttttcttttaggcagctatgtaatcagtactgaaaattgtatttgaggataattattccacagcacatttgtaagtcgagccaacaatgtaaaggaatacaattctgctgcatgggttcaaaatttagaagtttcttgataatctggaatctagctctttggttatattgtatagatgttatgggggtgggagccacatttacggttaagtcttgtagtaatatcattttatatgatgtttcaagtgtgtttaaattactttcacaaaagttatcatttgatatatagaattaaaagcatttaattatacagatgacccttagagagtgacatttgatttggggaaagaaacacaatctcagcatcagggtagtccttaactggtaaaatgcattaagctggagaggataagaggcctgctgttgagtgtggtagatcacattttcctctgaatccttcatgacaaataatagagtgccttacccaagattggcactcagaatatgttgattttggtttagaagagtttgagcctggtttatggaaaaaaaaatccgtctaactggtatatgtcaatcccagtgctgggcactctgaaggttacaagaaaagtcttaagacctaggcctaggctctatagttcaattgcgaaaatatgaaacagagggaggtacacagtgaattataagattctcaaaagctttataggttgtttcctactattgtatacatgagaataattcctttcctttttttttttttttttgagacggagtctcgctttatcactcagcctacactgaggctgagtgcagtgatacgatcttggctcactgcagcctccgcctcctgggttcaagcgattctcctgcctcagcctcccgagtaggtgggactacacgtgcttgccaccacgcccagctaatttttgtatttttagtagagatggggtttcaccatgttggccaggctggtctcaaactcctggcctcaagtgatccacccacctcagcctcccaaagtgctgagattacaggcatgagccaccgcgccatacctaattcctatacttctaaattaggccttcacctccattgctatagcaccatagtttaatcaagtagatagaaatggagagattgtaagataatggaatactataaattccctaacaaaagagatttagagccagataaattcaataagatgtttatttccatatattaccttcctgtaagttcattagctttattagttgagggttcttgtccattgagagaaaatgaaaactgggttgggtgaacattaccaaagacttaaaagtaacttctttctctattgctcttcccatggagtcttccctttggaatgtagtttcctgtggaggcttttaggtgactttgagctaaaatcctagttctgcagaaacaaggatgaagcaatagcatgggaaacaaatagaggtagagcaataccaacaaggctgaagccagaatacatttctttatgagtctgattttagtaaagaaggcaacatatgcaggttaaatcttaactaacagatttccatcctcttcctccaaacaacttatttgtaggctctgggccagtaggttttgtttgtttgtttgtttttgtttttttgagacagaatcttgcttagtcacctaggctggagttcagtggcacaatcttggctcactgcaacctctgcctcccggtctcaagcaattctcccacctcagcctcctgagtagctgggaccacaggagcatgccaccacacctggctaatttttgtattttctgtagatggggtttcgccatgttgcccaagctggtctccaattcctgagctcaagtgatccccctgccttggcctaccaaagtcctgggattacagggtggaatgagccacctgaccagcccagtgtttttcctaatgcaatacaacttctggtttttgtctgaacctgaaactaagaattcatactcccttttctgaaaaagaagtctggtattgaggttcagttctattttgaattcaccttcaagggttagtcccaccagttgctaaatggtctgtgaaggtgtttagtatttgccacctttctttgtcattgagaggtgtttctaccaattggagggtgtgtgttgcatgttgttgaacctgttaaatagacttattttaggaactagatacttgaatgaatctagttccctgtttgattattaagccacatcctgtttgcaaagcaaagatgtgattatttggaatttggaatggcacccatctaatgttgctccagacatttaataagcatggtgtggagcatggtgcttgatggagctgataaagtccaaatttttccaagtaaagtggctaagtctaattctgccattagactgcatttttttttttttttgagatggagtcttgctctgttgcccaggctggaatgcagtggtgtgattttgactcactgcaacctccacctcctgggttcaagtgattatcctgcctcagcctcccaagtagctgggaattcaggcacccaccaccatgcctggctaattttttattttttagtagagacggggtttagtagcgatggggtttcaccacgttggccagactggtctcgaactcctggcctcatgtgatctgcccacctcaagattacaggtgtgagccactgcgcctggccatgactgcattcttctttgcttttcctgaaactggttgatagaagccatagtatatcatagatattataaggttcccatcctggtctgatgttcacctgcacatccctgtgagttgctgaggatgccattgtccttcaacagaataatcctgccccccttctccagcccttttattctggaatggaagtaagattattatataagagcctgtgtccttctgcagccattatcagtatttgatttgctcatcctcagatattaaagaagtgactaaattaataaatggcatagttcattataatctggatctcctaaaataccttctttggccatttcttctgtatctggaacgttgtagatatgtagtaattatttgtaaaatatattaacgttaaagagctactttgtgtaaacatttgtaagaaggctttatgggtttgggttttgttttcttttttttcttttttttttttcttttagagacagggtcttgttttgtcacccagtctggagtgcagtggcacaaacacagcccactgcagcctcgacctccgaggctcaagctgtcctcccatctcagcctcttgagtagctgggactacaggtgcatagctaatttttgtagagatggagtaccaccatgttgccccagctggtctcgaacccctgggctcaaccactctgcctgcttcagccacccaaagtgttgggattacaggtctgagaagatcatcaaaaagatatgatttgcaggttttcattgaggattacctttcctttcaggttaccaatttggagtgtaagtgtgtgattccaggcaaaggataatcacactatgctgcttattgtgtgatcccaactcgtgctgctcttaactcagcatgcagtgagagatgcattgggattgcatctaggagggaaacagataaggtcaagcagctgggctggggagaaagaataaggccgattagttctctccactttaattgggctagcggctaactatactttaacctttcccacggcaaagacaaggcatattcctgccaaagatgattgccactaagtttattgttttaaaagcaaagaggaagaaaacaacacgggaagaaggttttgtagtagaattactttttctcatgaaggggtttctggagaacgagggatacataggagaaatacagtgatgaataaattgtctttagaaagaaggtgatggcagaagcacagtttttagttgaagggcaaaataagtgtcatatttcattttgaatcccagggcctagattagcttggcctgcagtcttccaccagcctctcttctcacagccctgtttttttcttttcttttctttctttttttttttcttttttttttttaagaaacaggtctttctctgtcattcagactggagtgcagtggtgtgatcacggcttacagcaacctcgaactccaggactcaagcagtcttcccgcctcactgatgagtagctaggactacagacgcatgccaccgcacccagctaatttttttattttttgcattttgtagagatgggggtcttactgtgttgcccaggctggtcttgaacccctggcttcaagcgatcctcttgtctcggcctccccgagtgctgagattacaggtgtgagccaccatttattacctaaagcatgatacttttctagtatccctgtatagtactgagtccaagaagctaaacttgatcaaggtgtatgtgggtagcctgggcctggtttatgaaaaatttgagttttatttctgtgagctgtaggtgttcccctgctttggatattctgtttgaacacagtatacattggaggactcaggatgtggaacatgattcattcaggagtcagctgagaaagtgtttattaaccccttaactctgtgccttcagactaattgcctaatttccaagctgttgctgctacttcctttttttttttttttttttaactctgcctgccttccagacatttccgaggataacaagaaaatagttatgaatgttttttcagtctttaagggagggtataatagtgggaagaacttggtgattttaaaaataaaacaataaaaattaaaagtccaagccccagagatgcctttccttccatttccttctaccccagttccttacctccaaacaggagcgagaagcatagcattggaaggtttttgacaatggataccttgtcgttttgttgttgtttgtttttaaccgtctcatgctagggcatgttgtctgtttcttagcctgttcaaggcataagcctcaatccctttcctgttgttatatagagggaaaggagttttacagccttaccagtacttcttttaagaaataaagctgggcatggtgtctcatgcctatagtcccagctactccagaggctgaggtgggaggatggcttgagctcaggaggtggaggttgcagttagctgagatcgtgtcattgcactccagcctggacaacagagccagaccttgtctcaaacaaacaaacaaacaaacaaaaacctagaaacaaaaacaaaagaaagggatcactcttatgtttctgcagtttcctaaatttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaggggtcagagaggtgtatgtgtgaagagttttctgtggtgtgagctgtctcaaggtttacatgtttacagtccattgtaatacagaaatggattatattttcttctgtattcctggctgtaatgaataaaacccattattgggtcaggaacttgagtcttctctcttcttgtcctttgttcctgtttcaagctgtggcatttgcttaagcttcctggccacacactcagccctgatccccagccaactgctgtatgctattgttgtgtccacatcttgaggctggttaggcttgggtgtggtgtagagctcctttctgtggaagcgtatactcaaaaatacaggacgtatgggtgtttgtcagctgtcattaagcagccttccccttcttttgtaaagctcttgggattgagggggtaagagagatgccttactaggtacactgttatgcatgaaaagtttaactacttactgtttgttcaaccttgtccttgttgtaactaggattccacattagtggctttgttgttttgcctggagctgcagtcctaggttgggggagattcagagttctaaggccatgtccctcttgtattttgaagtgtcagcctgttcatatacagaatggcatctcacagtagtgaagccttcagtctcctataagaggctcatgaaaaacccttcagggaagctgctcctagagtgtggctttgccataggagaccctgccccaggactcctctggccaaatgagagagtcgaggtttgctggggcaaaactgtcttattgggaaaagggaagtagaacacggaaggaaactagcatttattgtctggcacttgatgtatgttattgccctttaatcttcataaacagctctgtgaggtcagtgttatcccaatctttgagaatggagacatagaggctaagtaacatgcccagggttacacagcttgtagggatggagcagaaattccagtcatgcataaattttgcttttgtcactgtacagtcttgtaatatactcatacacgtctttgtcagtccagttagcaatttggaaaactactggcctctggcaggattaagctctaatcacatcttagtgttaattacttcaaataggtagtaacttctaacatctagttactcataagcactcaggttatgaatattttgatccctggcccattgttaccagattccagtagcatttcttccttcctcccatctattcttagtacaggtagtatttattaagtaactttaattgtcaatagtactaggtccaaggaatattaaattgaacttccccgtccttaaagaatttacagtttctggaagtggggatacagagagtgtgatatttttctatgataactgaagcacaaggtactttgggagtgcagaagaggaacacctgacctaagtgtatggggggaaaaggagaaagtgcacattgaaaaggctttcccagagagctgttgaaggagatctaaaagtagaagttagtgggggtgaagatagtattccgcatagaaagaactgcgcgtggaaaaggcctacaggcgagaagccttcatgccatattcaaggaactcaaggtgtctagctgaagtacacaactctagggtggatcagcaagttctgaagctaaagaggtgatagatggaaaggtcatgaaatggcctaataagccctggtaaggaatggagctttatcctaaggtcaaagaaggccagtaaagtccagtcaacaggataagtgatgtgactaaactctagctacattggggcttgctgtagagtgggattagaggcaggaaacccagttaaaaggctgccaacagtggtctagataagagagagtagtggctgaagttgggttgatggctgtaaggacagagaaaactagaaagactgaagagagatttaggaggtggctgcttggaagtgggagttaggttggagggaaagggtgctgaggatgactcccagatttctgacttagcagtttgaatgttggctctcattcactcgtgctgccattaacaaagatagggaaaatagtaggagaggaagggaaggagtaaaaagagctaaattggtggtcgtggtggctcacacctgtaatcccagcactttgggaggctgaggcaggtggattacctgaggtcgagagttcgagaccagtctgaccaacatggagaaaccccatctctactgaaaatacaaaattagctgggcatagtggtgcattcctgtaatcccagctactctggaggctgaggcagcagaatcgcttgaatccaggaggtggaggttgcagtgagccgagagtgcgccactgcactccagcctgggcaacaggagtgaaactccatctcaaaaaacaaaacaaaaaaaaaacagtgaaattaagaggttgagaggtagagtgagaatcatgaaaagtaaatttgattttgacgtgttgactatgaggtatctagcaaacagttagctatgtagtactagagcttgggagaatgagtttgaacacttccgaggagaagaaggtccaaaaggcaaccacaggagggtggttgaggaggaggaggaggatgttgttggatgactgctaagccagaacatgggttagttcttcctcttgggtgtgaaaatcatctaggataatagccagccttggggtggagaggaatactgggcaacaggatccaaagtattaagtaaataaggttgggcatggtggctcacacctgtaatcccagcactttgggaggctgaggctgtgggatcacttgaggtcaggagttcgagaccagcttggctaatgtggtgaaaccccgtctaatttgtaaaaatagaaaaattagccaggtgtggtggtgcacacctgtaatcccagctacttaggaggctgaggtaggaggatcacttgagcctgggaggcggagattgcagtgagctgagatcgcgccactgcaccccagcctgggcaacagaggaggactccatctcaaaaaaaaaaaaaaattaagtgaataaagaagtgatcaggaagctacagagtgttgtaacaaggagagctgaagatttaacagctggatgacatgaaccacagaagaaaggtgttttattacttggtggtggtggaatggatgacccagaagcagccccatatctcaaccctatgatgtgggaagtggctgcctctcagagcatgttgtaggggaagtggtgtgtggtattcctggggagagccaggcttcagttagggaggaagtagaagaggctgagtaattaagtaactacacaacaagatctcagagggtttacaaggtgaatgatatgtagtacacaggtggtctggtggagaagaggaagcaacatgtataaaaatagaagtgcaggaccagaagtgagcaaagggggttatatattgggcaaagtgacaaaatatggtagagatatgacatggcggatttccctgacaataagattaccaagaaaatagattccagagacaagcaagcatgtgtatatatgtgggaatttaatatatgatcaaagaagtatttctgatcaaatgtgaaaagatgtattagtcaataaatacctaaggatgactggttatccaattgggaaaaaaataaatccttacctcatatcaaactcaaaagtaaattccagggagattaaagatctgaagataaaagaccattgaagtgttagacagaaatgaaggaaactattattataattttaggggtagaggaggcctttctaagtaagcaaataaagagaccgtaaaggaaaagagtcatagctttgactacataaaaattaaagcaaaagaaagcataaggttaaaaaataagggataaaatgaggcagatatttgcaacaagtcaataaaagaaaagtaactttaaaaagtaaaaagaatggctgggtgccgtggctcacgcctgtagtcccagcactttgggaggccaaggcgggtggatcatgaggtcaggagatctagaccatcctggctaacatggtgaaacatcgtctctactaaaaataataataataataaaaaattagccgggcacggtggcgtgcgcctgtggtcccagctactcaggaggctgaggcaggagaatggcatgaacctgggaggcggagcttgcggtgagccgagatcgcgccattgcactccagcctgggcgacagagcgagactccgtctcaaaaaaaagagtaaaaaaaatttggctagtaaatgcaaagaaatgcttgaggccaagagttcaagaccagcctgggcagcatagtgagaccctgtctctacaaaaaataaaaataaaaattagcctgacatgctggtgcacgcttgtagtcttagctgtttgggaggctgaggcaggaggatcacttgagcctaggaggttgaggctgcagtgagctatgattgtgccactgcactccagcctgggtgacagagcaagaccctgtctctaaaaaaaaaaaaaaaaaaaattaaattaaaacttaaaaagaaatacaaattgaaattgaaacaatgtatgtgtttttttaaatccagctggcaatggtgaaaaagaattgagatgttctagtgttggaaagatgtggagagatgggcccatatatgtggatttgggtgtaagtcagtacagtaacttggaagaggaatttggcagtatcaaaaccaaaacttttcttacctgtggcctagcatttccacctccaagaatttatcctacagatatctttcacaattgcttatatacatatatatgaatatttgtttactagagtgttgtttataatactaaaaacttagaaacattaccgaatgtctacaaacagaagagaagttaggtaagttaatgtatatctcatcattggtttttttttcaacatttacaagatggatgtaattctatatatattgacattaacagatctacagctcattttggtaaggggaaaaatgttacaaactaatagtattaggatcccattttttttttctgtttttgttttttgttttggggtttttttgagacagtctcgctctgtcaccaaggctagagtgcagtggcgtggtcgcttggctcactgcagctgccacctcccaggttcaagtgattctcctgccgcagcctcccaagtagctgggtttacaggcgcctgctaccacgcccagctaatttttgtatttttagtagagacaaggtttcgccatgttgactggcgaaccttgaactcgttcgctgggctcgaactcttgaactcaagtgatccacctgcctcagcctcccaaagtgctggggttgcaggtatgagccacctagcctgggcccatttttattttaaaaattaataaatttatgtatttacaaaaaaattggaaaattgtgcaaaatgttataactaaagttatcccttgagatctagaattttagggagatgttctctttccagtggggatagggttgggagggacagatcagttttaaaagtaggggaaaatagaaaatttttaactacagcttttcccaaaaaaagatgggtacaacttttacccaaaaaatatgggatgggaatgagaggaaggaagaacattcaggattcatctgtgggctggagagagtgatacttccaagtaggtattaatagtctgtggagggtgaagaatcttggaacttacaggaggaggtaccatgatctagactaaattcagcagcactaaggagaaggccccagctcagggcagttggcttcacagactcccactttactgggataagaagtttgacaaggttggccttgacttctctcctagctacaccaattcacttcccaggcttggaataccttttctcctcttggtagcttggtgaacaccaattcagggttcaagatcccactcagaggtccccttcaacgtcaagccttccacctttcctggacgtggctattaaatctaccatagcccttatcacaatgtttgtaattattgtttgtgttcatctctcctgctagactgtgatctcctcaagggcagggaccagggtttgtttttctttttaactgccccagcacctagcacagttcctgatgcacattaaatgcacaatatatcttggttggaatgaagaaatgagtgggaaatgaatgatataatgggcttttattaggcagaatatgggggagatgaaacctggatatgatgtgtataaaggtgggagggggaagagaagaaagtgggcatgggaacaaactttggcaccagcctaggagggtaccaggggatatgggagcagagtagacattaaagagtgggaaggtggcaaagtctgggttgcctttcttagttttcaatccagaagcaaaatcagctaccactttataaccgaaaccaatgtgttttttttccatagtgctgggattctgtgaatcaaacacattgatacgatggaagtgttttgattcaggagggaacgggtggtagagggaaaggctattgtgcactgaggtaaagattgatagtttccaggttaccctaatagttattagtgaccctaatacagcaacgagttcttcctctcagagaagtggaaagacctaaatcttagaatttatggatccagaggtcttcagagcagtgtctgaaaaggcactttgtgtaagtctgggcgtcttcttagcatcgcccaccccagtctcaggatttcagaaatactaggtttggggatataaaagtaatctctacattaactacttgctatttatgcctgattatcacatagcacaatcataaaatatgcattttttgaattccaacatcattcattttttcagcaaacatgtactgaatgactgctgtgtgtcaggcactgggaatacaaagacactgagattggtccctcctgttgaggaactcacaacctaggtgaggagatagacaaataaacagcatatcttaagaaaagtgttttgaaaaatgtatgtatacattgctgcatgatcacataggagggtttcttaggaaagagggggggaataacagaaaagtttcctaaaaggaaaatagagctgtttcttaattaggggagatgtggcgggaaggcaaagtttgtttcaattggaggaagcaatatgtgcaaagaaaaatatggagaaaatatggcattttcagggttctgttaagagttcattgttcattgtgagagttcctgcacaggagcagaaaaagacaaggcattttcttatgattacccagtgaattctggactgtattctgaaagctatgggagccattggaagattttaagcggagactgtcatgctcttatcttcatattctaatatctctgaggatagtagattgacatgggtattcctggaggcaggggaagactgcctgggagattttttatagtcatccaggtgagaaattacaagaggctgaattaaggctttggcccagtggggctgggaaaatggcgatgtgttaagagattataaggattgtgtaattgtaagacttttaaaaagtatttttactgttgtaatctcagtgcttaacacaatgtttgagatatcagacagtctgtaaatgttattttgagttgatgaacttgtgatctactcagttagatggaaggtgtagaagaaggagatttctggtataggtgaatagatggggctgttatcaaagtgagagagaggatcagccaggaggaggaatgaagagttagattagttttatgtttaagattcaagtggcttttgagacatttgagtggaggtgtacaagtctagagctccagaagaagagttggcttggaaagatagatttgggagtcattggcctgctgtgggagtggatgacattgtctagggagagtgtaagcgaagggaaaaagagaagtttggaaccttggataccctgggtaacattagtacattgggattggtaaaggagaagttgaatgaagaagcatattcaaggagttagaaggaaaaccaagagagcaatgtcccctaagctaagggagtttagtttcaagaaggtcagagatgtctgatgctgtcaagaggtcccagaaggagtgagtggtttctattagctctctgacagctgggatttttgtctgttttgaccactgctgtatccccagcacttacaacaccctggcacatagtaagcattcagtaaattactgttgaatgaatgaatgaattgaaaagagtcccttgaatttggttacagaaccacaggactttggtgaagccattttgagagaagtggtggtgaaggaagccagattatagtggattgaggaatagataggttgtaaggaagcagctacaaaatactaagtatgaccaacatcatgagcacataggaggtaccaggcactgagctaagcactttacatgtattaactcatttaaccttcccagcagcccaattatataggtattatgatccctattttacagttgaggaaactgcagcttagagagggtaaataacttgcctagagaaggcctgcagctagaaagtgttagaaccaagatttgaatccagatctgtcttcctttggagttcaggtccttagctgcccaggctacatttcctctagggagtctttgtggcaggaaggcaaaagaaagagtaagtgaggccaggaagattgcaaacattttaatgctgatgagagttgaaagaaataatttgaaggctttgggaaaaggggaaataatttatacaagaggagactgagaagagctccagagcacaggtaaaaggaagccccttccatcaaggtggaggtccaggagagggtacaggcaggtgtgtgttgcagatatttttgtcagtgaggagaggggaagagggtagggatagttgaaagttctcttctgattgtctgctgagcataagggaggtggtgatcaagtagacttgaggaaggtgtagagaatagaatgaagcaatgatggagatagaagattttcagggtagcatcaagggcccagccaagatggagaccattattttgcagtggtccagtcctgctgttttgtgatttttctcccttccctccagtagggtacagtagccggggtcaggggcacagcaggcagatgttagattgatccagggttgaaagttttgcccattggttgtgacagaagaaaagagacagatcgttgggagtattggctagattgcgtttgaggtgatgaatcactacatgtaggccagcagggaaggaagcaagaatgagagaagactgagaacagaagggaaatggaggggtcatagtactggagtctggagaaggttcaacagtaggactttggtgatagagcgtccttgttattagaattccatgtccagaggtgacctgtctgtgatgaataaggcaaaattactctataaggtactacaggggtagaaaactaccagtgatgtttgtctctttactgaggggactaaggaagggtaccaaagatactttttttttttaatcgtaaatattttctactgtttggtagtactgtttgattttttttttaaccagtatgtactactcttttttttttttttttttttttttttgagacagtttcactctattgcccaggctggggtgcagtggtgcagtctctgctcactgtagcctccgtctcttgggttcaagtgattctcctgcctcagcctcctgagtagctgggattacagggcccaccaccatgaccagctaatttgtttgtatttttagtagagacagggtctcaccgtgttggccaggctggtcactaactcccgaccttaagtgatccgcctgcctcagcctcccaaagtgctgagatcatggacctgagccaccgcaccaggcctatacaactgttttgattttaaaaaaagatacaaagttttcagtgaacccaaagagaagagtaggtttacatgaaagcagggagatgagtgagctgcagaggtagcaggctgtggtcctggaatgggaccctggagtgtattatctgtctatggaatcacaaggtcttagatctgaagaggagtagctggaatctggtcccaccctgccattgtttacagggaaggaaatgggagccctgagacttgctcagcttggcagcagcaaaaccagaaccagaagcaacctgtcctgatttcccagccctctggtctgtttttcatgctacctcctaagccctggaggcttctcaatttcctgctgttccagccagactcatggcacatgtgctcatgacattgctggctgaccgggctgtttgccatactgtgcttcccacacgttggtgcttctcagtgttcagggtgtgggcgggtgtgtgtagaggcggctgtactactgtcccctgcctatttcctgccctcttcatagccaggcaaagtagcaacttggaggcggaaaaccacagtggtgataccctatttacatcctttacaatgacctagtgtccctcctgttttgccagctctcatgttgctgcctcccccaaacatccctctcataatttgtttaaacagcagccatgcccccgtatctacttctttcagcccaaacccagatgagtcactgagagaacttcggacagggattcttcaccatgagattgatggcagggagtggaagaattgtaattctggagaaacagcccttaaattaggggcattgttctgggaaaaaaagtgttttcctattcagcagatctgcaaaggagtctgtgactctccaaaagactacagatttagggagtacagtgcaggtgtcttttagaaaaataaattttttaaaaatcgaaagattaggtatttttctgtcttccaagtaatagttcagataaacctggtgtttgtgtggcctctcttattttgtcatgagggcagcgagccatggtagttgcatatggattagttgtgatttctccttatgtggcaggctgagccccagaggattagaactaaagctcaggacttcggctgtcttttggatggctgcctgggtagatatgcagatgaattctccacacaatgatattggggctccatgatgtgtggggttgggagtgggggcaagaagtcagaggatggggtatagtttttcctcacccttgctcctaggttaagtcctcattggtctccctgtagagtctcctgtggagatgggtttgtagcctgtctgcttggatggccctgcagattctgccttgagtgtggtctttgccttgaaggtctgcttgtccttttgtgttgtaacaatgtagttttagggttcaagtatggagctgtgaattgacctggcccagagttgcctcagattccctcctctttgcagaatgtaggcaggtattggtgtggggatccagggtatttactggtaagggaaagaatgtgttgttcatgatggtaggaaaggcccccttattggcttgcttcttggcagaccaaagagctgagatacagccatgtggtagtgctcaagaggtctgagcaggcttccgtgagatgatctgagcgcttggattccttctgcctggagatgggtaacatttgagattccagtttggttctgaattctctcattgccttctgccaggccatcctatccctgacattgtagtgccataagaagtcatggatgttgtgatgccagtgggatgaatatggctccaggaaagaatagaatagagaggggttcattaagttaaggcttggggctataacaccagagccaccctgaaaatcacagggaagaaccagcaggagggtgagaagagacagtgtattcatattttggctttggcattttttctgcatagacaagggtctgtaaagctatattagatactatgttggttcaaccctccactattagggtaaaatctaccttggatagagaacctgtttgggaagaggaaggaaggaagcaagatgggtgggtgaccctgatcttctctgaggtatcagttgcatcatctcaggcctcctctgcctgatccttctgtcatctgctccattagctcctaggcttttgcaaaactggaaacccttcatctggagccctcaagagcagtactacttaatatgccaatcttcaatgagataagaagcatatgtaccagaatgtaagactgatctcttcatcaagaaaatcttgtatgaaaaaatgttagaactagacagtgtgtttactctgacataattgatttacattcaggcttcatataagttttctatatagtgaccagccagtaacacagtttgcaaattggcagctaatctgcagaccatacttggagtagcagtgctctagagctgcctttcattcagaagcagttgttgaggtcatggagttgtttgtttggtacaggccaagggcagtcagaaatatagagccctggttaagaagagctgtcacccagagcattcagacatgggtcagggcagctactgaggagaagaggggcacaacgagagtgagacagctgaacagatgatcaggcactgcctatgccaagggtaaatgccatgtcctccctttcctttaccacaggcgtgtgagctgagggactagagctagggtcttggttttgcctgttgcttctaatggcaggttggccgcaccaagcttaccctgtcttcctagggaaacggcatacactggagaagaatgtgttggttgtctctgtagtcacacctggatgtaaccagcttcctactttggagtcagtggagaattgtaagtaccatcctgttccctgtcttagaagagcaaacacttgtctgaagctgtaactctggatggcctggcctaaactgctgatgctcggcctggagtcccccttgaccctggggaccgagggtcaccaagtgctgagagccatggaagatgagtttttcctatgcagaaacttaaccagtgctaaaggttggctgtggaacatcacactggctcttcactgagtcccacaggacttctacctggtgtactgaatacatttctattttaggaaagtgtatactttgctacttttctctaatagaccctacactggggaaagcaggggttctggtcacttatactgagatgaagttaagtcattagtccagtgactgcctcctgtcttccctgagcagcatttggggacttctcagtctccaaagtgaacagttgagtttggctccttcctcacattcttggaggaagtagctgaagcatagaggaaggggaaaggagggtgattacaaaggcattgggagcatcgcgtgctgcactcacccctgcaggcatccctgttccctttgccaggagaagacttctttcatctttctgctgtggaaactgacccatgaggtaggtggtgctttgtacagacctccactccagcctgactcttgctgtacatcatcatccagggtctacagagtcactgtggtgaccaccctcccactctggccccagaccaggccatcctacagctgtcttgctctggggacatctcctcattgaaagattttttaaaatatatggtcttactgttttttttttttagtccagtgatttatatagaatatctggtctataatctgagaatagaaaaccttaaccaactaaatgagttcatttctgtcatttcagataccctgaccataaatgatgaccagtgtttactcctctctgagactgtctggggagctctccgaggtaacaaattggggctgattaaaagagagagagaaaggatgatgtgggaaggttggtgttggtggagtgcagtggcccagtccctgctcactgcaacctctgcctcctaggctcaagcaatcttccctctttagcctcccaagtagctgggattacaggtgcctgccaccatgcccagctaattcttgtatttttagtagagatgggatttcaccatattgcccaggccagtcttgaactcctgagttcaagtgatccacccatctcggcctcccaaagttctgggattacaggtgtgtgccaccgcgcccagccaggaagctttttttatgggaacaattggcgtgttttcccgtctctgtggaattgtccctggaagttgacaggttttaccctgtgcagcatcagcaactgctgctgccctagtcaggggctctgggaagcagtaggagagtctgtgggctgatgttctaggtgccagcaggggacaggtagctgggggcagggggaatgatgctaccacagacactgtctgtccagctcttgctaaagacatgtaattggaaaggtttttttaaaaggaaaactataacaaaagaaatagatacatgcaaaaaaaaagataaatagtagtgaaatatttagaactacattatttctggagaaaatgagtttactggctaaactattggcccttgcccttcttctgggtttactgagaaggcatttggtgcctagatacagacttagccaaatatctctcccacttttggtaaaccctctgctggtgaatgatgtgggaaactctctcggaattccacaccttgctttagtttgtcttcattcccttgctccacttctatgcttggagcaacagcatgctgcctccccttcctgccctcttgtacctttcatgcaggtgctgatggtgagtcaggctagaggtaagggaggacctggaactccagaatgctgggtgtcagagtcagagtggggagaagccaaaacagtacactagcagtctgctcaaatcaggtgctgagtgactgctgaggtctcatggattctttcactttgaaactggggactctgataattttcatggggcttctgcagggtttccagaagaggggccccagctgttgagaacatacaatactctgggttcaacatacctgtgtgtgggccttgctagactctaggagacagtgtcagtggactaggggagtccttctggggcagttgctgtccaccacacctcagctccctatagctgggtctcttctcagactctgaagaggaagagtggatgattttttttatcttctaggtccagccatgaacccaggctccttggaaacccaagcttatgatcactttctcacaatttattctgggaccccttttctcagctctcttagctcctgataggggttatccatgaaaagtccaactcttgcaggctgagttgtctctgtgtctgtcctcatgagtatatgtcttggcctctcttctcaatattcttgtgaaggcacaggaaatatagataagaggtatgtgggttttgaaggttagtatgttgtaaggaagggcactaaaacccttactctgacatctcccaaaatgaaatacagaagtaaagatggatagtggcttcctaatatccccttttcatcagtgttaaaaatcgtcaagcctacactacatccattttccctgtgtacccaaatgttatgctctgctacattgagaaccttccaaatagagacatctctttttccactccctgagtctttactctgcctctctacatcttcctaggtctggagacttttagccagcttgtttggaaatctgctgagggcacagtaagtgtggaccctcaaaaagggctcctttttcatctctggggttggatcccaatattgagaatcctagaaaaatcttgttttgccttaggatcctggtggcttgagatagccccagtagaaatggaagaggagatgtgagtggaaaactggtttggtagatttggtctgtttggaatcactgtaatttggtccccctgagtcatcatttagtaatgaccttgaggccacactgctttgaagaaaataaactatgttaacaggaaaatccagaatttgtaggctgagtggtgtttgggacagttgtattaggctggcgttggacaattgctctctgggaaggtggctgcttatggtcatttatagaggtggggagcatttagggagagagcgaccctgagaacagtcacagattggctttttaagaatcctgggagagttgtcttcatctccctgtgcccccatagtaagcttcctttgaaactgacatgttcaatgtttgttctgcacagttctttatcaacaagactgagattgaggactttccccgctttcctcaccggggcttgctgttggatacatctcgccattacctgccactctctagcatcctggacactctggtaaccaggccttaaggccttcttcacacttaagagttctagggtgatggagcaacggacagaccaagttccaaattcttaaagagttagagagggaatgtatggactgggtgtggtggctcatgcctgtaatcccaacactttgggaggccgaggtgggcggatcacctgaagtcagaagttcaaggccagcctggccaacatggtgaaactctgtctctactaaaaatacaaaaattagctgggcatggtggtgcatgcttgtaatcccagctacctgggaggctgaggcaggagaatcgcatgaacccaggaggcagaggttgcagtgggtggagatcacgccactgcactccagcctgggtgaaagagtgagacgctgtctcaaaaaaaaaaaaaaaagattgtatgtaattctatgagctcctgggaaaaatgtagaagatgagctgctccaagactcaaaaaataacagagtgacttaaatctaccttacaggctactgtagatcaatgttcaggctgtttccagggatacaaatgtttaggggaattggcttcattggcagagctaactatatttgtttttgagacagcgtctcaattttttttttttttttttgtattttttgtagagctggggtttcgtcatgttacccaggctggtcttgaactcctgggctcaagcaatctgcccaccttggcctgccagagtggtagaattacaggcatgagtcactacacctggccggcagagctaactttagttagaacaaggtcataggagagagacgttcaaagccttaacttggggccaggtgcagtggctcacacctgtaatcctagcactctgggaggccaaggcgggtggattgcccgagctcaggagtttgagactaacctggccaagacggtgaaaccccatctctactgaaaatacaaaaaattagccaggcgcgatggcgcaaacctgtagtcccagctactcaggagtctgtgatgggagaatcacctgagcctggggagatcaaggatgcatgaactgtgattgcaccactgcactccagcctggacaacagagaccctgtctcaaaaataaataaataaataaataagtgaaggaaggaaggaaggaaggaggctgaggcatgagaagcacttgaacctgggaggtggaggttgcagtgagctgagattgtgccactgcactccagcctgggcgacacagcaagactctgtctcaaaaaaaaaaaaaaaaaaaaaagcctttcctggggaagttcctaactctcttgagtttaatgtgcagtcttatctgacagttcccaatccagttcctgtgtctgccttttcctttgctcctgtgacggaaccaaaggaggccacacatctgccagcctttgcttctgagattatgagttaagaggctactaagttcccaggaggtctcacagttgggcttaacatcagtcagacaaccgaacacaaatggcaagaggaagtattgatcttcaggcttttggaagattccaggctaccacagtagctgcagccctcctcttaatgtggccagaatttatttcaagaagaggaaagaccacttctatcatccatctttggatgtgttctgggaaaagtagaagtgtgctgggccttccctccatgccatccctccctgatgggaaggtttgatagaccccataaatacttaattgagagctgaggcaggtcaagcctgtaggggtgtgtggagcggcctgagagctcgcccaacatcgcaagtttgaggctgaaaccggagagactgtgatgggttcacagtgtgcactttaacctacaggatgtcatggcgtacaataaattgaacgtgttccactggcatctggtagatgatccttccttcccatatgagagcttcacttttccagagctcatgagaaaggtatgttcccgtttcactcagaccaagtttatgggtcaatgtctgaatctggctgtggccctgctggcaagaacagggtctctcatcctaaccagccagttttagaccaatataggggaaggacactggatttggagtcaggagacttgagttcaagtccaaaactttgccgataatttgccttgtgaccttcaggagagaatctcttctggccttattccctttttatgtatttatattctgttaaatggacatagtattaatacctaccatgattatctcactggcattatgatactcagataaaacagatgtgataacttctgggaaattatgatcaagttttttgaagatagtccctgacaccaaagggctatgggcaggttttctgatatctggggagtcttgtgggcattttgagtatcttctactctgctagctttcaggaagtgtgaacctgaagggtgtcttgtgcctttcaggggtcctacaaccctgtcacccacatctacacagcacaggatgtgaaggaggtcattgaatacgcacggctccggggtatccgtgtgcttgcagagtttgacactcctggccacactttgtcctggggaccaggtaagaatgatgtctgggaccagagggactctgcttgttatgctcagagtgaagcttcagggcactggctcatggaagtggcatatcccagccttggtccttagaagaatgttttccatcgacttcttccacctgggaatttagataggaagaactcactttggacaatggaggctgcttcttactattaaaatatgtactgttagactatgtaagggcacatttttctcagatgccgttgcaggtagttgtgcctagagtggatgctgaggaatctgaccaccagggtagaatctgaaagaaagaagcccaagggcagcctgcagaggtcagagtcagtcagtacccctgctccctttcttctgtataccctcagccctccagtgtgagcccccaacacaggttaaatgacagttgaaaagggctactggcctgatagaaaactgaagatattggccgggcgtggtggctcatgtctgtaatcccaccacttttggaggccaaggcgggtggatcacctgaggtcaggagttcaagaccagcctggccaacatggtgaaactccatctctactaaaaatacaaaaattagccaggcgtggtggcaggcgcctgtaatcccagctactcgggaggctgaggcaggagaatcgcttgaacccaggaggcagaggttgcagtgagccaagatcatgccactgtactccagcctgggcgacagagcaagactctgtctcaaaaacaaacaaacaacaacaatcaaaaaaaaaccctgaagatatcttgtgacctcagcgtcaggaagtagtctctgggccaagggagatatcccttagcaaatgtaaaaagattctgggtgatggttgaccccacctacaggaggagatagagaagaaagattttgccagtttggctggattaggctctctctctgcctcaaggcctgtgaggagagcagccttgggagcaagggtagcacctgctagaagcagtgtgtccaggcaagagtgtgcgcactgacagttgtctggctggaacttagcctctgcctatgattgtggatatatttgtatctttttactgtgactaaatggtggtgactaccagtgtctgtgagtgcctaagtgtgcctacctaaatgtgtgtgatgtttatgaatacacttgtcttgctttgtgtgactcgtgtccttacgtgtaggactgtgcgtgggggtttatgtatttgtgacactcatatggggttttctcttggcttaggtatccctggattactgactccttgctactctgggtctgagccctctggcacctttggaccagtgaatcccagtctcaataatacctatgagttcatgagcacattcttcttagaagtcagctctgtcttcccagatttttatcttcatcttggaggagatgaggttgatttcacctgctggtatgagccctttgatcttcccactgtggcctgatcagttgcttactcagaatagaagttagcacccgaggggctgcttagctcagctgctgctctcaggggtctgtatgggctcacattgctcaggtcttaggccttcctctgcccatctacgtagagatcctacctgattttggcaaggctttcactgtgaacctcttccttcctactctcatatccttgaggtattgatagaaaaaacagccctgggcacagaattgtcttggaaaagttcgggatagagaaaaataatccctgtttatgaaggcttaaaattgtctagttgaagagtcaagacacagaattcaagactaataggtgacaatgtctaattagtattcagttgtaaagtccaaacccttggttctagtaagctcaaaagaggctgaggggcttctttgagaagagggcgctagagctgaatctggggaaatcaatttggctttttggagatgtgagcaggggaaaatattccagaaggagaacaatgtgagcaaaatgtggacgtcataacgcaagggatctgcagcaggtgttagacagcaaggcttgtcatccaactggaagagcagataggaaagccgaaatccagtgtgctggagcttcaagttaagaccttggattctcatgttgcagtccagagaggattaatatgttttctctttgggagtttgaacttaaaactcttcaggtccagactcagcctttctcagcctgtgtcaacagcccacctgcttcacataactttgcttggccacactttccacatgtagggcttctgagatccttgcttatttgatttttcaggtgaaaagaggaagttatagggggccaggtgactaatccccaggcattaggctttcaggatgttgaaagattaatcttcattttctcttgggattcaggaagtccaacccagagatccaggactttatgaggaagaaaggcttcggtgaggacttcaagcagctggagtccttctacatccagacgtgaggaaggaaggagggtgggtggggtcccttgggggtcctcctgtggggtcctccctttccataccgagtcaggccctgcttggccactgtctggtccctgcagggttcccttgtcctttgtcccatcctttcagatttggagtggttggttttcagcccaggggaaagacactgcttaatgaggaataggcccctggccaggctcaacccctagagcactggcacaaacagtctagaacccatctgagctaagcagacacttactagacactcctctcctctccaggctgctggacatcgtctcttcttatggcaagggctatgtggtgtggcaggaggtgtttgataataaagtaaaggtgagccggggcagagaagagaagaagccaccagcagtgcctccctctggtctccccagctcctccctgcctctacagagactgatcctcctggtttggattgggctttaatggtcggagcactctccttttctctctagaaaggccacagagtgctgggtgcagtggctcacgcctgtaatccaagcactttggtaggccaaggcagggggattgcttgagcctaggagttcaagaccagcctggccaacatagcaaaaccctcatctctacaaaaaatacaaaaatcaggaggctgaggttggggtactgcttgagcccaggaggcagaggttgctgtgagccaagatgtgcctctgcactcaaccctgggcaacagagtgagaccctgcctcaaaaaaaccaaaggccgctgtggtatgagccctgggtttatgtgtcagagtttctatcttccctcactacaaacttaattaagaactatttctgctgttaggttacttggataggctggatttttcttcctaaatcatagatgagggtcttctgggtctgtgggaccaaggttaccttctcctttattgttgatcagtaagatcccagtctcctgtcacatgcaaggactcttcaggaaccttgtcccgtccccagaaacatctggagacttttggacatggcagctcctgggtcccactgcttgcctccctcagctcacagctggtattactagctctgtgtggacagggaggctgcagagggacggggaggagagctgcagggaggcctcttagggccctggattccttggcctctgtcctgaggtgtgagctcaatggtcaggagtcacagagacatactttgctgctggggaacagagggagcacatacctgttgtcccatgttgcctgtgtatgaataaggcccaggaatctcctcagctttgtgtccttactgccatttgaccttttataacagattcagccagacacaatcatacaggtgtggcgagaggatattccagtgaactatatgaaggagctggaactggtcaccaaggccggcttccgggcccttctctctgccccctggtacctgaaccgtatatcctatggccctgactggaaggatttctacgtagtggaacccctggcatttgaaggtgaaagcagagagctctccttgctaaccaaaggaggctgggttggggcacaggatgggaggcaggaaggtctgggccagacatttccagttagtaaatgaaacaacttagctggggtgagggccacattgggaaggtggttgagagggaccctggagttaccccaccatcaccagactgttgttgcttgttttccctcaggtacccctgagcagaaggctctggtgattggtggagaggcttgtatgtggggagaatatgtggacaacacaaacctggtccccaggctctggtaagggttttcgggggggaggtggagggttgggcctgagagcaggagttctcccttagagacccaatcccatctagccacctctggactagtacccttctttcaggcctgagagagagcaggccgtgcaacgagccttctgaagatttgtgtgcaatattcactctccacatgacttccgtctatatccctccagctgccctttggtatgtgggatagggattgttaaccttacttcccagagagataatgaggcctggagaacataggtgagttgctcaagacccagcacaagcatccatgattcctgtaataaggcttccctctgctgttttcactgcagccttaccaagtatggttgggtgtgcaaagtttacattttaaggacctctgctgctgccactgtcattgtggttaatgatggctttaaggtttattcttattcccgtatctttgagagaggaagagagtgggattgctacccacattttaatgaaggtggagctgagccgtagaactctctgggagccatccaacctggctgtggctcataacaaggtattgatcacttcctttggcctgagtgagtccagggtgcctagacaagaggtagcagcctgtggatgtccagcacctttgcagggaatacagggcccaatctggcacatgccccttttcctccaggcccagagcaggggctgttgccgaaaggctgtggagcaacaagttgacatctgacctgacatttgcctatgaacgtttgtcacacttccgctgtgagttgctgaggtaagcaagctgtggggccttcgcaaggcggagcaggccagatccagggctggggaaccccttagagagaggaagacaataattaacaatagctaacacttacagaggcttatagtcagccctcatccacggattcaaccaactgcgataaaaagtattcaggaaaaaaaaaatacaacaaaaaatggtacaaataaaaaatactgtataacaactatttacatagcatttatattgtattaggtataagtaatctaagatcatttcaagtatatgggaagttgtacattggttatatgcaaatactatgtcatttttatataagggacttgagcatccttggattttggtatccacgggggtcctgaaacaaatcccctgtggatactgagggacaactgtattttgtggcaaacactgtgctaagtttgttacaaatattgtctcatttagtcttcaccacagccccatgagacaggtgcattttagagatagacactgaagcacagagttcaggaccttgcccaaagtcactaagaagcaggatttgaaccaggctgacttacaggatctcatgacacctttgcctctgtcagggatgtgcctgtgtaagatagtcatttccctgattccttcattggctaggtcttgagtacttgggggacatagcctagtgcagagcagagtcctgggctgagagtcaagcatgatggtgtctaagcctcaattatgtcattcactgggtaacttccagctggttctctaagcatgttgcttacttggatgataagggaagcatgcctagaggtcccctaaggagattggtcaggttatagactgagacccaaggacaggatttcgcatccatgttcatggacaggacagcacctaagtcccccagtgccaccatatttacagcattttagagtcaggaacagagggctaagtagaccaagagcattggctgcctttcagacatccatctatattctaaagggattgagttatttggggttagggtacagagatgggcaggatataaatagatgtcgccaacgtttctggatctccaagacctgtatcagaatcacctgaggcacctgttcagcttgcagattcttgccaatactttgccccaccccaggtgagaatctctggaattgagattcccaggtgcatttggtgtacagtgacagtttgagagtcaccgaaatggggaaggagagactgttgactggtgtgaaaagtgttgctggggccccttctgaggggcttatcttgccatttcttcatgtcctcttgcaggcgaggtgtccaggcccaacccctcaatgtaggcttctgtgagcaggagtttgaacagacctgagccccaggcaccgaggagggtgctggctgtaggtgaatggtagtggagccaggcttccactgcatcctggccaggggacggagccccttgccttcgtgccccttgcctgcgtgcccctgtgcttggagagaaaggggccggtgctggcgctcgcattcaataaagagtaatgtggcatttttctataataaacatggattacctgtgtttaaaaaaaaaagtgtgaatggcgttagggtaagggcacagccaggctggagtcagtgtctgcccctgaggtcttttaagttgagggctgggaatgaaacctatagcctttgtgctgttctgccttgcctgtgagctatgtcactcccctcccactcctgaccatattccagacacctgccctaatcctcagcctgctcacttcacttctgcattatatctccaaggcgttggtatatggaaaaagatgtaggggcttggaggtgttctggacagtggggagggctccagacccaacctggtcacagaagagcctctcccccatgcatactcatccacctccctcccctagagctattctcctttgggtttcttgctgcttcaattttatacaaccattatttaaatattattaaacacatattgttctctaggcactgtggtagtgggtttttttgttgtttttgtttttgagactgtctcaaaaactctgtcgcccaggctgacagtgcagtggcacaatcttggctcactgcagcctctgcctcctgggttcaagcgattctcgtgcatcagcctcctgagtaactggaattaataggcacgtgccaccatgtccatctaattcatatatatatattttttttttctgagacggagtctcactgtcacacaggctggagtgcagtggcacgatctcgactcactgcaagctccacctcctgggttcacgccattctcctgcctcagcctccccagtagctgggactacaggcgcccgccaccacgcccggctaattttttgtatttttagtagagatggggtttctccgtgttagccaggatggtctcgatctcctgacctcgtgatccgcccgccttggcctcccaaagtgctgggattacaggcgtgagccaccgcgcccggccgaattcatctatttttagtagagatggggtttcactatattggccaggctggtcttgaactcatgacctcagatgttcacttgtcttggcctcccaaagtgctgggattagaggcgtgagccaccgcacgcgggcctgtggtaaattgttgaatttgaaggactcagaggccctggtcaattccaaaataacgtaggcgacttccatccccctcctcccaaccattttcagcccaaagcatcttcgcagggaatggatggctgcgcggaggtgggcggtggctctggagagggtctttgcaggtgtgattttctctagaaggaaatgtctcgtcgtggacccagactgccccctcctggtttcagatgcagaagtgatactgtaagccagaggcgggggcagtaatgcatcgcagccattttaggtgaggatttccttggcggttatttgttaagttctttggctgggccctgggctggggtaacaatggacaggttccaggcatttttttcagaaagcttccagtgtagtggatacagaaacttcaggaaggcagggctgagaaggatctgagtaaaactcggtccttcaacaccatccttcagcccctgggtcatgttccttcgaggtcctggtgggaggtagacaagcctagccttgtgctgttcctgtaaggacagggtgggcattttctaccaacagaattcttggaattttcacacagcccagcctagccaagtccagggctatagcccagatacacaagttaaggtcccagcactggcacccaccacaggagcccccttacctctattacccagaagcttgtaggaggggtggtccgcagacaaggaccctgcacaggtgcgaccctgcttccctcctggtcataactttcatgttactattgcttgggataatgttaagtaaaaatagcagacactgagttttaagtctcaagtggatgaaggcagagatcgtgatacacttgagttaaagcagtagggttctgtcattttctattcctgttgtaaacattttctttaatgttattatttttaccactaaactaacgtggcctggtcacgactttcattggtaaagtgtgctgttcctcaccctccaccgttgctcctttggtccactgatcataagagcatttacctgaaggtcgtcagacctcgaatgccaacaggtcaactgcagtggcctgcagttaccacccagtctgttccaatgaacagaatcgctgttgccccaactcatctcccttcacctaggctgtaaattgaaagtcccacccctgagcggaacacaggccatcttgtgtgctgtgcaccaccagggggcggggaagtttccagactgacttcctggctccagtcatcctaggaaaagagttctccagtcgctccccacccccaccccttcccattccaggagtctattaaggaggcaaagcaggcctaacgggtatcaaagcaaaggagtgaatggagactgggag

SEQ ID NO: 16586 - DNA, 35913 bp, Human
  misc_feature (1)...(35913): n = A,T,C or G
ccaagtgctgggattacaggcctgagccaccgcacccggcctactatgcacctaatgtgagcaacgattcgctggatttgtctctgccagaggctcgtggacagcatttctagaactgtcagatcaaaatctgcaactgaggagttagtttgccatcaactctacatgtacatttcagtcttgtgaacatatctagatttagaactttttcgtttgtttgtttttgagacaaggtctggctctgtcacggaggctggagtgcagtggagtgatctctgctcactacaacctccacctctcggattcaagcgattctgcctcagcttcccgagtagctgggattacagacgtgcaccaccatgcccagctagtttttgtatttttagtaaagacggggtttcgccacgttggccaggatggtctcaactcctggcctcatgtgattcgccggcctcggcttcccaaagtgttgggattacaggcgtgagccactgcacccagacaatttagaactttaaaatacaatatagtccagcatcggccagatccttgccatcccagtgttgtccaccactgttcttagtttgtcctcagctcaggggccagggagggacttttatgccatccctctttctctgatagagaggaatctaaccctccctaggggggcatgtcttttttccttctcaacaacttcatgttctttcaccaccttaataatcaagcatttccttcccaacaacaactaaagggaccaggaaagacttacagaagaaagtgaaagatttttatctcacttcaaacagaaatttacttttaggctgtcactgtctcctcccagcttatctgagctaacaggaagcgaatgaaggcctgtgattcagctgcaggcagcgggtatgcctgagcaggtcacacccatttggtctcttttgccaggaaaataaaaaaagaacctaagagaacggtcttcacattttgaatgcgcaacattgtatctgtgaatgaaggcaagagttaacagctgtttaattgataactgctcgcatcattagttgctggctaacaactgggaaatcagaaaatgtcttgtagaaaaatgtaagaaaagttccaacaatactgacttaaacacgacaaaggtgaaaacagaaatgctgactcctgcataggttatcggccctaatgttctgacttgatatttccagatgcccagctctgcgctaatatcaacaccgtctatttactttctactctgaggcattcgctctgcaggattccagaccctactaaattattcacatggccccaaccggtccttccttgttccgcggtcctaacacaatgaatggtcctaagaggaaaacggcctcgcgctcccgctccaggcccacttcgcagtccctagttctccctactgccgctccagtgccagagcccctccgaaggcggccaggacctccaaccacgcacaagtctgcagctctccccaactttccgttcagctcagtctccgagggtgcgccagagcagacacccggaggagtggggagtggcagggcggggccgggagaatgctgccccggaacccataaatctgggccctgcccaggtaggccgggacagctggggtggcctgggccgagagccaagaaaagagaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggtccgccggctcctttcccgccccagccctaccccctcattctggtcccatcctcttcctcctgccccaatcctcaatgcgcctccatcctcgcctgccttctctcggtccctcgtgattgattccacccttgcttcccctttctccgcgccgcctgttccgtgctcgttttcccctcttcctccttaagtctggtccttccaccccctcctcttcaagctgtgcgtgtcccctgattctaatgctttctgtgtaactcattgaaactgcgttctggttcccctcccgcgtccattctccattcatgcgcgaccgcccttcccgcgccccagttccctctcgccgcccctccccctgcttgctggtcacgtccgctcccccgcatccccttcctcgcctggcgtgtccgctccctccctccctctctgctctggtcgcgcccgcccacttgctccggtctccgagcgcggtcccaccccccttttccatcaccgcctcccagctcccagcaggctcgggcggtgctgaggccccgtgtccggggcgggcgggcggagggctgggctgggtgccccgcgcggcgggcgggatgcggcggcccgggggcagctggagacttacgtaacgttggcctgccccgctgccgggaggcagggcggttgcccctgcggcgcggtgccgtcccctgtggccgggattagatgggcggcctgcgagggcctgggaatggctcggggcccgagagctcgaccggcccttgccgggtggccgccagggaccacgctccatctcgccgcggccgggctgcacgtagcggccgcgcccagggcccaccccgcttcaccgggcgatggccttgggcctcgtaacgggcgggataaacctctgcaggctttgctggggcctcctggccctcgcccgttccgcgcctctccggcacgtttctttcttttcctttcttttttctttcttttttttttttttaattatccggcacattttttaacaaatgcgtcctgattgtggaacgcggaggccgcggggtggggtggggatctggttacggagggggcaggaaatctgtcgcgttcactgaacgcaaacggtgtgggtcaagggctgtttgggggtcagagttagagaccaggatgactagacgagtcatagcccaccgagctcacaatcttaaaatgtatctcctgtaatgctgggagtggggtacgagcttcctgctgtgggagggagggggacaggaagcctcgtaaggtctcaccaggtggcaagcacactggattagaagatgcaggaaagcaccttccagtctgaagatcatttaaagactcagtcatgtaagggcatcccttggcttcttaatctacgtactccagacccagggcttggacctttgctggtacgggttaaagtgaggccgacagtgaaggtccacgtggagagagacattgggaagttgtcaaaaaggcgtttagaatcaggtttgactcattaatttcctgagactctgaaggagttcagcctctacacctcagtttcccctgggaaaactgggagtaacattttcctcatgatggttgaaaggattcatgcttacgtggatgtggcacactcagtaagtgtctaatctctggcgaaatacccagaagaaaagcctgtgactgaatatattatttttgagcacaattacttagtccacaattgagcataagggccttgatccattgtcttcctactgtccccaaacgcctacagctaatcgtgaggaatcaggctctctgaataaccacgtgtctcctggaaaccagttccccaagggatctggtttaatattgacaaagtaactgataatgtaactttccaactctctgcttggagcagatgctttttggtcatctgagattgggacctgtagacaaaggcaggcaaggaggggctgagttaagcctttggtgttccgctgtaagtagaatactacctaccagaggaacattccagcccttgacttgctctgcctgctggtgagattaggattggagccagggtcagtagcccccagttggccgtcttgagggtgtggccactccctaggtcacagaggagatggaggtcaggactcccctgctgcagcgttgttagcaaataatttgccctttggtggcctgaggtgctgtgggggcaggagtgggctgtcttgtggggaagggaaatgtaacgtatcaccaaatctgtgggggagtggggctctgtggggaagatgactcaacctttcaattattctgcttttgagagaattatcttcgctgggtgagtggggaaactacattgtggttcttgcaggcttaaaaagtcccttctcccctttcagtgagtcagataatgaagcatgcatttcccctaattaaaaatgcctcaactacggagcttgcagtgagccgagatcgcgccactgcactccagcctgggcgacagagcgagactccttctcaaaaaaaaaaaaaaaaaaaagccacaactaattaaaaaatgattggtccgggtcacctggttctctgtactgccttaagagcttaagtgtagactggcagagcccggtgcccagctaatgccgtctgtgcagcttcattcctggcccttttgtagcgggcacagccgcctctcctgggacttgattaatgatgacttaaagaaggttcttgaactcatttctcagttactgacttgagccaaaatgtatggatgttggtctcctgtctagcacaactgctttcattttaagcattgcattagaaataatgttgtattcatattttagcaaagagcatcattagctctttaagaaccgtacccccagtgacttagcaaatttggtggcggtgactctaaacagctagcactttatgggagttgcttctgtgccttgaatgttgtgacactgatgtggggtcacaggaaaaaccattttatttcctaaagctgtttatttcttaatattgaggcaatggaagaaatgaggaaacggccgtgggcaggaaggtagaagaaaatgcagcacttacattacaaactcactttacttgggttttagtttattttgcttcagttttttgtttttttttttttttttttttttttttttgagatagttttgctcttgttgcccagtctggagtgcaatggtgtgatctcggctcactgcaacctccacctcctgggttcaagcaattctcctgcctcagcctcccgaagtagctggaattacaggcacttgcaccacgcccagctaatatttttgtatttttagtagagatggggtttcaccatgttggccaggctggtcttgaactcctgacttaggtgatccaccggcctcggcctcccaaagtgccgggattacgggcgtgagccactgcacctggcctgcttcagcttttatgaaggcaagtcaggatgtgttatcttggccaagagctaagactgagaccggagtagaggaaaatgactcatttgacattacccttctttctgaatcactccaaaagtccacagtcaaatctcaattagctggtataacacaagaatgcgttgaccctgtgagcagagttttattgcaacttcaagggtcttcgtgagattggtttatttggtatgaggtcttaaggattttaagttgtccctttaagcatcagttctgatacagatgggaatagagctaaacaaccagatatatgaagaccatttttgataccaccatacttgcggggagcttgcatttttttaccaaggggcagactggataattgagtaatttaaatacttgggactttgttaaagaagctgttgggggaaggtgagcctgggtgagtggtggagggtgatgtgcagcatctgctgggccttcctgcctcttggtatgactgctcagctcaggagttgggtgctttagggcccctaccatgcagtgcggtgaagccccgcccctgcagtggtttgtgcttgtctgcacgtaggagggaacaagccggctgcagtaccttcggtggcctctgagactcacctcccccacttctgtccatagacaaagctcctggggagccctaagcctctttcctcatgccagcaagcagtcttggaagcaggctggggctgcagtgggagagatgccaagaccagttattcaagggcagtgaggttgccagtcctagcatttcacactgtggaccagcacagctgctggctgaatactgcagtcaagattctctgaagggagtcctatcccttccaaacatcttcagtttacttgcagataatgtttcttcattttttattttattttattttattttatttttttgagacggagtctcgcaccatgacccaggctggagtgcagtggtgcaatctcagctcactgcaagctccgcctcccgggttcatgccattctcctgcctcagcctcctgagtagctgggactacaggcaaccgcaaccacgcctggctgattttttttgtattttttagtagagacggggtttcactgtgttagccaggatggtctcagtctgctgacctcgtgatccacctgtcttggcctcccaaagtgctgggattacaggcatcagccaccgcgcctggccatgtttcttcaattttaaacaactgatatctcccttggccatgaacgaaaaagaactgcccatcagtggagtcagtcagggcacataagacacactgtgtccaccatgccatttcagaggagatttgattgagttaagcagggaaatagagatgttgtaaacgttgaaactatctgggtatccctctttggttattaacattagatgagcagaaaaacaaatgtcaccgatgggcaaacatttaaaaagtctggcagtaccaagtgtggaaaaaggtgtggaaggcagcaactcagcgttcattgatatagccactttggagagcaattcagccttatttagtaaaaatagaaataaacatactccatgacctaagacttcaatttctggatatatagaaactcacacagtacagggagacatgtactacaagagtattgattaatagaagaaacttagtttaacggggagggagagtggccaccagtaagacagtccataaataaaatggtctgttgtacagtggactagtgtaacagcttaaatgaattagctagatccatatacccactggatggatcttaaatgtgctgctgagtgaaaaacaagttactcagtgatatatacagtataccacttagggcattaagaaaaccacaatattatagggttcagtatagacatagatacactgtacatagacttcagtgaactggaaggatatagagttcatgacagtgattgggtgtcaaaatgcatgatgtggctgggagcagtggctcacacctgtaatcccagcactttgagaggctgatgcaggaggatcacttgaggccaggaggtcgagaccagcctgggcaacatcgcaagattcccatctctatttaaataaataaaatagaaaaaaaagtttaagatggaggtggaaagggttggaggagcttggggatggagaaaaaatgaactgtataaaattaaaattcttgtttttgtttttagaaagtaaagagggccgggcacagtggctcatgcctgtaatcccagcactttgggaagctgaggtgggcggatcacgaggtcaggagattgagaccatcctggctaacacggtgaaaccccgtctgtactaaaaatacaaaaaaaaaaaaaaaaaaaaattagccgggcctggtggcgggcgcctgtagtcccagctactcaggaggctgaggcaggagaatggcctgaacctgggaggtggagcttgcagtgagctgagatcgcgccagtgcactccagcctgggcaacagagcgagactccatctcaaaaaaaaaaaaaaagaaaaaagaaattaaagaaaatacagctcagcctttatttgtgtttttttttttttcctttttttctgagacagagtttttcactctgttgcccaggctggagggcagtggtgcgatctccgttcactgcagcctccacttcctggattcaagcaattctgtgtctcagccacccaagtagctgggattacaggtgcgcgcctggctaatttttgtatgtttagtagtgatggtgtttcaccatattagccaggctggtctcgaactcttagcctcaagtgatctgcccgcctcagcctttcaaactgttgggattacaggcgtgagccaacacagccagccatggctcagtgttaatggtcagttctgggtggtagagaggcagatgttaaaacttttttttctttaattcgtaacatagaagcaaacctataaaggctgccgtaggaagaccagtcatagtaactagttcagtgctcttggagagttggcactgcctttcctcctttatccccccgactagaatgcagggcagcccttccagtaaatgttgagccagtgcctcactttgctgaggccatcacccaccttagttgcacttaagaggaccctaaatcagggtcccaggtcccttgctgattttagagtgtggatatcatacccagaaacaccgccctacttttaatcctagtaaggaggcaccatgtcccaggacaactaatgcttcccccaaaccacctccttcaggctgaaaccagttctctgcactgagcagctgggatggaaccaggaaatcctcggcatctgaggacattgagggttctctgacttagggcttcttcacctgaagttgagtggtctttgagggaagtaggcccatttagcatcagctgctcttccctattccacactctagttggaaataggaccttaggttcctgttgacaagtcatttactttcagccccgaagaaataaaagagccaagattttttttttttttttaaagccagggaattttactagaacctacaagtgggctcattttgttctgtgtagcctggtaacaccatactgctttctgctgtggggcctcctggggttaaagtgtgggcttaagacccaggtctcttagctagaagatatcttatcctctgtatcctgcacccatatgcaaatacattattgtcattacccttaactatagatgaagatgaacagtgcctattccagaccttactaggttctgctggcccgtcacccattttgatcatgttgctggcctagtttgattagggcaaatcttagaaactccatttccattgttgaggaagagaactagagagcaggctgacctgaatgccagcgtatcatgatgcagactttctaacggatgcaggtgttcggaagagttgtggatcgaaacgccttcatgatggcttggaggtgtaggtagcaaactgacgtcacaggaaggaacacaatcttgggtacctactggcaacgttggagggagaaagtgagcatcaggtgccatcattttatagttgatctatgtgatgaggttggtatcggagcataattggtacaaaggaaaaatgacttaggcagatgcagactcacgggccaggctattttattagggcagaatgatttggtcctttgtggaagaattggtggagtgaagcgtgaatctttcccagcacaacccaacaacagtcctggccctaagaagtggagcatgggagttgggtgtggttcgtgcctgtagtcccagctacttgggatgctgaggctggaggatcgtttgagggtgcagtgagctataatataatataatcacaccactgcactccagcctgggtgacagagtgaaaccctgtctgaaaaaaaaaaaaaagaaaaaaaaaaagttggagggaggagtgttgggtattttttatgatttttgtctcctggtttctgaagaatggccaaaaaattgtgtctgacacaaaggaaactaatataaaaagccaggagctgtctgagatgagaaaggaaagggagaatagggcacttggagctgagctgtgattgtgcctgttccaacctgtcactccagactaaggcctcttagagatggtgtctcctttctcacagaggagacatggctctgaggaagatcttactgcaggggctcgggctcaagaataaggctcctggacctgggcatggtgtgtgctgctatcagtggatacgccaggcttccactgctggctggaggttggctctgcatgtctgtgccttcctaggaggaggatgcaatagtgagtcagactggcatgggtggggccacatgtcctggcaggcactgtccaggcagctggcatgagggagaggagtctttcccagaagtccgccctgagaaaccaaggctgggctgctctcctggagccaggggagtccagtgagtgttttacatacaactctaggtacgtggttggtgggatgggcagtttgtgctgggaagaggcttgtggaggattttggagaaggcaggagagctctggccctccctgcaagggaggcttcaggtcagagcctgaggaaagacctgggcatgagatatgaggtctctggctgggtagagagcatgaaggacacatgagatctggagtctggatgaacttgctgacaagcaagctttttttgactgctaatgcgtaaatccactatagaaattttcatttgtcatttttgtacttattggcaaaaaattagagcttataggcatcagatttaatttgagatagttgaaatagggtttgtgtttgaggccaatataattttatctgctaatggcatctcgtggacttggaggcagcccttctgtaccagaacattgtcaaaagcttttactgtaaagcttgagaacaaactagtttgctggatttgggcatgtaactaacaggtttgaggcatgggattatcctgtggacttttttttttttttttttgctttgaggttctgaatgtattaaggttgaccttcttaagccgttgaaactgttctgcagtacatttgtgatgtagggcctaagacttgtatcgttttttttttttaatcacaacccagtgtacagaacttgagacatgcgtcttttctctgccaccttttaaaagcagattattcttgaagtgcatagagcagcaattgattaatggaattggtgtcttcacatttcatttacttcctcccaacaattttataggatgcatataaatatttccaaaagaggtacacataatttcttactataaaagtatttttatatttatatcagtaaatttgttaataaagaggatttttttttttctgtaatcctaccaccccaatgacgtcctattaaaatttcagtatatatcctcccaggtcttttaggtatgtttaatttggtgtcccttccccgctcccaaaaggggagggaccaggttcttgtatagaatagtggaatgttagtaaatcacaggtttaaagagacataacagtggaatctctagagcagctgtcacctggatacctggttattaaggtaatttttccattaccccaaagagctttagttacactcagctttttccttaatccttgtgcagctctccagggcacaccgtattcagctctgagcggtctttgctagtgaggccaaggagccaccctgagccaaaaggggagcattatgtcaccggaagcccaaccccagagaaccaaaggtatgacctgatattcagtggccccagccaggtctttacaggaagaccctcatatctcaggtctaagaagagccagctgatggtttttaaaaagagtggaattagttactccaacccacttattcagatcttattttgttcacaatacagtccctagattgtaggcccattggaggccacagcaaagcctttgtgttccagttggcctgatgtgccatctctcagtaatgttcccttaacagccagacttccctaagcccagctgggagctctgaaggtatgcgagccctccctcaaccatgagtgtagggaaagggaccaggggccccaggctttcctgtcagtaatgcagaagttcctcagatttagggaagggggagcagaggcataactttgattctgacaaagaggcattcagagagactgaaaggtcatttaacaaacactggaatgcttccacatactaggtgctaggagatacaaaaccatataggtcctggaagggaggattgattttttcattttggtacgtagtagatattaggggcttaggaaatacacatcgaaatgaagagtgcatttgccatgttgaaccgttagccggtatcttatttccccattttaaaagttttagaatctgtggttgaggacttgtggccatcagttttccatagccaacagactgttcactactgccttcagagctccttggacctcagcgggccttctttggagatggcagagatggatttagatgtatactctactcgagccacccagagagcccacaaagtcagagatggaacagggtaaaggagtaagggtcatatgtgtgagatgccttgatttggaactttgagatttaggatgaggtggggaagggctaaagaggagcttgttcctgagccttgcttggccgaagcatttaggctcaagcgttttagaaagagtagcccttggtctgagaactcaaggaaacagctttctgatgagacgtgtagcaagcttctggttcacatccttacctgatagttcttcaaacactgcctggtctggttcacatccttacctgatagttattcaaacactgcctggaagcttctcctgagtttttgtctctaatcagctaactaacaggctgagtgagtttagttgtaagtcattaatgaagaaagcaaaggttggggccattgtcagggttgtgacctgggctagttaattacctggaactgatggtctgtgttacagagtggtggtatacttgtcaggcttagaaaagaaatcaggatgtgtatcaaaaatcatttggggaaaagatttgaccagcaactttaatttctctatgtttgcaactatcctgttaatgtagttgtgataatttcagaattataccagtgcccttatgttatccttgctttgcaaattgcaaattgctttgcgtgtcctgacatccttctggccaacagtagatgtggttttaggtttagactcctgggatggaagcttttgcattcaggggaatgactttgggtttgggtgaggattgtaaagaggcaatatgggtgccccacgacaaagcagctatttgtagctttgtgacagcttgacatgcagagatctaggcttatcaaggcactaagctaggagtcagttgtttgtatcactggaagattggttacaacttccttcattggaagctccttcagtgcatgttaaatgatgttatttatagatagggtggtgagaaagctgtctaggtagatgtcagtcagcccagtgtaagagagacctgcttactgtgggtgcttgggactatgtggagtgggtgggaggttttaacttgttcagtaaggtcctttccattgttcacaatctggtgaaccctttttctaacatgaggagcacccacataaccagatcatgtctggcttccctgtggcttgtgtacaaagcgtgcttattgagttaatgtgtaagcaggagacagccttctgtgctaaatggtatattaaccacttctcagtcttaccactctctttcaatttgtctcgacccaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggtgagtgggtgtgccccttcccccaaaaaagggcttcatgggcagtgacctttctctcctgaaaagagtaactaaatgtcctaacaaacctaggtgctacatgggatactacacagattcttatgaaaggactcaggtcataggaagttgcagtaaagaattagtatgtgcataggatggcaaatacagttaataagagagtattagacatttcaaaattgctaagatggcgaggtatggtggctcccagcactttgggaggccaacgtgggaggattgcctgagcctcgaaatttgagaccagcctgagcaacttagaccctgtctctccaaaaagtgaaaaaaaaaaaaaaaaaattagctgggcatggtggcatgcacctgtagttctggctacatgggaggctgagacaaagatcacttgagtccaggagattgaagttgcagtgagccatgatcacaccactgcactccagtctaggcaacagagcgagatcctgtcttaagaaaaaaaaattgtccgggcgcagtggcacatgcctgtaatccagcacttcgggaggctgaggcaggtggatcacctgaggtcaggagttcgagaccagcctggccaacatggtgaaatcccatctctactaaaaatacaaaaaaattagccgggggtggtggcgggtacctataatcccagctacttgggaggctgaggcaggagaattgcttgaacctgggaggcggaggttgcagtgagctgagatctgaccattgcactccagccttggcaacaagaacgaaactctgcctcaaaaaaaaaaggaagaaaaaagaaaaaaacatcgctaagagtaaatttcaaatgttctcaccacaaaaatgttaagtatttgaagtcatggatatgttaactaacctgatttaattattccacattgtatccaaactgtatgtattggattacataactttgtaacccaaattataaattaccagtttataataaaaaataatttgttgcaaaaagaatccatatggtttaggttttatgctataggcaaaatttagaagatgttttccttagcaggtctttgtaggagcaacttaaagacctaggaaagatctttctaacatgttctgtgctaccaagattctgtggttggacatctggctgggtttcagtgagggtggagaaggctggccaagtcttaacctaggcttttctgatacagtgggagcctgcagaacttgaaggaaatggtcgaagtgtcccagtagatcaagaaagtaagctggcacggtagtagccttccatgcactttttaaagacttttgagctatttgggagaggaaaagttttcagggaaaaaaattctttaaacttaagcaaacttaaatgtttttccttctttgaataattaatacttgtggctttaaaacttttcctaataggcccagcttcccgatcagtggagacgttgaaggagatgattaagtctggaatgaatgtggctcgtctgaacttctctcatggaactcatgaggtgagctgtggctggaccctatggccattgtgatggcctgtaggaaacagggagggggtgcagtgttcgtttagccacagtggactagacaaggatgagtctgagtttcacagtcagtgtgaagtttgtctttactagcccatccctactctccttccctcttgtcctgacaaagcaactggctgagtctcttttagcaaaaaggaccccctttgttgctggctgtggttctcccacacacctctcctacccttagcttttacaaaggaagatatggaaaggttctactggaaaaccctctaagccttaggtgtcctggccacagcgcttgactctcctgtcccagggtttctgcttcaccttgtgttgccatggtaaaccatctagcagattgattctagcttagaaccaaaataactgggcaggtccatgagaacggtttccactattctaagttttgagggactgagcctaatgcataagcactatctggggtgtaataccccacttcctcagcactgtattctcagcctgtgccttcccaggggttctggtacattaaaataacaccagttagcactcttccccaggagcctagtaggactgtatttgtgctgggctctttattagctggctttacctatggacagaggccttgcccaggagccaggtagcagctgttgggatggctccattcctgcctccattgccagatttagaattaacccattctgaggagcttggggttccctgaggtaccatgacttatttatttttttattttataaaacaaaattttgctctgtcatccaggctggactgcagtggtatgattatggctaactggatccttgacctcccaggttcaagtgatcctcttgcctcagcctcccgagtagctgggaatacaggcatgcaccaccacacctggctaatttaaaaatttttttgggggaaatgaggtctcactatattgccttggctggtctcaaactcctgggctcaagtgattctctcaaatgttgggattacaggaatgagctaccatgctcagcctgggattgtgcctttttaaaaccttcagacttaaccataggtttcccatagatcatgggatttcgtaatggcattgataagaggaattacagaagaggcaaactttgcacctgtcttggcttctgtatttcctgttgagagtaaagaaaatgctatcctgtaaggccaattgccttacagaggttgccctctggcatttggaagttggtattaagtttggactaaaaataaagcctcaggaaatgcaatccaagagtgaattcctccttttgggaaacacaagactcttcatcatagattccctaacctgtgttcataaacagcctatggcctggctagtggctggcccttaaatgtcatggggacctgaccaagtccagcagacataccatgtaggttaagacatgtccctgtaccttttggaaaattctgtagttttccaaaagcaaggggtccttagcaggagtcaccgagaattacttgttagagaattaagtgttagcttagcttagagagagctgaagacaatgctggaggtctgttcgctgttgatccctgctgctgtagtctgccatgggctcctgcattcaggggaaggagcagaaatagatttttaagaagttgacctttaagtaggctttatggttccttcatccagtaaaataacaccacatagctctaacatggcaagggcgagtgatacctgccacacctgctggatgagagctggctccgattttggtattttaaactttaagaggcttttggagattatctctactttcactcctattcccagattataattaagatttattttttattttttatctatttattttttaaagatgtccctcttgtgtgttcattttgaagttttagaccaagatgaggttgtgtgtgggctcagcttggaaactgatctgaaattattctaatttatataatgtaatgtaaacagtttcagccttaccatacgtcagggctatcgtttcatgtgcacctttgactaggggctggggcgtacttttccagtttctgactattttaaatgctcttctgagcagaacgttgagattactgtcttccctctcactctgacagagggacatcaaatgtctgcatctgatcttttaacagcttttttttttgagacagaatcttgctctgttgcccaggctggagtgcactggcacaatctctgctcaccacaacctctgcctcccaggttcaagcgattctcatacctcagcctcctgagtagctgggattacagacctgtgccaccacgcccagctaatttttttatatttttagtagagacggggtttcgccatgttggccaggctggtcttgaacttgtgacctcaggtgatccgactgcctcggcctcctaaaggcgtgagccaccacgcccagccctcttttaacagctttggcaactagtcttcagccctcacttttggcagttcacatgggcaagatgcattcttgctgaacatgtggttccatatgccatgttttccagatttatttatttatttatttatttatttagagagggagtctcgctctgtcatccaggctggagtgcagtggcacgatcttggctcactgcaacctctgcctcctgggttcaagagattcttctgcctcagcctcctaagtatctgagattacaggcacctgccaccacacccgactaatttttgtattttagtagagacttggtttcaccttgttggccaggctgatctcgaattcctgacctcaagtgatccatccgccttggcctcccaaattgctgggattacaggcgtgagccaccacacctggcctagaaataatgacttttaaacaacctaaatgtagagccttccacaggacagcattgatggatgctttaccacataacatcccaataaagccacagctgaagtggaagactcagtacacctcccagagatgctctaagagattatgatatatgacatagatttgaataatatacctaataattggtatgtttataatatatggttttacatccccaagaccaaaaatgcatgtttgcatgaaacactcatggttacaaaaatatattaggccaccaaaaaaacccccacgtttcataaagtagaaattatacagacacattctctgataaaattttttagtggaaattaagaacaaagtcaagaaaactgaagtgtgcttactttagaaagcaaagatctcaaggtagatgaaataaatatttaactcagaacactaggggaggaaaaccctaaaaagggtgaagaaaataattttgtaagattatagctcaatgaaatgaaaataaatttgacagattaagctaagagctgattctttgtggggaaaaaatagtaaaatagaaagttctgagaagccaggtgaagaatgcgaggatgtgcaaataagagtatgaatagaaaagagaatatttcctacacattggagattttaaaagtcaagaaagacttataacttaattcctatatagagagatgactctggctattttcaaagaaaagataaatatccaaaagatagaaaatatgaatagaccagtggccataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattctaggagaacaaaattctacatcgggattaagtagagttaaggttgacatttttttttttttcttctgagacggagtctcgctctgtcacccaggctggaatgcagtggcacgatctcggctcactgcaacctctgccttccgggttcacaccattctcttgcctcagcctcccgagtagctgggactacaggcgcctgctaccacgcccggctaattttgtttttgtacttttagtagagacggggtttcaccatgttagccaggatggtctcgatctcctgaccttgtgatcccccctcctcggcctcccaaagtgctgggattacaggcgtgagccactgcgcctggcctgagttaaggttgacttttaaacaacctaaatatagctaaatatagagccttccgcaggacagcattgatgtgtggaactcttatccacgtgataacatcccaacaaagccacagctgtagtggaactcagtacacctgagtcttatcattataagatgataataggtaacatttattagataattaccatgtactttgtcctaatacttcatgtattcttttactcctcacgtcaactctgaaggaaaggcaccacctatccccttaaaagaaaacaactattactattctttttttttttttttcttttagagacggaatctcactctgtctgtcgcccaggctggagtgcagtggcacgatctcggctcactgcaacttctgcctcctaggttcaagtggttctcttgcctcagcctcctgaatagctgggactacaggtgcacgccaccacgcccagctaatttttgtattttaagttgagacgaggtttcaccatgttggcctggttgttgtcaatctcttgatctcatgatccacccgccttggccttccaaagtgtttagatgacaggtgtgagccaccgcgcccagcctctattctattctattttgttctatttctattacaagccagtaagcaagaaaatatcataatttataaggaaccctataaaaaacagacaagccaagggtctgtcattaggaagtatgcctgaataagaagctgaagatttttagacacaggtttcaggcaacactgtctttagaggctaggctctggctccagctccctccagcctcctgtgaataacaggcaggcttacttgcaggtgccactttcctggacagtggtggttaaaggacaaggcccagaaagtgctgaattaggtgcccttgttaccgctaatgtcatattgatgacactatcttagagctcttttgacatcttggctctgcgtcttttttttttttttttcttgagatagggtgttgctttgttatccaggccggagtgcagtggtgtgatcatggctcactgtagccttgacctcctagacataacccacctcagcctcacaagtagctgggaccccaggcacgcaccatcatgcacagttaatttttgtgttttttgtagagacgaggtttcgccatgttgcccaggctcatctcaaactcctggcccaaactgtcctcccaccttagcctcccaaagtgtttggtttataggcatgagccactgtgcttagcctgagtccctcttttaaacaaacaaaatggtaaatggaaaggaggaaaggcttaagaaaaaagattgaagccaggatttgttgtaagcaaggagtaataaagggcagttcatttagagaaaggcatatgaccacctttccccctccaatcagaatctagaaagtgattgaggccgggcgcagtggctcacgcctgtaatcccagcactttgggaggccgaggtgggcggatcacgagatcaggagatcgagaccatcctggctaacatggtgaaaccccgtctctactaaaaatcgaagaagttagccaggcgtggtggtgggcgcctgcagtcccagctactcgggaggctgagaggcaggagaatggcgtgaacctgggaggtggagcttgcagtgagcctagatagtgccactgcactccagcctgggcgacagagcaagactctgtctcaaaaaaaaaaaaaacaaagcgattgagaaaatcaggtctgtgtgaccttagcaatgagttatttagcttgggccactgttagcttaagtcaataacttcaagtttgcgttgtagttggaatcaatagaggaaaagctctcagcattaccacatatatcagaatgtgacattgattgccagaccagccttatccaaacacaagtcctaggctttttgccctgtttatgagctttatatgctgagggtatttgatgagtcttagggaaaaaagaacagccctggggacacagctgcttttatgatgagacatgtttgcacccataccttaatgggttttggtggcaatattctgaaatttgccacctacatttcaaagatttgccctttgggtgaattagtgctgtagtagaagtgggtggaggctgaggaggttggattaagcaggtagaggatttctcagtgcatggatcgtgctgaggatggagatagagctctaagacatccacgggcctttcctgagtgatcagctttggctcctgggcaggggaattggagctggattctagtgtgggagcacgcttgtcatcttccttcttttcccccagtaccatgcggagaccatcaagaatgtgcgcacagccacggaaagctttgcttctgaccccatcctctaccggcccgttgctgtggctctagacactaaaggacctgagatccgaactgggctcatcaagggcgtgagtattctgcggagagcgaggggaaggctcagtaggcaatatgccccagagacatgtcctccaaagcgctgggttgccatgtttcttcccagtactatgaaggactgcagaggagttgaggtctacaaatgaggatttattcatcactgtaaacaatgttgatttgatctactttgctaggaaatggtaccacaaaggaaccttttttttttaccctaaaaacctaaactttaggctttctaacttggagaaccatctctttgtatctttttccccatcattaagtagcataactgaaacatattcttttcttggattatttccgtgaagtatacagagttagagaataagagcaaaaaactgtattacttttagcagtgacttgagcattgttcccgggaggaaagagcttttccattccttctgaggtgatgctgctactggtgtctccagtttggactcttgcttactctcttgtccctagagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtacgtatgggagctggagtccagttgtctaaaacagtcttttgtctctaaacttccttgacacaaggaagatgggaaggttggttgcctggcagtgagattgagtctgtgtgttctcaggaatcccttttataactcatttatcctcaaagataggctttaatccagcatagttacattcttctggttctggagaacacaggaacatacatacatatatatatatatatacatatatatatatatatatatatatatatatatatatatatatatttgtttcgctgtgttttgttttgttttcaagacagagtctcgctctgttgcccaggctggagtgcagtggcatgatcttggctcactgcaacctctgcctccagagttctagctattctcctacctcagcctcctgagtagctgggattacaggcacccgccaccacacccggctaatttttttgtatttttagtagagatggcgttttgccatgttggccaggctggtctcaaactcctgacctcaggtgatctgcctgccttggcctcccaaagtcagaacagtcttaattatccttatttatgggtgaggaaagtgaggtacagagaggttaaatggcttgcccaggattacacagtgtagtaggttttcaactctggtaaaacagctccagcacccataatgcaccacttcccagctcactgtccttgcgggaaaggtgcctgcttcctgttgacctgtgccctcgtgctctgcctcccctacttaccctttttcatacaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtccccgttgtccctgctccagtcccagcgcagctctccgaagggcatggtccatcctgtgaatgtctgattcccagcccctagcccatcagaatgtagactcccaagccagttccaaacctgctgaatcagaatatcttaggagagtagaaggcattatgtttttttgtttttgtttttttgttttttttaaaaaaaagcttcccaggtaattgagatgctggcagcttgacattgttccctgggcctggggaccaacatttgagagaacagggtcactgctcacaggaccaggggccatgatgttctgttcctgatcagaaacactaccagtgtttgctggaatggggggaccagggggaaagatgacagcagacacttaagaaagggctctttttggcccttcctggggagccatgtggaatttcagggcctggtgtccatgttaaagcttatggcctcctggtcttcacttagaatgcagctggctcagtgatcatgctaactctggtatggtccattccactctcagaggaagatgtgtggttcttctccagtttcagattgccccaacttagcttaccccctccccaatgctcacaaagtagagcccagtgggcatggccaccatttttggcatcctgctaggaatacaactcagcacaactaagatgctagacacactcttgtggattagaagtgtgtttggggagggtgggggagcaaccctgtgcacccactgtagtggccttactgtctgagctttgtgtagatatcctctgtaccaggcaatttggggtcctcccctttgccatcctgataagccataggctagctgaacttggccctaggccaggcaaagccacattccctcttgccttcagcaggttggagtgggccacctcaaagggcagtcctcaagtgtccttgactagatgaggccatgggtctttgtggtggaagcagtcatcaggcctcaggttccctgtcttgaagtgctgattggaaaatggaggccctagagagacccctaacatgcatgggatttggagaggagaccttgggaatgagcccatttggatttgccctctcccctttcttccgtcaatgaagcatccatattggtgttgaagcccagcaggcagaattgttggcccactctgggggcctaaggtagctggactgccttgccatctgtgtgcacccatgatgatatcatggatgtctgtcctggtacaaggacatctaagttagggaatcccagggaaacttcttgtctactgccatacttgtggcctctgttctatataacctctctccccccaactttgtccatcaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcaggcatgtgcccacccttccccacattctcatgtgcacactcgcatgtttgtatgggaaagctctggaggctgtctgatctcttcccatggaattgtcgcacgtaacacacagataatccccttcccccatgtacctacacaaagccatactctgtgtacctactcactatccagaggatcagcttgctgtcatttgtctctgaagacagctcaagctacatctcactaatgctctgtcccctcccagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctggtgagttctggggcctgccccatcccccagggcttcggactgggcctgggatggatgcaagctctggtgcagagctttttaggtttctccatcctcttatgcacagcctttcattatcctccaagttacagcagcaagagggtgggggtggaagtggaggtggcttttttttttctcctgttctgcattcctgcccacacccccacccctccatttccttctgctctggaggcatcctccttcattggacaccacacagtttatttcacttctgacttcaaggttgtgaattcttcccatggcttaagtcctgggatacttctgcagtgaaaggaggtcttgtacctcttcctcagagtcagaagttctgagtacctttgccctattctgaaaagggctaggggctcctgctcccagctgccctcttcctttggcttccaattcagttccctctgccccgcatcctgcagacaggcgctcccgcagggggcccttgtggacctgcactggagtctgttgccttcactgagctgcctgtgctggccttgcatggtgcctgtagggggatttgctttgctgtgccattggggtacagctgctgctcttactctagaccaaaaagtcgggttgagtgactggtggcagggccacagatagagacagcggggagggtggctgaccctggcggccctggactgagcgtctggaggagtcgtggaggctctttcccttctttctcctctgagagctcgttcttcaggctcttccagcttgtcatgtcgagtgcctggccactgctcagggttggaggctcagtccctttgccctgtctgttccagctctggagctaactcagggatccctgatcagggttacataggtttggtaaaatgagtgctggaaattaactttctcccagtagtcttaggtcatgctcagtgaacttaaactttatccagatatggttttccttcagcctttctattccctttctagccagtgaaagacccgctgccctttgacctcagcccctccaagcccccaagtttaaaacgccaccccctgccaccagaaaaaacagaaaaaaaaaaaaaaaaaaaactaaaacacccatctggtctgggcatcttcctttcctttttcactatgtatcctgttactgggcttaaacagctttcagagaagagatgtcatttctattaaatgctctttcagtagcgaactgagttcacacttgactaaggatattttccggactgtctgtcatcagcatccttagtgggtttccccatatttaaattggtagaggccagggatggtggctcacacctgtaatctcagtactttgggaggccaaggtaggtggattgcttgagctcagaagaccagcctgggcaacctggtgaaaccctgtctctactaaaaattcaagttagctagctgggcatggtgatgcacttctgtagtcccagctacttggagagggggtggtgctggggcagcaggatcgcttgaacccaggaggttgaggttgcagtgagccaagatggtaccagcctaggtgacaaagtgacaccctgtctcaaaaaagaaaccaaacaaacataaaaaaaaaaacaaaaaaatcggtagagagtgatttctctcccaggcccacttaatgtagactgggcctggctgacacctcaccattcgtgtgatgtgattgctgttctgatgcttagatactcttggcgcagtctcacaattgccaccatggtaggaaggtgtcccaggagacggtgcaccttgaaccagtcaccactaaagtggctgcctttctgggtctctccacacatcccctctctctaatttccctacttaatcgtgtgacttcatggtctcaaaggaggaacagaggctgatcttgacttagatatactgaaccatgaaatcactgcatagaatgtggggacttgaatgtgtctttgggcaagtcatttaacctcttaagacctcatctgtaaaatggattagatatgtttaattatagccttagcattaaatattcattgctgttattattaagtgtctgataagtctctgtgtacatggatgtaatcttcctaactcccattacctccatttatagatgagggttatatggccaataaagcctgggtttgaatctaggtctactgcctccaaagccagtcttctctcctgcaacatcatgctctgtctagcaggagatgagaacaggtctccatttggagcctgtcagtggggtcagagactaagattcaggctcagggtctaaattccgtatcctttcttccataccctggtgtttcctatgaacagatagatactttagggctgcaaggtttggattgcatggcactgctcagaagataagttacaggtctgggctaggctgtagctgcccctccaggtggctagacctttcctttctgtgtcaccagttaacactggccaacagttccttccattaactgttcactgctttctcctgtgtctaactgatgcagtttatgacccataactaagagcagtaccaggtatggctctgtttcctgttcatgtcccctgtcctctgggctgcatgcattccgttcttacagaaagaatacctttaacctagtacatcctgccacacatctgcttctactgtgaaattgatgagggggtattaccgattcttccctcacccatcatttactgagatgctggtgattgcattataatcctctaaagcttacattgtctttctgattcttggtcttatctgagcaagtgatctataaataactcagtggctttctcatgactgttttaattattagattttaatcaagtgtcttattaaatatatctgcatgcttccacaggcatctgtctcttcacatggctgttcagtgtgcctctcacaagttagcccacgttttctgttctcctgcttcaaactcagttgagctgccttgctttggctttgatcccagctttccagcgctgctcaatctgttgccatggcaggccattggaaaggctcagtgcatccccgtgcctgaagccaagtgagcgctcactccatgcatgcatggaggctgggcaggagcctgcctaatcaaccagccatgtgaggagggagggcctgttccttcctgtaagctatgtcatgaggcagcgtggtcaagtcctctgccagggagtggcctgggcccagcctgggcatgttttcatgccagggtgctagagcctactgccagattgtctccctccacccccaatgaaaaaatccttccagaagggaagagccaatttcccctgtattggaggggaagtggcagcacctcctgaagcagttggactttcatcaccctacctctgcatctgcctgaaggacagatttagccaattaacctaaggttaccttcctctctgataaattccccattctgtcttcccatgtgttgtgtctcgtttttttcctcctccttccctcttccttgccccctcttcccctaaaccttacagatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtagggccctaagggcaggtaacactgttaggataaccagcctcttgctccacctgctctaggagaagacagccaggcccaacctggcatctgggcacagagcctcttctcgtctgtaggaacaccgccagggaggtcatggcagggcaggaccaaagggtcctgtggctcagtaggcacagtagatgtcacaggcacttggtgaaggactggtttctgtggagtcttgatcttggctcagctcagaatctccagtgattgggctcctcttggcctttgttcccaggaacatgttcctcaccagctgtccggtgactcttcccctccctctccttttgtgacaaagctctgacaaagctctgtccccctctcgtccctctggacggatgttgctcccctagattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtaggaggcggcagcggctccctggaatgccctgctcagtggtacctcaccttgggggtcctgggagcagtccattgaacaatgctcaggtggcactgagccaaggtaagacccctctgcctgccaccttgggcctgcagggaaggattgagcagagccccttccctgggcccaaaggactctaggtagcactcataaggaatgtcagaacatttggatcaaaagcaaatttatgctggagatttattacataacagtgcacaggctgactacaaatggttatttgatattgaaaatttagtcctctaaaattgtaaaagataaccacttttgcttattccagttactatgtgctctttaaaaatttcagttgggaaatgaatttatttaaatgctgtttactgtgcctccatttggcacactagtccctgctgtttttgagccctaaagacaaattgggttccagctcaggagaggttgctgtgctatcttggctgacattctgtggggcctggcagccaggctgaggactgtgtggcctatgctgggcctccaacttgggatcccttccttggcccaggacattgagttaatgtccttcactctcctagttagggagtatgctccttgtccctgtccacagggcagcaagggtttcctggaagaggggagcaaacaggcagtgcccatgcactgaggagcagcagatgggcgtgggcagcccagagaaccaggacacaagctctgtgcagatgccctcagcagagggctccagcctcccactcttggctgaacagctccaacccgtagggttgacctttcttaaaaggtccagttcttgctgtttggctattttaagctctagtcttctggggtttcactcagctggtcctggcttcagcaattgcttccctctgaaggccttgcatagaggccaagcgtgaagtgcagggacttctctgctgtgatgtggcttaagtttccctgacacctgttgagtgtcctcataacttcccttctggtgcccctccccagctcctgagacacagctgcagctacaagtgtgcagtgtcagtgttcaagaaagtgcctggcagaggggctttagaagggtcccctgccttccaaaggagctttggcaggcagagctgctcctgcagcaacactcccatttcctgttcttgcctgctgagtagcacctagatttctaagcctcatctagatactcagatttgattctgggcctttatagcccagttgctgggactgtttcaggagctaggggccatgtggggcagggagagggcacaaaagtagagaagcctgatgttgattcccagggggctggtcagctctgctactgctccttgcagatgtcaagagtcaggtgctagtcacgtgctgcttggcttgtcactgtcattggcagcgagaggaatgggtgctggtgacattgggccagggctgcctctctgtgtcagagttcagggtgtaggaggggttctgccaaccatgggctgtgtggggtaagtgggtgaggctgatcttgctgggtcaaggtgatcctgagcccttggcctgtggaatgggggtagagggcaaatggtaacctagcatgctgtgggggatataggatgaggggctgcccgagcctcgggaggggtcctagggagcagatgttgaagaggccagagccctcagtgagctggatgagagggtgagctgtttgaacgccctgagggtacttcctggggcctcgtgtaatggtctcttctgtatgtcccccatcccatctcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggtacgtggctggagcaggggctagagcctagaggagcttggggatgcttgagcattggcttctgtgggaccccgaaagtttggggaatagaaaggggaacacacagaccttagtggggcaaaaggcccagcgactgttcctctcccttattgggaatgttcattctgaatctctcattctccgaagtcctaagctgagccaggagggaaaagggtcctttgagttgtagggctgagcaattcagttcctcttctcttctagtctggggctcaaagcaaaattgtccattttttggcatctgctcattactgagagttttttttgttttttgttttttttttaaataaaattggccacagctcctgtgctgtggggtggcatacacagattacgtactgatgtggccattgtccctgtataaggtagggtatcatcagatgacaggaagcagctagctctgaccctgggcaaggctttgcaccctctccaggatagtgaatgatgtccaaaggtccctgccaaccctgccatctgagtgataaggacatttcagggccttcctcctgtttgcctgggctgtgagtttggtgccaccttgtggtgtgaggaagtagtggtcagccagcctagttcagtactcaggctatggggcagctgcccaggtgcaaacctgcctggcttggcttttactcaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacctgtttcctctcttttctgctggggagggggaggtggttgaaccctgccctctgagcaggctgggaatggctgcagcctcgtgccccgcagtgggagctatggtggtgtcacctgccatcctgcccacctcctggtgcagaggcgctgggaaagcagtagcttactatcttagggttacaggttgcccccttcagtgctgcggggagactttaatggcttacgtgaaccgaagatgggaaagagcagggacaaggcctccctcccactctggtagataaacccaaattgcaaagtggccttggccatggttcttccactttggtcttcctgcattagcgtatcccttatgggggctgtaggaggagtcagctctgggcgcctgagactgggtttggctcccaggtcctcagttgtggacctaggctccccttgggacccctcctgtttgctggtgccctcccaccatgatgctgtagtgccaaagggctgggggagagagttgggaatgggaccaaatctggcctgcgcttttcctctcccctgaccacactcccaaggaccaagtgtcctggtggggatggaagaggaaagggcctgcaggccaggcaaaagctcattgtcacactgagctgtgcctctgcttccctgcctttgatttgtgtccaccttcagcccctttgcagactcctccaaaagtgtatttccttggagaaactgcaatgttaactccggcaaaagtgcgtgggagcatcctggctcccgggttcgtggtggtgacttggctgtcagaccatggtgttcaatatcccctttggtgttccccactgacggtaaaattgaaacttatccggagctctatgttgggaagggttaggttggagaggggccggaattggttcctgcagagggacccaagccgcaagactaggacgacagaagcgtccagaggggacacaataccctcgacgtgagggacaggaggtgccgcgccaggccctggcctccgggacctcccagtccggggaaccgagcgctaggatctgctcagagcttggagccccacctggggaaggtggggaaggagagaagctggggaagctggggaatgagggggaggaacggccaatgggctgtgcccggcccgcgcgacccgccaatgggcgggcgggcggggcgggctctcgacggggcgggcggggtccggcgggcgctgggtcccggcgcgcggtcggggcgctgggtgcaggcgccgggatgaccgctttaagccggagcgaggccaccgaggagggcgggtaaggggttgcggcccgggggccggtctcgggggttccggaggccgccgcgaggggctgctgccgcgcggggcaggacggctcctggggccgcggcaactcggcgcgttctgcccacggggcaggcacttcccggccgccggaatgcgggctccgggccagagctgcaccgcgcgcccaggcgtctcccggggcccgcgaggtgttcgcactaggaccgggtgtcttggctgagtctgctgcgacctgggggatgagggacggtcccggcagcatcggggcaaggaagggcaccctcctcgggacgccccgcatggcccatctccgcctcgccactctgttcatcctttcatttattcattcatcattcgttgcccgcagtatcgactcccagtcctaattgcccccgacccaaaggttggatttccctgcgtcccctggagggccagactgtttcctctcgccgccgaatccgtattgtagcggcccgcggctgcggggaggcagctcggagctgtctcagcacgacgcggcctcccccgggcgccaggcccatcccggtcgggcgggctggggccggtctcccggcctcgagacctggtccaaagtcgccctgggagaaagggataaggaggcagggcagacaggagctggcgctgcac

SEQ ID NO: 16587 - DNA, 55135 bp, Human
aggaagggacaaggaatttactgaacatgaaagtacactccagtgtgggagcgggcctgagcttagaagttcagtggctccgttacagaattttggggagtttaaataaccccagaggattccatggttacttcgggtatgccttatgtaaatagagaagatgaagtaaagttacaaagacatttatggcctatgccctatggacagaatattacctgttatagctgaagtgtgaattggccttatgttccctacctccagaccctattttcctgcctcaggaggattacttgagcctaggagttcaagtccagtctggacatcaatagtgagacccctgcctctgaaaaaaaatttttttgagacagagttttgctcttgttgcccaggctggagtgcaatgggatgatctcagctcactgtaacttccacctcctggattcaagcaattctcctgcctcagcttccctagtagctgggattacaggagccggccaccacgcccggataattttttgtatttttagtagagacagggttacaccatgttggccaggctggtcttgaactcctgacctcaggtgatctgcccacctcagcctcacaaagtcctgggattacaggcgtgagccaccgagcccagcaaatttttgttttttagacggagtctccctctatcgcccaggctggagcacagaaatgcgatctcggctcactgcaacctctgccgcttgggttcaagtgattctcctgactcagcctcccgagtagctgcgattacaggcgggcaccaccatgcccgactaattttttgtatttttagtagagacggggtttcaccatgctggccaagctggaaaattttatttttaataaatgaaaggcagagtatttatctgaaaaaagtgggagaccaacagtctcatgggattgttataaagattaaaagagagagtgttactgaaatacttagaagagctgttattctattgctgtcctttccccttgtatttggatagattaccgtacttgtttcttctatgtaactctaattgtcagtggggttctccctctcttagaggcctggagaaacttgtcttaaatgctttcccagttaatgaattgggagaggcagattttatgtctaaattacaagggcgagacttaaaagtatgaattggggctaatgtcagtgctcaggtgcagggatcctccgttttgttcatcacacagctcccggcactttaataaatgaggctcaaagaaacgacgggcttaggtcatgcagtagtcaaattcagaactcatgtttgattccaaagcccacacgttttcctagtttagaaacactaaacatttaattcaccgcaccgggggccagacaggtaatggagaacgccttaagtatgttaggaagggaagttatctacagtcgcagccgctattcagatctatttcactgccttgcagaaaacgccgactgtcgtctctttatcccatggccgatttcttgtgaaatctcctaacttttaaatatttccaatcaaaagactgccgttcaaatgcagcccaccaggagcatgtttgcaaactctggagtaaacaagagtgggaagctgataaggtgagtacctcagttcgatagtgacagccaagaaacggggagttttgtacctaaggcgagaaagaaattctccgccgaaatctcccggaagaaggactgaattaaatgcagattagagtcagggcagggtaaggtggcgggagaactaggctgccatcccaggtggctggcctaccagccagcgcggccggaggtacagaccatgtacagaccacggcgaggggtgttaggggcttctcgggataaaggcagcgagtggctgcgcattccctccccgactctttcagaggtaagccttctgtggagcagaccctaatcctccccctgattccttaggtcactcggcgatttacttccttcccccgcttcctcacagtcctccacagccctacgacttccgcttgcctcgtcgtctgggaaaccgccgacttccggccgcgcagcggtgggctgagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaaggtaatgactagcacttgtgtagacagttcctgttaatcccgtgaattgggaatttaacatgcctggaagcttgcagcgtcactgccttctgccagtggagcgggactgtgttttttctgtggtgattaagtttaggaaagtacggttttggaattcatctgaaggctgagttgggcgttcactccacagaactgctaatatagaggaacccgatgaattcaggatgacctagtcgctattttttgaggcatatatctataattggatctaatttcggtaaagtgccaagtgtgaagctttgtttaccttgctttagtgttgggtttgaaagcctgttctgtccatttgttagaatgattttaggtattcggaatttattgtctttcgaaaaacgccctggaaaacagtacaaatagcagcctttggctgttttacaacttagttttggctaagcagcaaggttagtgttattgttagagggccttttgtttgttttctactctcatttgcagagtagtcatattattctagtctaattagaaaactctgaagacagaaacttttttttttttttttttttttttttttgagacggagtgtcgctgttgtcggcccgggctggagtgcaatggcgcgatctcggctcactgcaacctccgcctcccaggttccagcaattctcctgcctcagcctccggattagctgagaatacaggcgcctgccaccacgcccggccgaaacatttttattaagctaagaaatttaaaatagctaggccggacgcggtgcatcacgcctgtaatcccagcactttgggaggccgagacgggtggatcacttgaggtcatgagtttgagaccatcctggccaacatggtgaaaccccgtctctactaaaaatacaaaaattagcggggcatcgtggcgctcgcctgtaatcccaggtacctggaaggctgaggcaggagaatcgcttgaaccccggaggcggaggttgcagtgagccgagatcatgccattgctctccagcatgagcgacagagacagactccttctcaaaaaaaaaagaaagaaaaaacagattttaaaataattaaataggccaggctcagtggctcacgcctgtaatcctagcaccttgggaggctgaggtgggtggatcgcctgaggtcaggagttcgagaccagcctggccaacgtagtgaaaccctgtccctactaaaaaaatacaaaaaattagctggacgtggtggcgggcgctggtaatcccagctactagggaggctgaggcaggagaatcgcttagaacccaggaggcagaggttgcagtgagccgagatcgtgccatttcactgcagcctgggcatccagagcaaaactccgtctcagaaaaaaaaaaaaagtaaatagcatggttaatgttactgggttttaaatattaaaaacataggaaagaaaatacttccactccagcctgggtgacagagcaagactccgtctcaaaaaaaaaaaaaaaaaaaaaaagaaaatacttctaagtaatcttaaagtgtaaaagataatgggtaacataacattgctacaaatatagcttatcctctagtgctcatcacaagtgtttgtgtaatagaatatgaacttgagtctgtgacggcagaattgtcatgtacatttgaatgtctaatactgttttaaagagaatagcttttgtttcgatatgacttagcaattaagcctgaagttaactgttttcattgttgtcaaatttattgctagtagtgttacgtttatagtaattttcatcttttcaagttaccaatgcatggaaatgtgaatttctgtccttttaggaagtggtattttatcttttttttttttttttttttgagacggagtctcactttgtcgccctgtctggagtgcagtggcgtgatctcagctcagtggaacctctgcctcccgggttcaagtgatttttctgcctcagcctcccgagtagctggggttacaggccctcaccaccatgcctggcttatttttgtggagatggggtttcaccacgttggccaggctggtcttgaactcctgaccttgtgatctgcacgcctcggtctcccaaagtgttgggattacaggcgtgagccatggccccctgccttattttttaatacaattaaaagaacccagtaatcctactcctagacctgtgtcccacagaaaaaagtgttaaacatgagcgtgtagtactagggcattcgttgtagtactatccgtagtggcaaaacgctggaagcaaattaaatgcccattaatagggtaattgatgacttcagatatttccatactgtggaatattatgcagtcattaaaaagaatgttacaactaattgcttttcctctcagaagcccctctctctcactagagaaagctgttctcctttctttcttctgcctattaaacctccattcctaaactcagaaagaaaaaaaaaaaaagagaatgttacgactaattgacttggagggacttccatggtgtacatttaaataaaaggtagatgtgaagtggggtatattatgtgatcttaatttcataacacaaaggaaaacatatagatccgtagataaggatatatggatatggaggagagaaaaggaaaagactcaaaactcacagaatttttgaagaaatgtatagctaaaaatctaagaaggctacagtcaaggccttgaggccagaagactccccatcaaaactgagtaaaactagcccagtgtgggacgcagaaattctaatatgctaccaaaattacttacggattgctaccagttccttagaaggaaaactgaggactaatatttgtattttcagtatagtttagaattcttaaaaaatgagcaaacaggctgtacttggtggctcatgcctgtaatgccaggacttgtggaaactgaggtgagaggataacttgagtccagaggtttgagaccagtctgggcaacatgttggagccccatttctacaaaaaacacaaaaattagccagacgtggtggcacgcgcctgtcttcccagctactggggaggatcatctgagcctgggggaagttgaggctccagtgagccatgatcatgccactggactccagcaggggcagagtgagactttgtctgaaaaaaacaaaaacaaaaaatgaatgagcaactaactctggctttcatgatttgtgcttataaatctttttatttatttatttatttatttatttatttatttatttatttattttgagacggagtcttgctctgtcgcccaggctggagcgcagtggcgcgatctcggctcactgcaacctccgcctcccgggttcacgccattctccagcctgagcctccggagtagctgggactacaggcgcctgccaccacgcccagctaattttttgtatttttagtagagacggggtttcaccgtgttagccaggatggtttcaatctcctgaccttgtgatccgcccgactcagcctcccaaagtgctgggattacaggcgagccactgtacccagcctataaattttttttataatgccctgattcccattatttgatgtatttggataaatatgtcatcctgtaaattgaaggattaaactgataagagcagaaaacagaaattagtacactagttgatctggctcagatatagtgcctatgtatcaggtgctccatgaatatttgttggatgaataaatgatcataaaactatataaaaatgaagaaataacagaataaaataatttgttctatataaatcctatgaatgagattgagtgggctaatagaatcctttccatctcaaaatgttctggaaagtcttgagtaaaagactcatcaaaaaaataattctgctttgtgcagaaagaagggttgctgacctttgaaggtgctttttgagtctttaacattctttagtagtatattccccaaagttaagaaattctagttagattttaaaaaattgagttaacatttaaaaaacagttttgttgaggtataatacacgtaccataaaatttactcaatttaagtacaaagtttgatcagttttagtaaatttatatagttgcacagctgtcatcagaggctgcttttaaaacatgtccatcactccagaagggttcctgtgtcaatggaattgctgggttatattgtttaagtatttgtttaaaaaaacagaaacaaatctgcctaacttctgcaggctatatacgagttaacatttccatgagcaatgcatgagggttgtgatttttccacatccctgtcaacacttggtttgtcagtttgtttttatttagctgttgtagtggatgggtagtgatggtgtatggtggttttaatttgtatttccttcatgaataatgatattgaagattttttatatgtttattttccacccgtatctctttggtgaaatgtctttataaatttttgtgaatttttaaatcaagatcattaaccaaatgagcccctcatttgggctcaagtgatccttccacctcaacctcccgagtagctgggaccacaggtgcaggccacgcttggctaatttttgtatattttgtagaggcggggttttgccatgttgcccaggctggtcttaaactcctgaactcaagcaattggcctgcctcacataagtattctcttttattttgaggattaatttttgttgttgtgaaatatatcctacctgtaaaagagtgcttaaaatgtcgtatgtgtgctttaaaggataatataatggaaacttgtgttcctactgcccaggttaggaaatgggttattaataactttgaaacctcctaaatgcctctctcctactgcattttccttcctccacatcagatgtagtgtttcttcaattttatattaatattttgtactttttatagttttaccatatatgtttatatatatccttaatatattagtttttaaaatttgttattaaccttcagtttattcattatttcaacactgtatagtatcttattgtagtaaagtatgtcaattaacttatccattccactagatggagatcgggattatttctggtttttagttattaaaaacaatgctgctgctgggtgcagtggcttacgcctgtaatcctagcactttgggaggccgaggctgcggatcatgaggtcaagagatcgagatcatcctggccaacatggtgcaactccgtctctactaaaaatacaaaaattagcaggatgcggtgctgcgcgcctgtagtccctgctactcgggaggctgaggcgggagaatcacttgaacccaggaggcggaggttgcagtgagccgagattgtgccactgcacttcagcttggcagagcgagacttcgtctcaaaaaaaaaaaaaaaaaaagctgctataaatatggccaagactaaggaaaggtaagtgaggtgcttagggttcacattttatggagtaagagtaagtaccttcttaaggtttataccctaggttcttcacatgcctcactttagtcctagccctgagcattattatgtaggtcttctgatgcaatatctaagagtttctctaaggtatacctagaaatagattgctaggtaatggagtaactttattacttacaggaaactatatggtggttgtaacaatttatgcttctgccaccagtcatggtggatatgaaattatgtcttaatgtgataatttacattgcaatttttttttttttttttttttttttttttgagacagagtcttgctctgtcacccaggctggagtgcagtggcgtgatcttggctcactgcaacctctgcctcctgggctcaagtgatccttccacctcagcctcccgagtagctgagaccacaggcgcaggccacacttggctaatttttgtatattctgtagaggcggggtttcgtcatgttacccaggctggtcttaaactcctgaactcaagcaatcggcctgcctcagcctaccgaagtgctgggattagaggtgtgagccaccacacctggctgtttgtttgttttgagcctgttcctcaggctggagtgcagtggtccaatcatggcttgctgcaactccgcttcctgggcttaagagatcctcccacctcagccttctgagtagctaggactaagggcacctgccactatgcctggctaatttctaaagttttttttatagaggcagagtctcgctgttttgcccaagctgttctcaaatttctaggctcgtgtgatcctcctgcctcagcctcccaaagtgctgggattataggtgtgagccaccacacctggctgatctatctgtcttaaactggagaattgcatttttttctacctcctttcttttttttaaaaaaactgaatttccatctgttacccctccctttctgctcctcttatttcatgccttggaagttatactttgccttcctttaatgagtaccaaagaaattaaaaaatacatgtttactgtaagtccaggcctaaatgttgctactacagggaccatcaaatgctttactaccatctattgccatctgcaaatgtatgccattgttgtttagttttgtagttcttaatgtattttaattaaacaccacaaattatgctttttgtttgttttattcagtcagtagatgcttagaatacttgcttattttaccaattcctttgcttattccactcctttgttctgggattatttttctttttcctaatatattttcattaaaagtttatttggtgagaatctaaaaactctcaaattctgaaagttttaaaaatttgcctttgttgttgaaaattagttttgatgggtgagagaatctagatcaggtgttagcaaacctttttttgtaaagggccagatagtaaatattgtgggctttgtgggccatagagtctctctgacaactactcagcaatgctgttgtaggacaaaagcaaccatagacattatgtaaacatgagtgtgggtatgttctcacaaattttgtttatagacactgaaatttgactcaattttcatgtgttaaaaattattattttttgaatttttttaaccatataaaaatgtaaaaatcattcgtagcttgtagaccaaataaacaggatggatttgacctgtgggccatagtttgctgacctctggtctaaattaacattcattttacttagtacctgacactggagtaattattcttatgatgtcttattgtgatattgtcttccatttttaattgttgaagagccagctgtcagtcttttttgtttttctttttcttcttcttttttttttgaaatggagttttgctcttatcgcccaagctggagtgcagtggtgtgatcttggcccactgcaacctctgccttctgggttcaagcgattttcctgcctcagcctcccaagtagctgggattacaggtgcctgccaccacacccagctaatttttgtatttttagtagagatggggcttcaccatgttggccaggctggtgttgaactcctaacctcaggtgatccacctgccttggcctcccaaagtgctgcaattacaggcatgaggcacggcgtctggcctttctttccttttttttttttttgagacgtagtcttgctctgttgcccaggccggggggcgatggtacgatcttggctcattgcaacctctgcttcccaagttcaagccattctcctgcctcagcctcccaagtagctgggactataggcacgtgccaccatgccgagctaatttttgtatatttagtagagacggggtttcaccatgttgtccaggctggtcttgaactcctgacctcaagtgatcctctcgccttggcctctcaaataactgtcctttctttgttggtaatctggtgatatgttttcttgtttggctgcttttaagagctgcttcttgtctctggtgcagttcgctatgatgtatctaagtatgtatttattttcatttaacctggtcaggatttgttgagtatccagaaactaaggattggtgtttctcattacatctggaaaaatttgagccattatttttgcttatattgtggtatgtcataggaagttgagaaaagaaaaattcatttgatggttttctatgaggttatagtggaaaataactatctcccttttagaattgagtgctagacagtttctgtgtagatgatctcataagcttccttttatcaaacagcgatcacttttttggtttggctgctgagaagtatggcatcaagtataatactcatatgaggtgtttaagaactgagtatatttcttatgcacattttactatatactataattatacattaaaaatgcacattgtaaatattataaatatgtgttatacattgttaatagtttggatagcaaaagtatgacttgacatttgttttttaaaccatatttaaagtaactctatcacaatatggatttaatggattaattgcataattggtgagctactgattattcttgttatttggatgcttctttaagttagcaagtttatattgtggtgcttcaatatagactacttatttcatttcagagaactcaatttcctgtatctactgagtctcaaaaaccccggcagaaaaaaggtctgtatgcagtttcattgtatgtgtatgtttgcacagacagatttctcttttatttatttatttatttttttttttggaggcagagtctcactgtcacccaggctggagtgcagtagcacaatcttggctcactgcaacctttgcctctggggctcaagcaattctcctgcctcagcctcccgagtagctgggattacaggtgcacgccaccacacctggctaacttttgtgttttagtagagatgaggtttcactgtgtttgccaggctggtctcgaactcctgacctcaggtgatctgcccaccttggcctcccaaagtgttgggattacaggcgtgagccgccacgcctggccagatttctctctcttgttgattcttttatctattctatattatttcaaaatgagtgttgggaaaagaagtaatagtctaaatgttctgtcacatctagcttttatttaatagagttattagatattaggaggttggtttgacctggaaattatttaaatggggtttgattattatgtaagtgtgtactaattttctgcttctggaaaaaccactttgtgaagttccaggtatctttttgctttgttggtttctagtttaattctattgtgggtagagaacattctttatatggtttgttttatggcccacaatgtggcctgtgttggtgcatgtcccatgtacacttggaaataatgtgtattctgctcttgtaggatgtagcattctgtaaatgtcaattaggtcaagttggttgatagtgttctgtatatacttacaattacagatattcatattcttactgatgtagttactgattggaagggtgatagaagagtgttgaagtgtgcaaatgtaattgtggatttgtttctactttcagttctatcaatttttgatttgtgtattttgaagatctgttgttggatgcatatacatttaggattgtctgatttcttggtaaattgacccgtttgtctttatataatattcctcttcaatttctgataatattccttgtttgaagtctactttgcctgataatattttagttttagttatttatttagctattttagttttgctttggccagtctttgaatggtatcaacatataattttcgtagagtaaaattccctttttttagtacaaattctgagtttcgacaaatgaaactagccatgtaaccactagtagcaccataatcaagttataaaagtttaattactcccccaaaagtcacctttactttgtagtaaaccacttcttccattcccaattgctggcagccattaatctgtttctttcttcctagttttgcctttcttggaatgccaaataaatggaatcatacattattattattttgagagagagggtctcgctctgtcacccaagctagagtgcagtggtgtgattatagctcactgcaacctgaaactcctgggttcaaatggttttccccagtagctgggtctacaggtgcatgccgccatgcctggctaatttttatgtattttttttgtagaaatgggggtctggctctgttgcccaggctggttttgaactcctggcttcaagtgatactccatcttcggcctcctgaagtactggcattacaggcatgagctattgcgcctgggttatgtaaatttttcagtggcttttaaacctcatataatgtttgttggtttgtttgtttttgaggcggaggctcgctctgtcacccaggctggagtgcagtggtgcagtctcagctcactgcaacctccacctcctgggttcaagtgattctgctgtctcagcctcccaagtagctgggattatcggcatgaaccaccatgcctggctaatttttttatttttagtacagatggggtttcaccacgttggccaggctggtcttgaactcctgacctcaagtgatccacctgctttggccccccaaagtactgggattacaggcatgagccactgcatccagcccaatatagggaggtattaagaaaagagaagaactatcatccttaagtattaacgggactttaacaaattaaaaaagtagtactttgaataaaaagctgtcacattttactgtgaaatccttagactttttttatacctctagttcaggttttttcagctttggcatgaatgatattttgagcaagataaatctttgttggagttgtcctgtatattgtaggatggttaacaacatccctggcttctacctggtagatgacagtagcacttaattgtaacaaccaaaagtgtctccagatgttgccagttattccttctggggcaaaattgttcccacttgagaaccactgctctggttaagtagtgtaatacttggaaatagaaggcagaaagttggtaagtgcataaagaattcacacagaagttggattagcaagctgagagacgttatttgaacaagtagcaattggaggcattttgactgagaatggatgttgtgcctctccctcactctttcctcctcagcttgagaggtccatattctctcaaagtttgactctttagttttgagggtgatgactgccaactgtggaagggataaacagatttctgtttggtatttttgtccaaatatatcaggactttttcaagaacaggcaatgaaattattgatcagaactacttggtggttctgagaaaataatatgctacatgaggctactgaagtcctcttccttttgccccatgatgtaaccttaggtgactttcttctggctttcagttgaagatcttacccatcattgaggtgagcgaactgatttactgcttgagtctattttcttccttaaaggagtcttcattgaaaactttacccattttggggtggccatagctgaggatgagttttgtccacaacctgagacaacatactcactatgtaaaaaacctgatctcagcttgatatctggttttagactaattgtttaatagaataatttattattgtaaaatatatataaaatttaccatttttaagtgtgtaagtcagtggcattaagtacatttacaaagttgtgcagccatcaccactgtccatttctagaagtgtttcatcattccaaacagaaacactgtacccattaaacaataaatctccacatccccttgcctccccagatcctggtaatctccattctattttctgtatctatgaatttgactattctaggtttttcatgtaaggtgaatcatacaatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcatttttttttttttccactgcaacctctgcctcccgggttcaagtgattctcttgcctcagcttcccgtgtagctggtattacaggtgcccaccaccatgcctggctaattttttgtctttttagtagaaacggggtttcactatgttggccagactggtatcgagctcctgacttcatgatccaccccaaagcctcccaaagttctgggattacaggtgtgagccaccgtgcttggcccaattctgtttaatttttgaggaacaatgttaacttctaatttaaatggaaggtagtatatatctaatttttccctattatttttaatttcaatgctagtaaatctttaaatctgaaatacacactcttgaattttgacagatatgtatactcatgtacatatttatattcctgtaatcatcagatcaaattaaacatttttatcacttagaaagtttcctcatgcctttttccagtaagtcttctgcttcacttcgccagatgcaaccaccattctgatttctgcctgtataaattgattttgaactttcctataataagttgtgcttgaacttcacacaaagggagccatacagtatctactatttagcttttggcagctttcatacaacatgttgttttggagattcatccgtgttgttatatgtatcagtagttcttttatttaaaaaatgctgtttagtattcagttgcatgaatataccaccgtttgtccattctcctgttaatgagtatttgcaatgtttccagtttttgagtactgtgaaagtttctatgaacatttatttatttagagatggagtctcgctttattgcccaggctggagtgcagtggtgcgatctcagctcactgtaacctccgcctcctgggttcaatcgattcttcagcttcagcctcctgagtagctgggactataggtgtgtgccaccatgcccggctaatttttctatttttagtagagacgggatttcaccatattagccaggctggtcttgaattccttacctcatgatccgcccgcctcagcctcccatagtgctgggattacaggcatgagccactgcacccggcctgaacatttatttactggttttttttgtgtgtgcatgtgtgtgcaagttttcacttgaataagtgcctagggagtggaattgcttggtcatatgtgaactgtttgttttaactttataataaactgccgaagtattttccaaagtggttgtacagttttacccgaccgccagcaacgtgtgaggattctgtttggctacattcttgccaacatttgttactatcagtctttttcatattagacttgctggtgggtatattgtgttttattgtgattttaatttgcattacactaatgactagtgatgttgaacaccttttcatatacttattggtcatatcttttgtgtagtgcctgctcaagttttttgcctatttttaaatttcttttttccttattattgatttgtgagacttcttaatatattctgaatgtacgtcctttgtctgttatatatgtggtaagtatttccccccagcctgtgttttactactttcattttattaaggtatcttttgatgatcaaaagttttaattttgatgaaggccaatttactattatttttcttttgttattaatgccttctctgtcttgtctaggaaatcttgatccttaccccagactgagttgtgtgtcctctcccttttctgcattaatattgcagaaattaattttttggttttagaaaatgtctaatttggctcaatcagtaatttttgatatctttctattgaaatatatatacagaaaagtacatacataaatcataattgtactgtgcagtgaatttttacaaagtaaacatatccatgtaatcaccatctagattaaggtatagaatattatcagtgccctccaggccgcctccttattccctaccagtcattaaccacccctcccaaaggtagtaacttgtatttaacttctatcttctacatcagttttgcctgcttttgaatttaatgtaaatggaatcatgcagtgtgtactttttaatatctaacttcgttgctcagaattatgtttgtgagattcatttatgttgttgcatgtagtagtggttggttgttttcttccttgttatatatattccattgtggggctctacctaagtctattcattttatacttgatgaacatttgggatatttttattgtgatgtattatgaataatgccaccatgaagagtcttgtacatgttttttggtacacatacatacttaggagtaggattttcagggtcaccaggaaggatatatttaggctcagtgaatactagcaagcaatttttaaaatgcggtcaatataatccccatgtgtaaaataaaggtgtacaaacgcacacacacacacttgctcatatgcttatatgtgcatagaaattccttgaaaatactcaagaaatgcttcacctctggtaagggataggaatggaatgggtcttttgtttagtatcctatgtgccctttgaattttgttttactgtaagtatgtatttttaagaaaaccaactagttatttttaaaaatcatttgaaagtcttcctactttgatatatgaaaaacactggttttaaaaaaaataatagaaaagctttaaaatcattattatttttttgagacggagtcttgctctgtcgccaggctggagtgcagtggtgcgatttccgctcaccacaacctttgcctcccggattcaagcaattctcctgcctcagcctcccaagtagctgggactacaggtgtgtgccaccaggcccagctaatttttttttttttttgtatttttaatagagatggggtttcaccatgttggccaggatggtctcaatctcttgacctcgtgatctgcctgcctcggcctcccaaagtgctgggattacaggcgtgagccactgtgcctggccgctttaaaatcattaatgttgcgttgctcagttatgtctaattgacagcccaaacatttacattgtaatattagaaaatcctttatgattgggcagaaacttggtttaatgtgtcaccttggagacctgggttatagtcctgcctcttccattaactacttgttgaatgtggacaatttacttaacctttagggccttaatttcctcctttataatgtgagaatgttctctgaattgcataactcactggccttacgtgactattcagtggaataataagagagaaaaactttgagatacatgcacacacacccttaagaaggatataattgttaaattttgctttgaggaaataaaataatctaagctataaagtaaaaccataattagctaatcttttatatgacttttttcttcctcatttcaagctaatgagaagcaaacaaactggatagcagcaatataattaaaaaattataggacagcttctagcatgtattcttgagtcaatactgactcagcccagtctcttcctcttccttcatcatcatttatgtacctgaacagagtagatgtttctcttgatcctgggcctgttcgccctcagatccattccttgccttctcttctctttttggtatagtgaggagctgactctttttttttttttttttttttttgagacggagtctcgctctgtcgcccaggctggagtgcagtggcgggatctcggctcactgcaagctccgccttccgggttcacgccattctcctgcctcagcctcccaagtagctgggactacaggcgcccgccactacgcccggctaattttttttgtatttttagtagagacggggtttcaccgtttttttagccgggatggtctcgatctcctgacctcgtgatccgcccgcctcggcctcccaaagtgctgggattacaggcgtgagccatcgcgcccggccgaggagctgactcttgcagcctccttttcttcccaggcttccgtgtcagcagtttctggctggattagcaagtggaggaactggcaggagattagaaggcaagaggaaagagaagacagggcttccctccccgaccttcaggcttcagagtcgtagtggttttttgctcatgcagacttctgatttgtctcaccattccctgttgggcctctcatttcttccattgcctgttctctgcattaaagtccttgtgtttcaaatcctcaagtggctttttgttaggctttgactgatacagggctcaaaatgatagtaatgaaaatgtcttacatttatattcttttcaagatttgttatctcttttgataccccaaatatcctattgaggtagaaaagtgttataattcctgtttggcatgaggaaattaacatttattgaatgactattttcagattctttggattttcgggtgaaaattttaggggggataaatggaggcccagagaagtgaaataacttgccctaggccccatagaaggctggtattgaatcaagattgaaattctgcatgtgaaaacttttatgtgctacatgtctgctagtcctggaagaaatcctttctttgatgagtattttttttaaaggctttacttgcaatatatttacaaaagccttagttatttagtaaatttttcaatgaaaaatctgaaccataataattttctgcttagtacttatatagctagcatactatccctagcattaatcaaagtgtcatgtaaaggtttgatttttgagcctaagcaaaatttgaaattcttctaagagaatttagcacctagggcaaactacaggggagaattcttgaggtgtcatgtttattcacttctggaattgtttaaaatatgtcaggtgcatccttaaagggagaaagaagggggaagagatgttacaaaagagtagaatggggcaagagaagtggcaagggagtattgttgctaggttgccagccttctgcccccactgtcttggtgatggtggaggggtagtgtggcagctgggatatgaatgaggtcttttttataactcactaaaagccattaccttgtcttcatctcgtcagctggctacctgacctctgtggtaacataggctcctgaaatgtagcattggagatgatcactgtgctttattgcaaaataggggagactctgctctgcatttacatgcttatgttttgtggaggatctttcaactagtaattctcataatacctgtgaaagcatataagaaccagtatctccatttttagggggagttggagtgagcaatgatttggaataccagaaattcaacttatatatttacaggtaaaattctaattgtaaattcaggattcatagattctagggatttctgaggtatccagaattccttcatctttgatgataagtagataataatggtaataaaaataacagcaacaggcccagcacagtgacccacacctgtaatcccagcactttgggagactgaggcaggtggatcacttgaggtcaggagttcaagaccagcctggcggacatggcaaaaccccatttctactaaaaatgcaaaaattagctgagcatagtggcatgtgcctgtaatcccagctactcagtaggctgagtcataagaatcatttgaatctgggaggtggagattgcggtgagctaagatcgcgccactgcactccggcctttatgacagaactcgactccatctcaaaaaaacaaaacaaaacaaaacaaaacaaaaacaaaatgcaaaaaaacagcaacaataataggtaacatttctttaaggcctactatgtaccaggcactatttgaacctctttatatattaggtaatacgatacaactctatgagaatgagtattttatttcctgacccttctatttaaaagtaaaaccccccacccggcactgtttctctttcctgctttatttttctccatagaaaaatatcactcataagtgtaacatactttattatctgtcctgtgtggtagtagcccctgccctcaattataaactccatgaaatcagggagtcagttttgttcactgctgtattcccagtgcctagaacagtgcctggaatcatggtaggtacccagcgaatattggttgaatgaatgagtcttggttttacagatgaggaaactataaatttcccaggtcacacatttggtaataggacagttgtgtacactgaaatgttctctaaaatatttgatggaacgaaaattagcttttggacagctacatctccaagagtgtgaaatgaccttcagcactggatttggtggattttcctttttctaatccctagagttccatttaatgagcgtttgggttcttgagctaccttacaaattgaacacttttttctccagctttcactcaagaaacacaaaacatggcttgtcctttttttttttttttttttttttgagactgggtctcactctgtcacccaggttggagtgcagtgcacaatcatggttcattgcaacctctgcctcccaggctcaagcaatcctcctaactcagcctcctgagtagctgggactacaggcttgtgcctccactcctggctaatttttttgtattttttgtagagatggggtttgtccaggctggccttgaagtgctggactcaagtgatccgtccacctgggcctcccaaagtgctggggttacaggcgtaaaccactatagctagccctgattgtcttttattgtgagattttaataacagctaagacttgaaaattaacattttataaattttcttttagactacttagtgatatactaagtatctaaggtttgtaatacttagtataaactcaaaagggttcagtgcctcattctcttttactctttccctttagtagataggtgacagaggactgggtcatgcagttgagacttggtccaagatgacttagtaagctacttgtcccagaactatttatttatttacttatttttgagatggagtctcgctctgtcgcccaggctggagtgcagtggtgtgatcttggctcactgcaacccccgtctcctgggttcaagcgattcttttgcctcagcctcccgagtagctgggattataggtgcccgccaccactcccggctaattttttgtatttttagtagagacttggtttcattgtgttagccaggattgtttcgatctcctgacctcatgatccacctgcgtggacctcccaaaatgctaggattacaggcgtgagtcaccacccccggaccctggaactatttatgacggtgcactttatgcacttaacacactcacatgtctttaagcttggtgactcgtgtggctttttcgaaggagatttgattctggaagtggttaagtaggatgtgaatggctaaggtctggtcattggtgaagcctaggggaagaaaagaaaggaaacacaagtcttagaagaatttcagatcggccccaacgactagaagggtggttctactaagaaaatgtgtgtagtcagaaaatgaagagtcagttgcttaaaattttactttttttcttgttcctggcatgtaaagtcatatccatactttctgttataatttcttcttacaaattccattgataatccctattcttggatagcaatgagcagcattacttcttttttatttttttaaaaaaattaaattttttgttgaaatgagggtcctgctgtattgcccaggctggtatcaaatttctgggctcaactgatcctcctgcctcagcctcccaaagcgctgggattacagttgtgagccagtgtgtctggttgtaccttttaatttttgtgttcaggcaacattaactctgagtcacagtaagctttttttttcttcctgtcatattatggacatagaagttttttggttttctttagattgtttctccttaggttgcagaacatcaagaaatggattacagtcattttcctctcttccccatgctcttccctttcttttccttttttcttttttttttttttttttggagacagaatcttgctctttggccgaggctggagtacagtgtcatgatcttggctcactgtaacctccccgcaccaggttcaagtgattctggtgcccaagcctccctagtagctgggatgtcaggatgcgccaccacaccctgctaatttttgtatttttttgtagagatggggtttcaccatgttgtccaggctgacctcaaactcctggactcaaatgatctgccctcctcggtctcccaaagtgctgggattataggcatgagccaccacatctggcctcttttccatttttaaaaaggactgtctccaacatattaaaattcacaaaaaataatataaacacacatgtactcactggctaggcttaataaaaaacatttagtcatgtttactttaaagctttttatttttttgagaaataagcattaaagagttgaagtctcctttctgtcttttcataattctgttcttccctcttccttccttgagatcttcactattcttgggttaatttggatctttctactccttgttaccacagaaaagtaattcttaatgaatttgaccatattttaaacttctgatttcagtgggcaggtaactcattttatggtttctgtattgtgagccattttcaatgactcaactagatttttttcatcgttgacttctcatttctgggcaacagcataatgttctcatttgagctatttctaaagattgtgtttaactatttaaaatatttgtggtactctgatcatcagatgtgatttttttttttttttgagacggagtctcactctttcaccaggctggagtgcagtggcgcgatctcggctcactgtaacctccttctcccaggttcaagtgatgctcctgcctcagcctcccaagtagctgggactattggtgcgggttaccacacccggctaattttttgtatttttagtagagacagggtttcaccatgtttgctaggatggtctcgatcttctgacctcgtgatctgcctgccttggcctcccaaagtgctgggattacaggcgtgagccactgcacctggccagaagtgatattaactatcttatatgtatatttctgttgcgggaagtcaggggccccaaacggagggaccggctggagctgtggcagaggaacgtaaattgtgattatttcatggacacttaccagttcccaaataatattcttataatttcttacacctgtctttaatctcttaatcctgttatcttcgtaagctgaggatgtacctcacctcagggccactatgataattgtgttaactgtacaaattgattgtaaaacgtgtgtttgaacaatatgaaatcagtgcaccttgaacagaataacagcaattttagggaacaagggaagacaaccataaggtctgactgcctgtggggttgggcaaaatagagccatatttttcttctttgcagagagcctataaacggacatgcaagtagggaagatatcgctaaattcttttcctagcaaggaattttaataatactctggagaaggaatgcattccttggaggaggtctatagggcatgtctgtcttatgctgttgacataaggactgaaatacaccctggtctcctgcagtaccctcaggcttattagggtggggaaaaaaccccaccctggtaaatttgaggtcagatcagttttctgctctcaaaccctgttttctgttgtttaagatgtttatcaagacaatttgtgcaccgctgaacatagactcttaccagtaattttgcttttgccttttgccttgtgatctttgttggacccttatcaggagtttctgattttgcccttgtcctgtttcctcagaagcatgtgatctttgttctcctttttgccctttgaggcatgtgatctttgtgacctactcactgttcttaggccccctccccttttgaaatccttaataaacacttgcttattttgcagctcaggtgggcatcacggtcctaccgatatatgtgaggcccagctgtgaaattcctctcttcgtactcttatttcttagccggctgacgcttatagaaaatagaaagaacctacattgaaatattgggggcaggttcccctgatatatttccttagtgacattcctgcaatctcctttagaaagtctttctgttcaccttctataaccagggaaggagagattgagaagagacgaaggatgattttatgtttttcagtcccagtcattatttgatgagaaactgatattacaagctttaaaaactcaagatatgtattcaacatgtagtagtagaacaagtatcttagtttaatagtctataaatttttgatgcactataatatattattgtagtcagtagcatcaaaattttaatgtgatattgcagtatgtttatggttagtttagacatgaggacagtgctaaaggagaaaatctaatgactgtgttgtttgttttgtcaaaatatgctgcctagctccagagtttcctattttggagaagcagaactggttgattcatcttcattatatccggaaagattatgaagcctgcaaggtaagagattgccataataataaaaatgagaggcaggatgttgggtaggcaactaacagtgcctgctaaacagagtgtggcagtttatatctcagtgataaaacatgaattccttcttccccatacttcatacactggttatcttttgctatggtagtgatgtttaacatacaacctcaatatttcagtggcccccaacaaacaaatattaattgctcatgggctttcagatcagctgtgggttggctgggtttgactgcaggctgtgggtcaggtttaggtgtgttccatgtgtcttctcatgtcaagagcaaacaactctcttggacatgttggtcttctggtggaggcagatgttcaactcagcatattaacttttttatctttggatagatgaaaaatggtattttgtcgagttctttttttttttttttttttttttgagatggagtctcactgtcacctaggctggagtgcagtggcatgatcttggctcattgcagcctttgtctcccaggttcaagcaattcttctgcctcagcctccccagtagatgggactacagatgagtgtcaccatgcccagctaattttttgtatttttagtagagatggggtttcaccatattggccaggctggtctcgaactcctgaccttgtgatctgcccgccttggcctcccaaagtgctgggattacaggcgtgagccaccgtgcccagccctgagttttattttttaatttctctcttactgcaaggttgatcatcatgtgtatatttaaaaaccatttgtatttccctttctctgtatctttggtgacataccatatgtgttacaaacttgcaggcagacagtggtagtactaacatgcagaatgtatccttggtgtcatcttttttggtatccagagctttgtgacccatctaaggtttttaatttatacccatggcatttatacctatggcaatgcacagaactaattcatactggtatgacaaagattcataccagtttttttttttctttttttaagtggagttttgctcttattgcccaggctagagtgcagtggcgcaatctcggctcactgcaacccccgctttccagtttcaagcaattctcctgcctcagcctcccaagtcgctgggattacaggtgcccgccaccatgcccagctaatttttttttttttttttgtatttctagtagaggtggagtttcaccatgttggtcaggctggtctcaaactgctgacctcgtaatccacctgcctcagcctcccaaagtgctgggattacaggcgtgagccaccgcacccggcccataccagttttttttgacaccgctgatccgaaggcagataccagtatgaatctttttttttttgagatggagttttgctcttgtcgccaagggtggagtgcaatggcatgacctcggctcaccacaacctccgcctcctgggttcaagcgattgtcctgcctcagcctcctgagtagctgggattacaggcatgtgccaccacgcctggctaattttttgtgtttttagtagagatggggtttttccatgttggtcaggctggtctcaaactcccgacctcaggtgatctgcccgcttcggccacccaaagtgctgggattacatgcgtgagccaccgcgcctggccaccagtatgaatcttgaaaggttctctttctttttcatctgtgataatacttggaaatcttatcacacttttcttagcttgcctagttagattttagacaggggttggcaaactttttctgtaatgggccaacaatattttagggtttgtaggccacatacagtctctacatcatatttgttatcttattttttataaccctttagaaataaaaaaaccactgttagcttgagagctgtacaaaaatatacagggcctgtaagccctgtagtttgcaaatccctgttctagaagaagtaatcacaacaagggagttgaaattttaagaaactgaatgaactaatactttactaggcattattaatactctaggtttttttacatatgattcttgtccacgtctgctttttcattactatttgttttcttttttttttcagacagagtctcactctgttgcccaggctggagtgcagtggcgctatcttggctcactgcaacctccgcctcctgggttcaagcgattctccttcctcagcctcctgagtagctgggattacagacacgcaccactactgcccggctaatttttgtatttttagtagagatggggtttcaccatattggttaggctgatcttgaactcctgacctcataatctgcctgccttggtctcccaaagttttgggattacaagcatgagccaccgcacctggcctgtccatgtccactttttcttaaagacacctgaagaaacttaaccactgctcagaagcatttttctccctctttcaggctgttatcaaagaacagcttcaagagactcagggattgtgtgaatatgctatctatgtccaaggtaagacacatacttcttgtcttcttgctagagaaatacacttttcctaggttcttgaaaaagatcaggcaattgaagaaacaagttcaagtacagtcatgcaccacttaacaatggagatatgttctaagaaatgtgttgttaggcaattttgtcattgtgtgaacattacatggagtgtacttacacaaacatagatggatgatatagtgtactatacacatgatatagtctgttgctcccaggctacaaacctgtatgagcaggtgttataccgaatactgtaggcagttgtaaaacagtggtaagtgtatctaaacatagaaaaggtactgtaaaaatatggtataaaagataaaaaatagtatacctgtatagagtacttaccatggatggactggaagttgctctgggtgagttagtggtgagtgaatgtgaaggtctaggacattattgtatactaatgtagactttatgttgtatactaatgtagactttataaacactgtacacttagcctacactaaatttatttaaaaatattttttctacaatgataaattaactttagcttactataactttttactttataaactttaaaactttttggctcttttggggtaatacttaaaacacacaacaacattgtacatttgtacaaaaatagtttctttaggtccttattctataagcttttttctttttctttcttttttttttttggtagagagacagagtctcactttgttgcccaggctggtcttgaactcctgggctcaagcagttctcctgcctcagcctctcaaagtgctgggattataggcatgagctacgacacctggccctttatgctattcttaaaactttttatttttttacttttaaacttttttgttaaaaactacgatacacacactactacagtggtggtactaacatgtggaatgtgtccttgctgtcttttttggcattcagagctttgtgacccatctaaggtctttgtgacacacacacacacacacacacacacacacacacacgcacacgcacgcacgcactggtctaggcctacactgagtcaagattataaatatcactgtcttccacctccttatggaaggtcttcagtggcaataacatacatggagctgtcatctcctataacaataggaataccttctggaatacctcctgaaggatctgcctgaggcagttattcttttttttagtaagtggaaggagtacactctaaaataaagattaaaatgtatagcgtagtaaatacataaaccagtaatgtagtcatttattatcaagtattaagttctatatatatgtaattgtatatgctgtacttctatgtgactggcagcacagtaggtttgtttataccagcatcactacagataggtaagtaatgcattgcactgttttgattgctatgacgtcactgggcaataggaatttttcctcttcattataatcttaagtgatcatcatcatttatacagctgtcgaccaaaatgtcattacaggtgcatgagtttaaatgttccagaaaggttttattcagtattaatctttttatggaatctgaatataattactgtgttggatttgacttcagaaatgactagtaatgttaaaaaattgctatgattacccattttttagtttctggctagtgttttttggaatggatgcttaggattcctgcctaatgcagtgatttcagggccaaaagatgcttttggaaggattgcttgtaatcaagctaaaagagatgaagaagagcttgaggatttctgtaaggtgaatcaggatgaggggaagaagcctggaaataaacaagataaagcagagcataaattcagctcattagaaaccaaagataaggaccactcacttactttttttttttttttttttttttgagacagagtcttgctctgttgcccaggctggagtgcagtggtgcgatcccagctcactgcaacctctgccttccaggttcaagcgatcctcctgcctcagcccccctattagctgggattacaggcacatgccaccatgtccagctagtttttgtatttttagtagagacaaggttttgccatattggccaggctggtctcgaactcctgacctcaggtgatccacctgccttggcctaccaaagtgctgggattacaggcatgaaccactgcacctggcccactgacttaaattttcctctttagtggcataagtagcattcttagtttttccaggaactttctttttgactcttgggtgtaaataaatggttttgtttaccattcattgcatttgtagtcttcagattaacatataattttctgacataattgttaagatattgacaaatttaggacatcatggcaaaaaatgctcttattcccagtgtcacaagtatcagactttcagtgcctgataaattcttctggaaacataggcctaggaaaaacctctggttctaattggttgttacactgacaactgaagtcttaaatgttactttatcctttgccagaatctccatgttgaatttgaggtattgattccatttgccccatttgggggttcgctctgaaaactatcagttggaagtaaattatgataaatgaagcatctgatggggaagccccaaaatgttgttaatgtgaagagtttgtgtgataatttgcaaaggaactgattatctatgtgatggatcctgggagtagagagagaagtaggtaggtttgagctaccttgctaaaagacagttgagcttgtcagcagttttggttgttgtttcagcctgtccaaagccatatctgattgttttaaggatacagttgtccaaaggatttacttgatgtggtttcccagttttctcttctccaatttttctgaccccaggctccattcttcccagaacatggttttacttttttttgtattttctgtttcttggcagcattgatatttcgcctagaaggaaatatccaagaatccctagaactcttccagacatgtgcagttcttagtcctcagagtgctgataacctcaagcaggtggccagatctttgtgagtattggcaacctggaggccctagggcactcacagagaacagtgtaaaatgcattcctaggtccagcctgctgctggcagctgcatcagcctgatacacaagtgggggaatggtttaataggtacagtgggattcactctgaagaacatggattaagtttgaaatttgagaaaatgagataactagtgttaaggaactaagcattttaaacactgtgcattctagtttgatgggggaccaatattgtttatcatgtaaatagagacaccttgtaccctaagtcttctaaacttattggcaatccttggaatttttctcatctactcttctaacacttagtatttgtcacacagtaagtttttagtaaggacagagagttcctgacttctgatggttcaacttacataatttttcaactttacaatgatgtaaaattgttatgtattcagtagaaactgtacttcaagtatccatacagccattccgtttttcattttcagtatagtattcagtaaattacatgagatattcagcattttattataaagttggcattgtgttagatggttttgcctaactgtcagcaaatgtagttaagaaagtggagataggaactccatggaacagagtaagtgttctgagcatgcttaagataggctaggctatctatgatgtctggtagagtagatgtattacatgcatttttgaattacagtgttttcaatttacaatgggtttactgggatgtaaccccatcataagttgaggagcatctctatttgttgagtgaatgtcctaaagattcctagatggaaagaatctcaagtgtttataaactactaggtactcccttttcagtcctttgttccatggagttcctatctcccctttcttagccacattgccattcatacctgtgttgtttttgcatagagcttggttttccctgtttctctctaaactcaggatccaatatcaaggaaagagacttagtcttggaaggaaaggatgtgtccctaatgggtgatgataaatgatggtagttactgcttaacatggtatatcattaggcttatttcttttttggtctgcatttatagtacattgtagaagaaaaattccacaagactctcactaaaattggtatagaatgagaccaaggccttggaacagctgccagtgcaatccctactaagagagcttctgctgttagtgtatagcagcttcactgaccaaaccagcacaaccacctcatagagaaaaggcttctagaattctctgctggatgaaatatgattaaaatgtgggactagtagggttagtcttctaagaattttgaggtaataattatggaaaatatatcttttacagatttcttttgggaaaacataaagctgccattgaagtatataatgaagcagctaaactcaaccagaaagattgggtaagtagagaactttcagttctttcttattagtaaacttgctaatggttccatttatcatctggctgtcttatttctgaattcttacattccaaaaatgtcttgattttaacctcatacttaattcatgatttgtataagtataggatcaaaaaccatgtttcctcataactttgcaggcattgctgcatgattttctagcagtttgctgacgagcagtctcttaccagtctgattcttgttgatgacccctagaagctttgggtatttttttcgtcattggaattccacagtatcagcaataggcatctagttgtgtttcatgtctttttcccgtccccatctgtgtgacattcaattgactctttcattctgaagacccttgcctttctttgggtcagggcctttgagtagttctttatttttcccctccccttctctttgtgtcaattgaggattgtgtgtaaatgcaacagaaaatttgactaaacattggctttacaaattcgtttttgtttttttttttaattctcatgaaacaagatgtccaggtaagtagttgctggcattgatttggtggtcctaggatgtcaagactgagagtttttcctcatggttacaagaagactgctgcatccagcatcatatctgcattctagggaggcagaaagagaaagcaacaaggagaaaaggacagagcctatactgggaaagcacaactttcccagaagtcccccacagacttccacttatgtcatatcagctccccttctataaggaaggctggttaaatgtcgtttttaatctggtcacactgccactctaaacaaaattagggttcttttagtaaggaaaaagagaagagtaggtagcaggtaggcaagtagataactagcagcatctgccacactgttttccattctctatgagagatgttctctaactattctctacaactcttaacttgcctctcattttctacctctgtgtccttttctttgtgtgtggtgcggggggtacagaggctcactctgttgcccaggctggagtgcagtggcgtgatctcggctcactgcaacctctttcttccaggttcaagtgattctcctgtctcagcctcctgagtagctgggattacaggcgcctgccaccatgcccggctaatttttgtatttttggtagagacggggtttcaccatgttggctaggctggtctccaactcctgacctcaggtgattcacctgccttgtcctcccaaagtgttgggattataggtgtgagacaccacgcctgaccctccttgtcattttattatatgttcaggacatgtattcagtcttatcttccatatcatcatttttgtttttagctatttgtattctgttatataccctatccatccaatattttttatttcatttccttttattgtatttttaatttccaaaaatcttgtcttttcttcaatgtctctgattcttgaagttcttttctgcttctcagaattatctttttcttcctctctgcattttggttcttctattttatgctgttggtatttttcaagtatttggtgattctcagagagacattcatatctgtgagtgaagaactagatttattagtacagagaattagcatggatttcctttgcagttcttacggggcactattatttttgaagtgtgttcaatttgttagtcgcttttcttctgtacatcggaagattgagttgagtctttatgccatggagtatgttatagctaacagccagagtgaaactacagatgaagaaaaattcatgtacttttcattcagtcggtttttcaaaaaatgagtatgtctgctatatgccaagcactgatctatgccctggagatgcaaagatggactgttggattataagatactcaactagaataggaaatgaaggaagaagagcaaggtttggaagaaggtgatggtaagaaatcagagttaaatcctgtctttcagaggattttggatatgataagttttaggttctgaggggatatctaaattgagatgtgtccagtaggattggatatagaaatctgaaactcaagtgttttggagtagagatgtgaattctggagtcagcaacataaaggtggtaattgaaaccattagattggttgacattaccctgcaatgagctgaggatgggaccctggaaaaaaagagttttttactttttttttgtctgtttgagacggcacaggaaaagttactgctttaatgcagggaggaagccctgcattctctatgggggccaggatcatgggggtggccagtgccacaaatggtcaccatacaggccagggaggagccagggcccaccaataatccctggaacatccctggatgctagcagttttttactttctaaatttttttttttttttttaagagacaaggttgcctaggctggagtatagtggggtgatcatagcttactgtaacctccaactcctgggctcaagtgatcctcctgcctctgcctcctgagtagctggggctacaggtgcaagccaccatgcctggctaaatttattttgtggaaatgaggtctcatgttacccaggctggtctcaagctcctgtcctcaagtgatcctcctgctttagcttcccagagtgctgggattacaggtgtgagccatcaaaaagcaattttgaaggactgagcagaagaagagaacccatagagggagatagggaagaggtaaagcaggagagctcagggtcacagggggaatggaacgtatttcttaatctatccagttggttgaaagagctcatttggtattactgactcacttgggataaccatcccattgttactagtagatgtgatcattcacaaaacagccattctttttttttttttttttgagacagagtctcattctgtcacctaggctagagtgcagtggctcaatcttggctcactgcaacctctgcctcctgggttcaagcgattctcctcccccagcctcctgagtagctgggatttacaggcacccgccaccatgcccagctaatttttgtatttttagtagagatgaggtttcaccatgttggtcaggctggtctcgagctcctgacgttgtgatccgcccaccttggcctcccaaagtgctgagactacaggtgtgagccaccaccttttttttttttaactttaaaatttttctttaaaattttccccttcatggcatttttattttctttttagaatattttaatgattttgaattttacttttattaatagcccttacctaccctacatatttcataagtacctgtagaaaaccttatagtagctggagcatggtggctcatacctgtaataccagcactttaaaaggatgctgagtggggaggatcacttgagcccaggagtctgagaccagcctgggcaacatagagacccagtttctaggaaaaaaaaataaaaattagtggtcgtgtgcacctgtagtcctagctattctagaggctgaggtaggaggatcacgttagcccaggaggttgaggctgcagtgatgcggtgaactgtgattgtgtcactgcacttcagcatggaaagcagagcaagaccctgtctcaaaaaaaaaaaaaaaaaagaaacaaccttgtagccctactttcttggactcatcagggtattccacagtcttgctgcaacaggggaatagtaattcctcctgccattatcttagttgacttttggaacagttctgttaagtagggagaatttcccccattgacaagtgaggaagctaaggctttggaagatggaagttgctacagtgaggtagttgctgagccagaactggaattcagacctgtgatctaggatgatctaagattcctcgtcttaagactgtgatcttttccactgtaccaactgcctttgcaggatgtctgctgggttcccttacctcctgaaagataggatttgactctgatttgttctgttgccctttccaaatttcttttgcagttagtttgttaaaggtatattgctgccttctcaactatctatgtcaaagattttaaaaggtcagaggttagccttcaggacatctatttacttacctaccttaacaattcctactgcagagcaggacatttaaaggacaagaaaggctttatttctgccttgtctctctccatgcatgcattcttatagcatgacaaagttggcagtatacaagttttggaagcaggcctgagttcaaatcccaatgttctataatatggacatgatttgtgattgaataaaaaaaatttttaaatgtgcggcatttgtgagataattggaaattttaacgtaattgaatatctaatatcaagcagtcactactttttttcgagtgtgacgatgtgggtagtttaagaaaaaggccttatcttttagaaatacatacggaaacatttgtggataaaacgttgggctgttatttgcttacaaaagttgtgggagtagatggggtgtggattggatggttgttgggacaggatgattagtacctaattctgtctgcacttacgtatgattgaaattctccctaggatatagaactaaaaaagaaaaaaaaaatcccaatactctctgtcttaagttaggtaatctactcaacctctctgagcttcaatttccttatctgtaaaattggaaagattataactatgttgcaggtttgctgaaaattaaagtaacatatatgaaaacatctggcataaagcctgatgttagtaggtgctcaaccaatggttgctgttttgttgtttttactatttttggagacttggaaaacattaaatcagttgttatctctgagcctgggggtccatgtttcctcagacagggacacatctccactactaatagggtagttcttactatgtttcccaagagcattttccttacccttgctttctccttttccaaagctaccttaaataaagggaggtttattataaaggaatttgagagtccataaaacagtatcaagagatgcaggttggtcttttagtgaagcagaactggaacgcttcagcatccaaggtagctactctgccttttctgcttcatcttttctttctgtagatcaaaggttggcaaactttttttgtaaagggccagttaataaatattttaatttgtatagcttcatacagactctgttgcaacgacttaactctgcagttctaatgcaaaagagccatacaaaaacaatagttgtgtctgtgttccaatgaatctgtacttataaaaaagggcagggaatggatttggcccatggaccatagttttcccatgtcagctctagacttctgcagatggctccaattacatgtattccatcacagcagactccaggtggcgctgtcagtcctcaagttcacatcacctagtaaatttagtacttgtaactaactagctctcttccaattccagattcctagggaaaggacttcagttgtgtcaggtgtcactatccaactgtgttgccttaagggcggaaatgtgtggctagcagccctctcagcaggggctgtgggtagtctctcctgagaagaaggagcaaagggtatgggtgatgggcaactcttaaagaaaaaaggtatggggatgggctgggtatgtgccccagggttccccatagatccaggaagatcacctgtttattctgcttttatttcttataatctgtatttttttatgttgaggaacttatttttaacaattaatttgagtatgaactctaataaaaagctgactgtaatgcatagtttaaagtttaaaccttgccgagcaataacaatctctagatgtctgttgtttcactctaatacttactgtggaattacacctgagttgttttccttcttttttatgagcctaggagatcagccataacctaggagtttgctacatatacctgaagcagttcaacaaggtaatttatagaagtggtgatagatttcactgagggtgcacttgttgcagaagttgttacattgctcatttggtattatccctagtgcttgcagaggtttttggaactgaaaattgaaagtacctttatacatttttttctgttttaattctcacttgtcattattcatctgttgttttctgcttgtaataagaacatggaaagttctagaaatatgagggaatggcagtttttctcctttcttctttttctctacctccagttaaatttcccagtttagaaacagatgcttaataaaacatacatatcaaaaagtggacccttaagtcttaaaggtgtgatcatgaccatgtgagctatctccatgccctgacggcaacttagtttttagggtcattgaaaataaattttaaattttaagtggatctgatttctgagttttcagttttaattttatagttattttccatgatgagaaattatatttcactgtgattaagctatagactcctatatcagagaagacaagttgagcttacctcaaatttggtactcaggtaagaaaaagtatatatcataattgaggagtagacaaaattactgagagctctaaaacttagtgatgagagcgttgggtagtttccttcatagagctcacagttagtgattgtgaagttttattctcctttctccgatgccaccaggactgagaatctgaattggttagtacccatttgacaatgtttagtttgtgtcaatttgcagactggtgtaactagtatcccacactggtgtgaaaaaaaatatgcacattagcagttggggtgtaaaagtaacttttctcctgagataacaatatatatacataaaatacatttagtgggccccttaggttttgtagatggatctatagttttatatacttggttaggagatttttctcttcagagacaatttcaaacaggcacatttctattcacaggattattctgagtcaggggaaaagaaggatttgtctttggttggatctgtgctgagaagaaatatatttagattttactgtacagctaacaggctaggcaaatacaatacctggcatttatataaatgcttgttgaatctgtgaatgactaaacaaagcccttttgtttactaggagaaggtaagctcctccagagcaaggagttggttttataaactcaaatatatttagcatctagaacagcaagcagttgggtgaataaatgagaacaatctatttattcatttatcatcacattgatggggaaacctggcccaccatagggaaggttgtgcacttggtcagtgttacagctgggatttagtttagtgtagtactctacactgtactatgatggcccttttgacttatgaagtatgagtcataggtgtgaatatcaggcagaaaacattcagaaagattaatcgtcttgtataaattcttccaagtggctccagaagcagatatcccatgttgccagctgtcttttcaacaaggacagttttggtatgttttggtctttgggtagtgggggctgtttgctgaaatgtgatgttcctatgtcaatacagcagaaagtgtctttacattagccatataaaggtatagttcgttcagtggtagtgatttggttttctttattttgttaaacttgtcaggcacaagaccagttgcacaatgccctgaatcttaataggcacgatctgacttatataatgctggggaagatccacttgctggagggagacttggacaaggccattgaagtctacaagaaagcagtggagtaagtgtatctgtttcctttaaaacagtgagaaactaaaaaaattgagtggatatgtgaactcccaagcctaaaagagtgaatatgtttgattaattacttactgtatgagttaaaggttaagctgaagtttaagagctcccagtagcttcaataaggtagactgtgtttctttcttacctataaggatgactgctgctttaggttagctgggcagctctattctacaaggtcagccagggatccaggtttcttccttattaactcaccattccttaggctgttgtctttacctgcatggttgatgctgaatgtaacatccacatccaggctgtggtggaaggagatggtttgggaagctaagcatggaataagcatctggctatatatatatatatatatagagagagagagagagagagagagagacatgatcttactccatcactcaggctggagtgcagtggagaacacagctcactgcagcctcaacctcttgggctaaagcaatcttcctacctcagcctcccaagtagttgggactacaggcatgtgccaccatgcccagctaatttaaaaaaaaaaactgtttttgtgttgacagggtcttgctgtgttgcccaggctggtcttaaacttctgggctcaagcgatcctcctgcctcagccttccaaagtgctggaattacaggtgtgagccactgcacctggccttggtaataagttttaaatgacccagaaattgcacacatcgttcctgcttacattccatggttcaaaactacatgatagttacaagggaagtgggcagacatgcactcaagaagaaggaaataacagatttaagagttggccgacagtctgccattttggtatcatatgttaataacagatcttctgttttcagagatattattagggacagaaatctcctgattcagtaaaaaacaaaacaaaacaaaacaaaacatttggccttattagcatgagaccagtatcttttttcccccttccccattttcccttccccctttccccttcctcctttcccttccccctttccccttttcccatctcccttcccctttcccctccctctctcccttccttcctttttctctcttttctttccatcctttccctccctcccattcccatctttctttgtttctttcttttcttcctttcttccttcctttctttccttcctttcatttatttcaacagtctcgctctgtcgcccaggggtgagtgcagtggcgcgatctcgcctcactgcaacctctgcctcctgggttcaagcgattctcatgcctcagcctcctgagtagctgggactgcacgagcacgccaccacccctggctaatgtttgtatttttagcagagacagggtttcaccatgttggtcaggctggtctcgaattcctggcctcaagtgatctgcttgccttggtctcccatagtgctgggattgcaggcgtgaaccactgcgcccagccttgtgttgttactttttaaatgggatagctgtagcaaaatgccttgtctcatttgtttggtcccttaatagaatgtctggtctgtggttcaaggcttattattcctaataattagattctgaactaaacttagatttctattaatttgttaatcatctttgtcttctaccatggtagtaaattttctggttatatcagtcacagcactgctttctgaattttcttcaaccatattttgtgtctaaaacagaaaaatcccttggtttgttaagctacagaacagacttttgtcatcaagaggctgtatatttgggcaagtagtaaggagccatgtaacatgttcagtgcctctgtggtgctaggtagtagccctgatccctgacccctgccttctagaggttagctctttgagaatagcatacataaatcccaaggggaacattcttccagtaactgatcaaggactttggtcactaaatttcctaagggagaaatgtggacagctaaaatctgaagccttactgagaagatagagaccattgttcatgacctacagctttgaagagagtagtcatgttgtagtggggaagccaatattgctagaattacagaagttacctggctttggggagggaagtgatcaaagtggatgtttattatggcagaaagtgaaaggcggattcccagttgaattgagaaagctctgtttggtcagctcaggcctcccctggctggggctttgcatcttctggttcaggtcttcctataggtaaccagtgccctatatcattccttagaagcagaagacattgttcatagccctttggtgttttactgttgaaactgtctgatgatcctatggtcagatcatctcaactcagtgttgccttggttttgtgacaaagacaaatactagtgagggattgagcaggcaatccctgatgtgagtattttacttacatcagtgtttactcccaaaggtcagtagcaccttctttcctaggattggtatgtatcttccttcttttgtttagtttggctacttggtatagctctttgtttaagtggagagaacagcattaggggccttgggatcctaaattacatagaaaattatgctgcctggcattgtgagcacaatgaggatagaaaaaaaattccacaagagaggactggtgaaactgtgtgtgttctaggctgacttggtttataaagcattgttctttaattttatcagtgtgaccaagacagtcatgcaaaacattctataggttctttcttaggacttttaccctaagaaaggaatctgaattctaagcctcatttttcttgctgagcagttctccttatcaccagggttgagatgacctacttttgatggcaattcccaaattgccttcaggtatttccacggggaggaagaggctcagtggggtctgtcaagtattgcacgagggcatattactgtgcatgtgtcttcgtgtttctcatctacatcttgtttccctctgagcatctctatgttgcaggttctcaccagaaaatacagagcttcttacaactttaggattactctacttacaggtaatgaaaactctgtactcattcatgcactgatgttagaaatggttttgggtttgtgtgtatggtggttttcctgcattctgatatttattttattaaaggtcatataaagttcatgaactacactctctctattcgatactctttgctaaaggaattaattttctgcatttaaattggaagcaattctattttagcctagtgcaattataattcttatctaggctgggtgtggtctcatgcctgtaatcccagcaatttgggaggctgaggctggtggatcacttgagctcaggagttggagaccagcctgggtaacatagtgagaccctgtctctacaaaaaataaaaaaattagccaggcatggtggcatgcttctgtagtcccagctacttgggaggctgtgatgggaagattgcttgaactcggaaggcagaggttgcagtgagctgagattgagtcactgcactccatcctgggtgacagagccagatcctgtctcagaaaaaaaaaaaaattcttatgctatccaggaaagagcatatatgagaaataactctggtcttggaggctgttattttgttgtgaggagagaaacagatacaagtgagcacttagggctttggggcaaagccatttcttttgatctttcttcccagccagagtcttattggaaagagagaaggcaaagtatacttttatctagaataagaagttttctgtcccctcaacattcctgaatgtgaatgggattcttttagctccattgattctctggctgaggacccagggcccaggtatccaaggggcttttccctcttccccaatatacacatttgccaagttccttggtcagctgattctgcctccagccctgcctctgtggtggcctttatgtctatttcatttttctttaaaaggaatcaggagcttaaccctgggtcttcctgggctttggcttgggaggttggctccacgggagatgaggatacccagctcatttcctgcaaagaggcattaatgtggaacagtactagtgtggcagagatggttcttatcaaatagatactttgaccttatcaggtgacaaattaacaaaaatagaaggaaaaccatgactggggatttttagttttctttctttattatctggtaactgtagctgctttttttttttttttttttttttttaaagtcaagagaactcaaaaaagccagagcatttctgttctgggtgaggttggccagactgttttttttttttttttggagacggagtttcactctttttgcctaggctagagtgcaatggcgtgatctcggctcactgcaacctctgcctcctgggttcaagcgattctcctgcctcagcctcccaagtagctgggattacaggcatgtgccaccatgcctgggtaattttgtatttttagtagagatggggtttctccatgttggtcaggctggtctcgaactcctgacctcaggtgatccacccaccttagcctcccaaagtgctgggattataggcattagccaccacgcctggtctggccagactcttttaactgccgtctccttgctgatgtaaattgtcttgtttgctttttttccaagctcggcatttaccagaaggcatttgaacatcttggcaatgcactgacttatgaccctaccaactacaaggtattacaggctgtgaaggctctggccttcatatagacggtcccactgctcctagaggtgatctgaccctggaaagcaaaggaatagcttcttaaatttggatacctgagaaatagaaaaaatataaataaaaggtggctcttcttatttgaaaatagtgtcaagtatgctctacttatcttctaaaagtgcacatttgttataatagacgtgtaacccctgcagaaggcagatcatagtgctagtaaagcttatgtgttacttaggaaattagcaatgcctccacaactattgtcaaaaataaatctgcggcccggcgcggtggctcacgcctgtaatcccagcactttgggaggctgaggtgggcagatcacgaggtcaggagatcgagaccatcctggctaacacagtgaaaccccgtctctactaaaaatacaaaaaaattagccgggcgtggtggcgggcgcctgtagtcccagctcctcgggaggctgaggcaggagaatggcgtgaacccgggaggcagagcttgcagtgagctgagatcacgcgccactgcactccagcctgggtgacagagcgagactctgtctcaaaaaaaaaaaaataaaaaataaaaaaaataaatctgctgggcatggtggcttatgcctgtaatcccagcactttggaatgctgaggcaggaggatcacttgaggccaggagttcaagaccaggctgggccacatagtgagacccccatttctacaaaaaaaattatccaggcatggtggcacacacctgtagtcctagccactcggaaggtggaagagggaagatcacttgagcccaggagtttgagtctacagtgggctatgatggcaccactatactccagcctgggtgacagatgagaccctgtctctaaaaagaaacaataattatgttgaaatgacttctagagtcctaatgatttgatactacaactttttttctagatgtgactttgggaatgagaaggaatagcatcaaatggatgaacatcattgaggagatgcagcaagacaagctgtttattaaaggatacaaactgaattctgatttaggaagtaacattagactgtcagctcccaccttgatacctttccttagagaaatgaaagggctgggctgatgaagcctaaagctgactcgccctctgttctacggtagaaagaaatttaccttaagtagccacgtacaggtgtatttcaggtatctagaacacttggtataccaaataggggctgcagagaacagattaaaggaagtttttacttaaagggctctggtattcattctgaaatactgactttcctggctagaagtaggaaacagatgggtaaagcaagtaacattttatctttttttttttttttttttttttttttttttgtgctgtgccagagagccacagtgtagagtgcaaggacattcctcaggaacatttgtcccaataggttggatatatttatgtccctggaagaaattttccagtcccatctatgctgatgggcctgctgagtatagactcaggaaagctgccccactgctacagccttttgggaatgactgaatgactttctctgtgccatgttttcaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggtgagtgtcccctcatgttctttgtttgtatttctacatgtggttattgggtctgtttagcttgcccttctcattgagtgccccttctctctcataggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcaggtaagaaacatttatgtggaaaactctctctgccatctgtaatgagggaaaaatggattagaatcatagaagatcagtggctgtctcataggagccattcccttagagatcctataggaatctggattactgtcctggagcttgaagaaatagaaaaagatgacaaaggaacttggttgtttctaacttgggggagtttgactcagagaccaacaggttaaataaagatcatccctagttcaccttttaccaattttttcctcttgccttgacaattcatttatgtatatattgagtccaactaagttccagacagcaagtgttaagagcttgggttttaggtagggtcctgcctctactacttattatatgtacctagggctgatgtgaggattgcatgattaagctctcaattaataatactggttttgttgaaatactgatttttgaaaactgttggttttactgtggttatataattggtctattattatcaatattgttgttactataattggcccctaggtgatacttccaagtcaagctaccttatgttgaaacccttatctcttctgagcatgttatatagaatgccattctcttcctgaaactccattttatgccatgcaaatactaaaattgatcataaaaataagttaaaattaatcaaacactttaacaattatgcacaaccattttaaagtactgactagtctttctaggaatttttttctccatatacatttacttactaaatgtaagacccaaagcagatttccatgtcctcatttggcagtcgttttccagtggctttttgttcattactgtgggttcttatttaaaagagaaagcttgcaaaagcaattgtggttatttgagggttgcctgaatacaaagataactttaaaaaaaaaacataggttttattattattcagatatggtatgggcaacagatcagaagacatctgccactggaaagatagtctgttacaattcctgagaaggagggcatgctacaccgtgcagggccacatggggaagcaccaggtcagtcaggaggtagagggagcaaggggtaaatgtgggcacaattctttattgtagttttcatgggtagaaatgccctccccggggcaagaccgggaaagcaggttaaccaggttggggattggccagtttgaataatttcagtgggctctgggctatagggctgtctctaggtgtctggtacctgaccctcgggtgactaggactagggaatattggcccagtgtcagggcccagtaaaggaggcagttaagaatatgaacactgggttggtcggtctgcatacagaaggtactcttgtaggggttatatctaggaattagctgactgtgggagggacagtctccccagggtcagtaaggccccagatgtcaaaacatcagaataaaaaggctaaagtggggtgtgatggtacatacctgtagtgctggctacttgggaggctaaggcaggaagtttgcttaagcccaggagttgggagtacagcctgggcaacacagtgagactccattcctctctctttttttaaaaattttattttaggttcaggggtacatgtgcatcctgttacacaggcacgtgtgtcatggggattagttgtacagattatttcatcacccaggtactaagcctagtacccaatagttatttttttctggccctccccctcctccagtaagctccagtgtctgtttccctctgtgtctccatgtgttctcatcatttagctcttatagtgagaacatgcaggatttggttttctatcctttattaatttgctaaggatggtggcctccagctccatctatgttgctgcaaaggacacgatcttgttcttttgtatggctgtgtcgtattccatggtgtacatttacattttgtttatccagtctaccattgatgggcatttaggttgatttcacatctttgctattgtgaatagtgctgcattgaacacacacatgcatgtgtctttatggcagaacgatttacattcctttgggcatatacccagtaatgggattgctgggtcgaagggtagttgtatttttagctctttggggaattgccagattgctttccacaatggttgaactaatttacactcccatcaacagtgtataagcattcccttttctctgcagcctcaccaggatgttatattttgagtttttaataatagccattttgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcatggtttgcaaatattttctcccattttgtacattgtctgtttactgtgttgatagtttctttagatagctgggttctaatggaacacagaaatgtaaacagccataatgtaagagataacagcgatgctaactttacaaagtagagatggcattcaaactggatcctgaacaacaagctaaaatggaatagcacagaatggctgaggagccactgtgaagaaaggcatgcagccatgaaactgcagtgtcccttgctgttagtgggggttagtgttagagaatatgatgggagatgaatcaggaaagatattctggggtcagattatggaggtcatgcgtacagtgcaaggactttatcttagaggccatgtttgtccagctgtcttcctagatctcctcttaggtgcctggtaggagtgagtgcatagctggtggggaggtggaatgggcagggcttccagagcagctgtttttgttttatatattaggtgtcaaggaaatactgattttaaaaagtggggggagtgttttactgctaaatgaaagtgtaaagatcatggttatagatgtggggggccagtgaggattcctaagtaggatggtaatgtggtcagatttgtaaggcagtgagatacctggcagcgctgtggaaggtggaatggaggcaggtggggactttgacactggggaataaatggaaagcctaaaactacttgggcctgaacaagggcagtgtcagaaaagaaactgcaaaaaaaggatgcatagaacctggcaactgattgactgtagaagagatggttgaagatagcaccaggtatctaagctgacttagtaaactctggtgccatgagctgacagggtgaagtttactttgggggtagtctttaatactccttttgtcttctaagctgagctctccagctgcagtgctttctttgttgcagtggctctgaccaatctggaagatatagaaaatgccaagagagcctacgcagaagcagtccacctggataagtatgcactttgttgagaatggtactggcgggggttggactctccaaagccatgaggtggtgccatacatagcattggtgctgcctgtgtcagcccagctgttcctctatggcattagtacatagcagacctcagtgtggagggatgtgtctcctaagtatgtggtggctcagcaggaattgacactctgagaaaatgtttccagtcctaaactgagtaatcaggaggctagagaatgtcagaactggcagtgggcttgggttgctgatagctatgggctagctggaatatcagatgggactctgggctgtttaattcaagataaaacttgactcttccaggatttactccgctggcatcttctagacagcagggtagagatccctttttcaaccctggcctaggtagtctctgttgagggctgagatgccagatttggtcccaataccagctttgcttgttaggccattaactccttgattcttctccacaggtctgcttagcacgtatgtacctaccttgctgcataatggagaaatctctacttaaccagttttgttttgtttttgtgtaatgagaaggatctctaaatgaccatttgttgcagagcccccagctccatagaatctctgtctgccacaggtgtaaccctttagtaaacctgaactatgctgtgctgctgtacaaccagggcgagaagaagaacgccctggcccaatatcaggagatggagaagaaagtcagcctactcaaggacaatagctctctggaatttgactctgaggtatgtcttttattagctcccaagagtcataagtaagctctcaggagacttttaaaaatcaagcccaaatcatccaaatccaaggtattacacgttcatggctgttctggctttgatgttcctagcagcatgagttcatcaattaataacagcctgagaaaaactttcctagaataataataaaaggaaattcaggcttactgagttgttattgctaattcaactcatcaaagttgaggtctgtgtctgtctgtagcttccttctatttcactttttttttttttttttttttgagacggaatctcgctctgttgcccaggctggagtgcaatggcgcaatctcagttcactgcaacctccgcctcctgggttcaagcaattctcctgcctcagccttccaagtagctgggactacaggcgcgtgccaccacgcccagctaatttttgtatttttagtagagacggggtttcaccatgttggccaggatggtcttgatctcttgacctcgtgatccacgtgcccagccctatttcacttgttgtaggaaatgcactgtttggcccggtaatgcaccaggcttgaattgttgggttttgagatcctatgtgaaccaccatgccatccagtaaaggcaatctgtaatctctactgtttgataagtacttcctgcctcaactgctagtacgaccagacactatttcagctaaaaccccagctcgaagaccaaagaagtgggttggcttgtctctgacagtcacgcttttgattcttttacttcctttgtggacacaagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtaggaccatacagagctccatgaagacctggcaggtacaagccacatgtgtctgtcagcagagattatagctttcagtgaggttctcttcagactcatatgtccaacgtagtattggccacaaggggagaaaaaaaacacagggtggctaaattggcacttgtttccttaaggcgagctatgtagtaggtaacagctactcacagacttagttggatggtctatacactggtctttccaattttagcaatatgttattaagtatatcctgttatgcaatgtttaatttttactgctttatcagaagttgacacgtaaatatttttcagtgactcattgaaggcaaacttgactgttgctttatttctcagttatagtcttcccttatagttaatgggtcagtcccactggttccagaaaatatggggtttcctcttgaactctaacagcaaaaaagaatgatttcttctgaaattgtggaacatgaggattcaagtttttattttgttactaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtatttttttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatgatcacggtcttcccttacctgtgtctaagcctattttgaaattggaggaggaacctcaaggccaagttcctgcttggtacaggcatggcctctgcagcaaccctgatgcatgataagccagcaatttgcttactgagggccagtccccattttgcactgaaagtgccctttaatcaccataatttaaagatagatagattagatagatgatagatagaaaactgacctactaccaaaccggttggagttccttattttattacagggtctgttttgacattgaagaagcagctaactgagcaggacccccttcatttcttgtatctcaaaaagtatcagaagtgatgcctttgtcattcagctggtggtatgtggcaaacgtggatttgtaccctgaacaattgagaacacttctacttcagcatggagtctagtatattagaatgaaatggtctagttactttctgaaactggaaaagtcttagtgaaaaaagaggaagagagatttaggagctaatatcaacaggaattggggattgattggatgtggcaggttaataattgggtacccatttcagggcttagataaccagggagagtaaaggaatattggactagggttgagggttggttgtggaatctagttttagatgtttaagatatctaatgatgatatccatcagatacctgaatagctagatttcaggaatgaaacctggtttgaagataaagattcaggagtaggccagatacggtggctcacacgtgtaatcccagcactttgggaggccaaagccagaggatcacttgaacccaggagttggagactggcctgggcaagatggctcagacctcatgtctacaaaaaattaaaaagccaggcgcagttgtgcgcacctatagtttcagctatttgggagactgaggcaagaggatcacttgagcctaggaatttgaggtggcagtaagctatgatcatgccactgcactccagcctgggaaacaaagcaagaccccatctcaaaaaaaaatttt

SEQ ID NO: 16588 - DNA, 12151 bp, Human
gttcaaacagctctgagcaaatggatgtccaaggttgcaatggagcttgacctcacctgcagggatgggaaggaccccagaagcggtaccctggaatcacccttggagggtgcatgttcaaaatttggagtcagtgcacctgggctggggcttagagattctgggtttaagaagccctccagcgattctgctccatctagtgcactttgagaaaggttgggctggagatgacatctcctgccacacccaaactcctctccctgatcccaagctgagtcagggtgcttcgggcacatgatcacagccaatcatgtgtccacctttgtctacaggatgaagtccaaattacctgaggctaggcctcaagttactccaagaactgccctcccaaccttatctcctgcctcctgacccacgtcttcagtcatttcaggtctccaggcttctgcacgtgccatctcttcccctagaagtgtcctgctccccttcaagggcctggtcatgagataagaagactcacttctaaattgccctttcaaagatgccccatgagagctggctggacaggaccttccacctcctcctctccccttgtccacacacctgaagaacgctaccaccgtcctctgcgaccactgtctttgaaacgtactctccccaccctgggttgtgcatttcttattctccaggtgtaaacacacctagaggttcagcaaatgttgagagacagtgagagaaagagagaggtagagagaaggacagagtgaagaagagaggaaacgggtgagaaaggagaaagggtggaagagagagaagaggaaggaaaggagaaaggaaggggagaaagctgtgagctcgaacagcccagggttgaggagaaaagcactctggaacagacctgcccgatgcctaccagtctggaactcaagtgattgagcttcgtagttctcatctgaaaagtaggggaataatgcaatacccaccacctaggctgactgcagagttaaatgagacaatccaggccaagcgattacaagggtgcctggcactggcactcaacaccaacagcccaaaatgactattatttgttctcattgtagcccctccagcgtccgggcacacaggcgccttcagtaagcgttgattagacatgacctgtgacccaggcccgggacccctcacacttccagactcagactctccatttacacgtttggaaacctaccctaagcacggcgtgggaggaggcagtgtaggccctcggtccctgcagacctggggagattgtggagggaggagcgtcccagctcggggctaccacccactccaggcctcggcgtcctcggccacagctccctcctggtgactcagcccggcgcgggccgcctgtttggagggataatgataggacagctgctggggccagcgccgcgagggcccctcgcccggccggcccgggaaaaacgaagccatcagatgccaaggggccggtcggccggggcagggcaactcctggccaggccagctcgagaggccgcgctggtcgcctttgaggtggggggccactggctgcggattcccgagggccacccagtcccggcccggagcctcgtcccacgatatcgcgccacaaggagggcgcaggagccgggacagtccagcggccggaggagagggctggaaggatgtggcagggaagcccaggagccccgacccccagccgtggagtttgccacctgcccccggtccggctcaccacgtccagatccgccgccagggcccagcttctgggtcaaggcccgccgggtcagctgaccgcgcgccaccgcccccgcgggaaccgcaggccccgcccccacgccgcgcgctgggctgaccgggcctggaggcgccgctggggccgcgcctgttgtccccgcccccaactgcctccgcgctcctccccggcatgggcggggcccccggctcccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagaggtaacagtagccgcagatcctccccatgcatcgtgtagagctgagcctgtccccagccgtgcaccaccccgctcgggcccggccgcgggcagcaccgacggattcgtccctcgctccccaccccaggtccaccccgcagctctgggaaccccgggacaactagacagtgctttgccctgactcctttcccccactctccttcccttgggagttgcagcgcgagagtctccccccagcctggtctgacccatcgcttcccacctccattgatgcccccgcctccaaacctgccaggtgcccacaaccggtccccacccaggctctcccccttttctctaccccttcgttaccatcatcacgcatgcacaccctgggcacccttttctcatcctggccttttcttaaccactagaatttgacctgtgcagctggcagtacctctgcctctctcagggagaactgtggcgatgccgtaaggctggctgggagagtaggagtgttagggagtgcggacgggtcagggtgtagggactttctatccactctatgccaggctttgacttggggccataggagggaaagtgattccagccctccacagggagttcagagtctaatgaggaagattgaagtaatgattgctggagagcccagaagagagagtactttagggagctgcaggccggggagaggcactagggaaggctcagcaaatgctggatggagctcagccttaaaggctcaatggtaggttggaggagaacaagagaaaggaacattagagtctgtgcaaagacttggtttggaaatgcaatgtgcgtgatgtgtgaaaggaaggccactgggcaggtggggcttgagtggaggatggaggggactgtccctcgtgagcctggtgcccttgatagcccttgggagggtgcctggcactcagtgagggcccagggaacgtgggctgttacccttaccatgcttcacccactggactatcctgaggctgttgctccccacccctgaggagaggttctctctgggtcctcctgagtcatagcgcttggggggtcggggggaaaagagggcaaatgtgaatctcaggcccacgctgtttctagttcacctggctgcatgttgttgtttttgttattattattatttgagacggaatcttgctctgtcacccagggtggagtgcagtggcacgatctcagctcactgcaacctctgcctcagcctcccaagtaactgggattacaggtgcacaccgccacgcccagctaatttttgtatttttagtagagatggggtttcaccatattggccaggctggtcctcaactcctgacctcaagtgatctgcccacctcagcctcccaaagtgctgggattataggtgtaagccaccacgcccggccacgttacatactattaataatgaagattttgttcctgagttggtttttcttctctaacccttccccgcttccgtctttggggccaggagctcactgaaccaaagtcctcaggccaggcctgaggcacagttcatgccaagaatgcctggggcgttgtggggaaatggagaaaatctggatgagaaactgtggaacttgttctgtcccatatcccaactgatctcgtgacacccttctgagctactgagctgactttgctaagtatgaaaagtgcagaatccatcccccaaccaatccagacagctggggttctttttttttgttttgttttttgttttttgacacagagtctcactctgtcgcccaggctggagtgcagtagcacaatctggactcactgcaacctctgcctcccaggttcaagtgattctcctgcctcagcctcctaagtagctggggttacaggcacgtgccaccacgcctggctaatttttgtatttttagtagagacagagtttcaccatgttggccaaggctggtctcgaactcctgacctcaggtgatccacccacttcagcctccgaaagtgctgggattacaggcgtgagctacctttcctggcccagctggggttcttttttaatttttatttttgtagagggagggtcttgctacattgtccaggattatctcaaactcttgggctcaagtaattctccctactcagcctcccaaagtacccccaaactaggtttacagacttgagccactacatctggaccaacagctggggttctttataggggaaagaatagtgcagaattaactcatttccaagctgctcggatgcagaacactgttgtcatagcgatgtgtccctacagtgtttggatatatgctcatgcttctgtgagtcaggaaggggaggggagaattataattacattctgctcagtttgccttctaagctctcaagttgatctctaccactgggccacatttatgtggctgcttcgctttcctaaactcttccaggcctgcccccttgacttctttctctatactgcagccaagtgtgaacacaggtgaccggttcacaccctgacaaaatctggaatgatcaagttcagattcagtgggatggtatttaagaacttttgggatgaggtctgtccctgtctcttgtcctacgtcccactgctccttgctctagaatttatgctcttataacttagacttgaaggtttggagcctcacatagtgtttttttgcctctttgactttgcatgggttcccatgctctggagtgtacttcctgctcttccttgttggctgggactctgggagtgatcccctagagaaagccttccctggagtctccaagttggcttcatgcatctcatctgggctccttggcatcgtgtgcctttccctcctgtgcttaccatattgtaccatcatcctctagggctccaggagggcagagatccattgtgttcagttcatctctgcatactcagtctctagtgcaaggcctggcacagccagcaggttggtgactaatgatagttattctaataggtgaacattgagaactcacatatatgacattatttaatccccaggacctcccaatgaggacagtttgattattatcaccccattttacagatcatacaattgaggccaagagaatattagtaatttagccagggttacatggttagcaaatggctctaataggtcacttaaccattccattctctctccaagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggaggtgagggggccctccgagctccaaaggtgggctcctgctcctttctttatcctgatcctactcatgagagcagaggcaccagggcagtcccagggtggggcagggaatagccccattccctggggccccaccctggcctccccttcctggtctgggctacactgcgttctgactggagcctcacccatgcagggcaagttcgtggagcttggcctctccaactatgctagctgggaagtggccgagatctgtaccctctgcaagagcaatggctggatcctgcccactgtgtaccaggtgagggccggggctgcagaggccaaggtctccaggactcctgctaatcctgggctctctttgcccccctgactgccccctgtgccgtctgcatagcagccactcccctgctgaaagcctgcagatggctcccatgtaccctcaggatgccattcaagctcctcagcctggccactgggcatctgcttccttcctgcctatctgtgcaccttggacccttccttccccacctcctttcatacttcagcctggaacacatttcccctgccctcctccctgggagaagcactcaggccttacatagaggtctcctcctctggaagcctttctagacagccccataggagtctccagtctccaaatctcatcttcatacattcagcgagtactttccagctccttgtttgattgtagaacctaactttattgtaattaactgccttccttgtctatttttttaaacttgagtaaacatctcctggaagcagggattttgtgatacctacttgtggttgtaaccagtgtccagcatggagttcatacagcagatatttgtggaaagataccattccacttcaattttctgtccttgggcccaacaccttccctccatcccctactaacagtagtgatgttagaatattgctgaagtcctgggccggtgttgctttagaggtttgaaagtggaaggcaacagttccttctcttgacatgtccaccctgtccccggggtccctctccctgcagggcatgtacaacgccaccacccggcaggtggaaacggagctcttcccctgcctcaggcactttggactgaggttctatgcctacaaccctctggctggtacgtggagcattcctgaccctgtctcagcctattcctgacccacagatgcccagcccagaatttatgaagcagggagggtttgacaagaggctgggctgtgttcttcagcccctcctgggtccctgcccctcccctagaccagagccctgagggatgtggcagcttctggggcactctggggccaggggctgattgctgccttcccgcagggggcctgctgactggcaagtacaagtatgaggacaaggacgggaaacagcctgtgggccgcttctttgggaatagctgggctgagacctacaggaatcggtgagccgggggtgggcttggtgaggatggctggggtggggtcaaatctatgtggaatgaagtcctgggctgttcctgaggtaagaccttcctttgctgtttgcatctcctcccctgcattgcttcaggaattcccaagccctctgtgggttttcttgttgtcttgagacctctgggggggaaatgaggatccctggatgttggggtcttgaagtcatagctcgttcctgagcaatcacctgctgggaagcaaaaagcgagcccaggatgggccaggcatggtggctcacacctgtaatcccagcactttgggacaccgaagtgggagggttacttgagctcatgagttcaagaccagcctgggcaacatggtctctacaaaaaaaaaaatgcaaaaaagtggtcaggtgtggtggtgcacacctgtctgtagcccagctacttggaaggctgaggcaggaggattacttgagtctaagaggttgaggctgcagtgagccataatgatgccactgcactccagtgtaggcaacagagtaagaccatgtatcaaaaagcaaaaagagagcccaggagggaatcctgccccatctgagcagccttcgtgtccctagggaagtccctaggctactgagtcctcaggagtaaagatccattgaggtctctgctgaggggcccagcatcctgggtggttctgatgcccagcaaagtgggagacctatgactagagaggacacccgcccctcagggctgcagggtgtggggtggggcagtggtcctggatggctatttggttgcggctcccagtgtgacccccatggtactgacccctgtgctaacatcccctctgcacagcttctggaaggagcaccacttcgaggccattgcgttggtggagaaggccctgcaggccgcatatggcgccagcgcccccagtgtgacctcggctgccctccggtggatgtaccaccactcacagctgcaggtaaccagcgaccctgggtgctcagcttcttcccttccagggggaccagcgtcacctttaggtgaagcccaaagcatttgatttctgaattcctctgaaatttttctttcttccaattctcataagcactcttcccactggtctttgatggtatctgagtggaggctttgtagtgagggattttcattacagggattttcttattccttaggctttctgaagtatgattatcccagtgttattgatgaggaaaccgaggttcacccagctattaaagtggcagacattttaacacaggtttaactaagacccacccatctcacccttttggtttctctctcttgatgcctcatgtcttcctggttaaaacttatttcctgatcagtggcagtgacccacacctgtaatccagcactttgggaggccgagatgggaggattgcttgatctcaagcatttgagtctagcctgggcaagaaaatgggaccctatctctacaacaaatcaaaaacattagccaggttgtgatggcttgctcctacgttcccagctactctggaggctgggatgggaagatggcttgagcctgggaggtcaaggctgcagtgagctgagattacaccactgcaccttagcctgggtgacaaagcaagaccctgtctaaaaaaaacaagcaaacaacaatgaaaataacagcaacaaacttatctccagcttcagccttccatgttgcatagtgtctggcatatatccggtagatgttcagtacgtgggagctgtgttttacataagttttctcattccaatgctgaaaacagagaaaaagattgaatgtcatgcctgcatcgacagcacatatactaaaattggaatgatacagagaagattagtatggcccctgcgcaaggatgacacgcaaatttgtgaagtgttccatatttttccgctgccaccaccacaccgcactacctcccacccccttttgtgtacaaaacacaaggaaaaatatttttgtttgaaaaaaaaaaagatcgaatgtcaaaacaagcttaataacgtagcctgctttttaatttttttgagacagagtctcactctgttacccaggcggtagaacagcagcacactcatagctcactgcaacctcaacctcctgggctcaagtgatccttctgcctcagcctccctagtagctgggacaaggcatgcaccatcacccctggctaattttgttttgttgttttttgtagagacagagtctctctctgttgcccaggctggtcttgaacactttggctcaagtgttcttcccaccttgacctcccaaagtgctgggattgcaggcatgagcctctgtgcccagccaacttagccatttttacacagctgctgggggcagaactgggctgtgaatgtagttctgtgtggaagcgtcgtgcggcagtaggggaaaggatgcgggtttcaagtcacgtgggtacagctatccaaggcaccttaagtcctttctggacatacaagatataaatataaacagagaccccagatctcagcagggaggtggctgggacggctgtgagtggagtcgctgtgcagcagaagagggttgaagtctggccgtctcccttgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaacttgctttctctgctgttaacactttgtttcccatcctacctggggactgagaaagggcagaaccatgggctggagtcttcagagggcagaggtagtaggagggtcacagaagcacactgccctcccagggtctcctcgggcccctggtctgaatacccacctgacctctcaacattgaggtgtctctcactcttctacacacgatagaaaagagagtcatacacctgcagtacattttctctaattcagagttgcctcaatacattcttaggaatgaaacaactgggacaaagaaactaccattagagtcactaccaagaagaagaacacttcccaggatctgtggaacatcttgaagctctcaatcttagcctcctcttgtcttaactaaagcctcttgtcttttcacccattaggttctcagtcttggctctgggcctcctgttcggcatggggacagacataggcagccaaggtcctcatttcccttggaaacccctactccaaacaggaggcaccaaggctgagaataagaatccttggttcagtggttgctgaacctgctgcattcccagtgcaccaaaatccctccagccatgggcagggcagcaggcagcacttggagcagcttcttgaagcaatgaaagaggcccaacctggaaatttactttttcatttatatttattatttgttcttgagacaggctcttgctctgtcacctagaccggagtacagtggcatgatcactgctcacagcaattttgacctccggggctcaagggatcctcccacctcagcctcccgagaagtttttatttttattttttttgtggagtggagatctccctatgttgtcaccgtcttttctgtttacccgtaacaaaacagatgctcacccatgtggaatggtgtatcagttatctttgcacaacaaaccacactaataagttgcttgaaaagataaaatccaaggctggcacagtggctcatggctataatcccagcacgttgagagcccaaagcaggcagatcacttgagctcaggagtttgagaccagcctgggcaacatggtgaaaccctgtctctaccaaaaatacaaaaaattaatctgtgtgtggtggcacatacctgtggtcccagctactctggaggctgaggtgggaggatcgcctgggccccggaaacagaggttgcagtgggccgagatcatgccattacactctagcctgggtgacacagtcagaccccatctcaaaaaaaaaaaaaaaaatcttattgatcaaaagatttgatataattcctattattcccagctgactttttcttaatactgaaattgacaaactaatcctaaagctcatatggaaattcaagggacccaggagaaccaaaacagtcttgaaaaacacatagttggaggacttatactttctgatttcaaaacttactacaaagctacagtaataaagacaatggttctggcataagaatagagcaactgaacagaactgagagtccagaaataaactcttactgattttagagttgagtgacaactcaatagggacagttcaatagggaaaagaatcatcttcaccaacatccagatgtcctgctgtgaaagagtgaagttggaccccttccccataccataaacaaaaaattaactcgaatcaccatctaaatgtataaggtaaactataaaactcttagaagaaaatacttgagtcaagtgtgactttggattaggcagtggtttcttagatgttgacaccaaaagcacacgtggcaaaagaaaaagtaaagtcaacaccatcaaagatgaaagtgttcgtgcttcagggaacactatcaagaaagtgaaaagacaacccaagaatgggatagtattttgcaaatcacatatctgttaagaatcttgtatctattctagctataggactcttacaacttaataaaagagaaaacccacctgggtgcactggctcacgcctgta

SEQ ID NO: 16589 - DNA, 112508 bp, Human
  misc_feature (1)...(112508): n = A,T,C or G
atctgtgattagcagtaataccagtatccctccctctccaaatctattcagttggtgagttcagctaagaggtctagagtgctgatagtaagaattaacatgccatctgaatcgcttttcttctggagttctggtctttgagcaagagctgaggtggtctgggacttgcatactgataagggaagaaagccagctcgaagataccttgaaccttctggtgagtctggggttagaagtgaagtagggagtgaaacagaggatggcaaatactgggggagaggctcagtgctccattagcccatgtgacagatggtttgagaagatttgccaggtcaatgtggggtcaattctaaaagtgtcctaagtctaggccaagaggaacaaaatgcagctgggtctctgacctcacacgccgaagcccaaggacacgttagggccaaaatgtgactctctaaggtcacctgtaaaactggacaatctggtaaagtcagtgaaggttaagatcatgaatccagccaggcgtggtggctcacgcctgtaattccagtactttgggaggccaaggaaggagaccaaagagaaaggatcacttgagcctaggagttcgagaccagcctgggcaacctagcaacctccgtctctacaaaaaatacaaaaattaaccaggtatggtggccggtgcctgcagtctcagctactcaggaggctgaggtgggagaactgcttgagcctgggaagcagaggttgcagggagtcatgatggtgccaccgtactctagcctgagcaacacagcgagtgagactctgtctcaaaatgaataaataaataaaagaaaaagaaaaatagtaaaactcaggacaggtgggcccacaaggaaagagttctgtggcttttactcccgttttttggttggtccaaaaaattcccagcagtccagggatctctgtggagttctcagtgagtgttctgtgtagggtgcaggagccacaagtgactgcagggggaaaggggggttctggtgctggcattctgcagcagtgggattgtcctctgtcataaagaaagagaaggccgagcgcggtggctcatacctgtaatcccagcactttgggaggccgaggcaggcggattatttgaggtcaggagttcgagaccagcctggccaacatggcgaaaccccgtctctactaaaaatacaattagtcgggcctggtggcacatgcctgtaatcacagctactcaggaggctgaggcaggacaatcgcttgaacccgggaggcggaggtttcagtgagccgagatcgggccactgcactccagcctgggcaacaagagcgaaactcgtctccaataaataaataaaatccaaaacgctgggacttgaagtgccctcctttcaatcttgacccaggtaaaactcaggacaaataaaaagaagtagaagcagtaaacttaggacatacagcatgtaaaggttctgaacgcaggagtaaatgacttcaaatagcttttgtggcctttcgccaaggaccgggccctccctggcaagctggggccgggtctgaccttccaggttggcgtcagcaaggaccaccctgcccttcagtggccggacacgaccttgggctttcgtgcagtagcctggctgcaggccaggtcgagtccgccaccccggggacttgcaccgcccttcagaaaccgaaacctgctcggccccaggaggcggaccgggagaaggggggggggtgtgtgtgtctcgggacgggggcgtggtctagaggcgggggcaggggaggagcctcgggtggacgcgcgtgcgcaggccggagcctcgggaggaggccgggtacccggggtgcggcgcgcgcgggaggaaggcggggcctcgggcgaggggcggggcctcgggccgggggcagggggcgggcgcaggcgcaggcgcgggcgggcggggcgcggggcgcggggcgccgggggcggggctccgagccgggctgaggcgagcgggggcgcgggtggcgcggcgggacgcgagcggcgagccggagcgcggagcccggctcccgcaccatggaggaggacgacagctacggtcagtgcgccccggcggcggacgcttccccctcgctgtcccccagtcccctccgggcccggccgtccggcagcgcttgcggcggctggcgtttcccggggacactggtgcgggacgcggagcccggggcgaccggcgggcgagcggtgcgcggggccctcgcggggcgggggtcgcagggggttttgagggatgagggtcgccggggccggggtcgctggcggcgctgagggatgtgggtggctggggcgggggtcacaggccgggctcgcggtctcgcggggccaggggtcgccgcgagctctgaggaatgagggtcgttggggtcgcggggcaggatctcaggggctctgagggatgagagtcgttggggtcgctggggtccccggggcaggggtcgcagtccgggtcccggggggccgaggggtggaggtcgctggccctgccgcccctctgcggggctcggggcggacgcgcggatggccgggcccgcgttccccgcagtttccggccgctctcggcgtcagcgagttgtgcccggtccacgtctttgttcagaaatgagaacggggagcggcgccgccggcgaggcgcgggctccgggacggccctgcccgcgggagtctgggcccggtagccgccggtccggtgcgtcgccgcctgccgagacgcgggtgtggagcccgaggggcaccgcggtggggacgccgctcctcccctgactggggacttggcaagcggagccgctgtcccgctcccttcgctcccgcgcgttgaggctgctggcccaggccaggggtgcctccctccaagagtttgaaattgcaagggttgcaaaaggttgtttgacatgctgtagttaatttattaagtttgttcatgaggaattaaaaggaagaatggcaaatagaacaagtggtgaacttttgtggtttggtagcaaagtacaaataaagcagaactctgtggccaaatggaacccaattctagtttaataactaatgggacatttttcttttttttttttttttaagagacgagatctcgctctgtcacccaggctggagcacagtggcgtgatcgtagctcacgtcagcctcttgagtggctggaaccatacgcacgccaccatgcccggctaattttttattttattttattttattattttattttattttattttatttttgaaacggagtctcactctgtcgcccaggctgtagtgcagtggcgccatctcggctcactgcaacctcggcctcctgggtgagctgagcgattctcctgcctcaggctcctgagtagctgggactacaggcgcgtgccaccacgcctgtctaattgttgtatttttagtagagacagggttttgccatgttggccaggctggtcttgaacttctgacctcaggtgatccacccgcctcggcctcccaaagtgctgggattacaggcatgagccaccgcgcccagccctaattttttacttttttaaaagatggggtcttgccatgttacccaggctggtcttgaactcctagacccaagcagtcctcccacctctgcctcgcacagtgttgggattacaggcctgagccaccacacccagcccacttgttaccttataagtaaacaagtaaaagcagcttgtgcatttttttgttgtttgttttgttgtgtttttgagacagggtctagctctcttgcgcaggctggagtgcaggggcgctctcatagctcactgcacgctctgcttccttggctcaagcaatcctctcacctctcttctcagcccctcctgtaacctggactacaggcctgggctaccacgccctgctaattatttttatttctttttgtagagagggaggtctccctatgttgcctaggctggtgtgaactccagttcctatcttggcctcccaaagtgttgggattacaggcatgagccactgctcccagcctccttttgtgattaaaagaaaaatcacccactggctggccccaaaagattgttcagcccctccagatttcactcctgcccactgctgagaagccgacagcagttttgcctgctgctcttttctctgcctcctcttgccatttaatttccctcagatcccagtgtcctgcctaccaggcttttgtggcctctcttgtgttcttgcctgctgccgtgggcaggaagctattggtctggttgcttttaatacagtgactgctttgccaccaggcatgacatgaacttgtacttgaaagaggtaagtggaagcagggcgtgttagtttcctatacctgttatattaccacaagcctggtggctcaaaacaacataacatttgttttagggttctgctgtcagaagtccaaaataggtctcactgggctaaagccaaggtgtcggacaggctggttctttctggaggctcaggggagaacccatttccttaccttttccagcttctagaggccacctgtgttccatggttcatagtcccctttccatcttcaaagccagcaggtagcatcttctcatttctctcgacctcctacctccctcttattaagatccttgtgattatagtgggacccacctggataatcaaggataaggattagcaaccttaattccatctgttaccttaattccccttctgccatgtaaggtaacctattcacaagttctggggattagtacccggacatctttaggggctgttattctgtctgccacacacgaagatgagaaagtttgtaagtttattcttcccctttcttttttttttttttttttttttgagatggagtttcactcttgttgcccaggctggagtgcaatggcgcaatctcggctcactgcaacctctgcctcccagcttcaagcgattctcctgcctcagcctcctgagtagctgggattacaggcatgcgccaccacgcctggctaattttgtatttttagtagagacagggtttctctgtgttgtccaggctggtctcaaactcttgacctcaggtgatctgcctgcctaagcctcccaaagtgctgggattacaggcatgaaccaccccgcctggcctgttcccctttctacagttttaaatatcatccttttattttggaggaactaaaaagattgaagattccccacccagagggtcaccacacaaaaagtacctgatggtgtaagatgatcatatgaagaataagactcccaagttctttaaggtttgtgttagtctccagaactgtccatttccctcataggtttcacagagaatttaccttgaccagatcccacattgtaaaaggaaatgtgtgtgatggattcataaagcatataacatgacgtgttcagacgtcacctcagaacttccattgttttcttttaaacaaactttttattattattattttttaaatagttgcagagtctcactatgttgcgcaggctggtctaaaaccatcctcccgccttggcctctgaaagtgttgggttgagtcactgtgccaggcctaattaaactttttctttcttttttttttttttttttttttttgagatggagtctcactgtgttgcccaggctggaatgcagtgacgcaatcttggttcactgcaacctctgcctgctgggttcaagtgattcttctgcctcagcctcccaagtagctgggattacaggcacctgccaccacacccggctgatttttgtgtttttagtagaaatggggtttcaccatattggccaggctggtcttaaactcctgacctcaagtgatccacctgccttggcctcccaaagtgctgggattacaggcgtgagccaccacgcccggccctaaataaactttttaaaccttaattttttttccttttttttttttttttttttttttgagacagtcttgttctgtcacccaggctggagtgtggtggcacagtcttagctccctgcagcttccacctcctgggttcatgcgattctccctcagctttctgagtaggggttactacaggcacatgctatcatgtctggctaatttttgtatttttagtaaagatggggtttccccatgttggccaggctggtcttgaactcctgacctcaattgatctgcctgcttcagcctctcaaagtgctaggattacaggcctgagccaccaagcccagcctaaaccttaatatttgattttcagaataatgagaaacatttcttgtggtgttaactttgtgtgtgcgctgttttcaacagtgcttcctctgtccctgtccctgtccctgctgcgtaagttggtaacgttttgtgaatcagcctaggacaggtaccactgtttttagaattctttctttttttttttttttgtatttttaatagagatggggtttcaccatgttagctaggatggtctcgatctcctgacctcgtgatctgcccgcctcagcctcccaaagtgctgggattacaggtgtgagccaccgcgcccggctttagaattctttctggagggaaatgcattgtaatttcctggctaccttttagtattaaaaaacttttggaacatagctcattgataatatgctatagaaagagagtcttagagtttctctgtccaattaaagacaatttcaaaaaccaacaaaaaggctttctcagttccagtactcttttgtattcattagatagggacagtttggttcagactacacctgtgtgggatatatctttactggtttgtttatttatttaatttatttatttttatttatttatttttgagacggagtcttgctctgttgcccaggctagagtgcagtggcgcaatctcggctcactgccagctctgcctcctgggttcacaccatctcctgcctcagcctcctgagtagctgggactacaggcacccgccaccacacccggctaaatttttgtatttttagtagagacggcgtttcaccatgttagccaggatggtctcgatctcctgacctcgtgatccatccgcctcccaaagtgctgggattacaggcgtgagccaccgcgcccggccttatttttttttttttgtgagacagagtttcactcttgttgcccaggctagagtgcaatggggcgatctcggctcaccgcaacctccgcctcccagattcaagcaattctcctgcctcagcctcccaagtagctgggattacaggcatgcgtcaccacgcctggctaattttgtatttttactggagacagggtttctccatgttggtcaggctggtctcgaactcccgacctcaggtgatccccctgcctaggcctcccaaagtgctgggattacaggtgtgagccactgcacctggcctattggtttctttttttaaaaaaaaaaaaactgtttatggcactgtggagtcccaccagacaaaccattaacttaagaaaatactattctgctcaggaaaaagaaaaaaatcgtaaaaattaaattttgcatacattttctttataacatgcatactgtgtgtacttttttttttttttttttttgagacagagtctcgctctgttgtccagcctggagtccagtggcacgatcttggcttactgcaccctctgcctcccgggttcaagcgattctcgtgcctcagcctcctgagtagctgggacaacaggcgtgtgctaccacgctcagctaattgttttgtatttttagtagagatggggtttcatcatgttggccaggctggtctcgaactcctgacctcaaatgatctgcccgcctcagcctcccaaagtgccgggattacaggtgtgagccattgcgcctggcttgtgtgtactgttgccagtatatatttctgtgtaataatgttcagggttgtaaacagaaaaccacatataatgcactttaagggagtatttgcgggattttccagagagtatgttcatcctgttgctctgtaatggtcatcattttggggctaatgactgcagttgccgtgattcaattatgaacttcctttttaagcataatttcttttttttgttgttgagacagagttttactctgtttcccaggctgaagtgcagtggcgtgatcttagctcactgcaacttctgcctcctgggttcaagtgattctcctgtctcagcttcccaagtagctgggattacaggcatgtgccaccacacccggctgatttttgtatttttagtagagacgaggtttcaccatgttggccaggctgatctcaaactcctgacctcaggtgatttgcccacttcagcctcccaaagtgctgggattacaggtatgagccaccgtgcctggcctttaagcataatttctatataaacatttaaaatgaaagttgctggagtctatcatgttcattatagcaaatgcatgtcttatttttgttcctttcaagaagttagcttcaattagggaagttgtcaacagagaattttaaaataatttttaggtgagttttcaaatgaaaaggaagagacgtctgcaaatgtcctttacttattcagcttctgaaataccttactttttatttgcctttgatgtaatttttacattgagttcccagattgattatctaaagcaggaaaggtagaactaattcattatctaaaacaagaaagaacaaatttcaagttaaaatagcagtgttttcagcaagaattaaaaaaacgaggtttcactttctctgtagaggaagagtggtggggtaagacattcaagaaagttgttcattcgcatatttcgagaagcattgaggtccaattgcataaaaacgtatctgctgtctctagctttggcctttgagggaaggatataagggaatactcaggacaggggtaaaaagaaaaaagacccttagcacccgaggctttcaagatcactcttaattagtaacttccttccatctctcctcttcccctaacccccagcggcccccccaatcttcatgggccacaggagactgtcagggtgttcagcctggtttctgtgccgggttaggtgtggtgtcataacacacagagggacctcaggaggactaaccctgtggtctgtggatggtgtgatgcctcgggagctggggtgactgcaggggtgggtgcctagtggcacagagggaaagcaggcagcaagtccagggccgttatgccagccacaggtggtgggctgtctgagggagcagtgccttgcggcagttctaacccgatttcccatgccgaatgccctggtgggtacttcgggggtttgataagaaaagagagtagtttcttctgtgttttcatggaaaggagttttctcacaggcataatcttgagtgtctactcaagatttgggaacatttcacatgtatgtattacggtttgtgaccaaagactctggataaaaggaggatttatatcagaattataggaagagctgtcatgctgtaccatggagacctgtgtgtgggtggtgagaagattcaacaagaaaaataaggtctgggcactggcatgtctgggtgctgctgcgggctggggagaggagcctgttgcatttaagaaagatttgccttttcatcaccatgtctccagaataggcatggtgcctggggccctacagaggcagctcagcaactgtggagggaataatggattgaaccaagttccatcttgtaaaaagttaatatgtggtgagtttgagtttttttcctcaactctccatttcaaacagaaaccagaacacttctgtgcatgtttgaccccatgcagaacccgttttctttgtttttctatgatatggatgacttccattattctcaaacttagttactaacttactgatttgcctttattgaaaagaacacaattatttacagtgaacaccttcttagaaaatctggaacataaggttgccataattatacacactttgtggtctttaagatatattctcagggtgacatgaacatgtcagagtataaacatttttagaattcttgatgtctggtgccaactttttccaaaagggctgcaccaatttactcttttcttagcaatgtatcagtacacgtacctgtaatagtgcaaatgtgccctcagtgaggatcaacattttaaaagtttttttttaaaacaaacaagcaaacaaactgaatttggtggttacaaaatggtgacttattaaatctactgatcactagctggattgaaaaaaatttttattttgcatatttgtgtattatgaactggctacatcataagaaatgatggtttatttacttaacttaggttaactcttttctatcaaataaagtgatttacaggtttttgtcactgttttaagcatggggaaaatgtgtatcagttttgactggggtttaggttagattttggctaattgtaacagtcgtttacctttcttttaatttttcttttaaagatgaaagatctctcaacccatatattgtcttctggccaactacaaaatgtttccttacgagaagaaattgtgaattaaatagatttttagaaaatttaatttaatttaattttttttttttttttgagatggagtcttgctctgtcgcccaggctgcagtgcagtggcacaatctcggctcactgcaacatctgcctcccgggttcaagcaattcttgtgcctcagcctcctgagtagcggaattacaggcgcacgccaccatgccctgctgatttttgtatttttagtagagatggggtttcaccatgttggtaaggctggcctcaaactcctgacctcaggtgatccgtccgcctcggcctcccaaagtgctgggattacaggcgtgagccaccgctcccggccagtagattttttttttgaaactataatttttcttttaattaaatagagcagggtctcactgtgttacccaggctggtcttgaactcctggcctcaagtgattctcctgccttggcttcctaaagtactaggattacaggcatgagccaccacaccttcctgtgaattaaacagattgtattggtctgggttataatgataaactgttcagtttcaggctgggcatggtggctcatgcttgtaatcccagcactttgggaggtcgaggtgggcagatcgcttaagctcaggagtacaagagcagcttgggcaacatggtgaaaacccatctctactaaaatacaaaaaaaaattagccgggtgtggtggtgcctgcctgtgatcccagctactcaagaggctgagtcactagaatcgcttgaacctgggaggcggaggttgcagtgagctgagatcgtgccactgtactcctgcctgggcaacagagtgagaccatgtctcaaaaacaaaacaggccaggtgtggtggctcacgcctgtaatcccaacactttgggaggccaaggtggccggatcatgaggtcaagagatcgagaccatcctggccaacattgtgaaactctgtctctaataaaaataaaaaaatcagctgggtgtggtggtgcacgcctgtagtctcagctattcaggaggctaaggcaggagaattgcttgaacctgggaggcggaggttgcagtgagccgagatcgcgccactgcactccagcctggcgacagagtgagactccatctcaaaaaacaaaaacaaaaacgaaacaaaacaaaacacttcagtttctggaatcttatggctcatacctgctcctttctaaatgttccatgtgttaatcaaaagagattatgtcaaacagattttttcttcagtatttcttgcattcacgatcagttaggacacttattctatagtaagaattagaagattgccttcttatttcaagtatggggggcacacatcataggtcatttggaacaggagagatgaaagggatgaaacatctctgtgtattgtgctggaccggtggaagacttcaacttgagagccgtgtcgagtctggtcgagtctgctttcctgttattgttccacacctttcctgctctcctctccaagatgaaagtcttcagagtgggcttctaaagaaaagaactttgcctgaacctgtccatttgctccgttgccacactacttgattgtctctaattattgttgcaatttagtttcagttgcaatcatagaggcatggaggaggtggaaaattatttagaaatgatcaagaagtgaatcccacatcctctgaaactgctggtaatgttgttttgcttctctgtttgcattaacttcagaaaaacacaaaagcagtgaagggtatgtaggggatttctatgactcctcattatccaggatagcgtgacattgtatatttctgcttttatggtagtgagatggttattagctgctttctttagtgactgaattttatagtaagggccaggataataccttccttatccaagtctttatattttccaccttttcttttctttctttttttttttttttttaagatggaatctcgctctgtcaccaggctggagtgcaatggcgcaatctcagctcactacaacctccaactccctggttcaagcaaatctcctgcctcagcctcccaagtagctgggattacaggtgcatgccaccatgcccagctaatttttgtatttttgttagagacagggtttcaccgtgttggccaggatggtgtctatctcctgaccttgtgatctgcctgcctcggcctcccaaagtgctgggattacaggtgtgagccaccgcacctggccttcttttttctttgagacagtcttgctgtgtcgtccaggttggagggcagtggcgtgatcttggctcactgcaacctctgcctcctgggttcaggcatttctcatgcttcatccacctgagtagctgggattataggcatgtgccactgtacctggcttatttttacatttttattttattttatttttcagacagggtcttgctctattgcccaggctggcatgcaatggcataatctcagctctcttaacctctgcctcccaggttcaggcagtttacctgcctcagcctcctgagtagctgggattacaggcgggcaccaccatgcctggctaatttttgtatttttagtagagatgggattttgccatgttgggcaggctggtcccaaactcctggcctcatgtgatctgtccacctcggcctcccaaagtgctgggattaccgatgtgagctactgcgcctggccagtttttgtatttttaggagagacggtgtttcaccatgttggccatgctggtcttgaacccctgagctcaaggaatatgcctgccttggcctcccaaactgctgggattacaggtatgagctcccgcacttggccattttctaccttttcttgagtcttcaaggcttctatttcagaagcgtgcccttacctggcattgttaaatctatgttgtaattagtagtgttaggtatgaatgatggaattggctaaggctattaaaaaaacctattttcagtcgggctctgtggctcacacctgtaatcccaggccgaggcaggcggatcacaaagtcaagagatcgagaccatcctggccaacatggtgaaaccccatctctactaaaaatataaaaattagccaggcgtgatggcgcacgcctgtagtcccagctacttgggaggctgaacaaggagaatcgcttgaacccgggaagtggagattgcagtgagccgaggtcacaccactgcactcccgcctgggtgacagagtgaggctccgtctcaaacaaaacaaaacaaaacaaaacaaaaaaaacccgcctattttgtagtaatatcacagatttctttgttttttttttttcttttcttttcttttcttttttttttttttggagatgggaattttgctcttgttgcccaggctggagtgcagtggcacaatttcgactcactgcatcctccacctcccgggtcaagcaattattctgcctcagcctcccaagtagctgggattacagacacccgccaccatgcctggctaatttttgtatttttcttttttttttttgagacgaagtcttgctgtgtcgtcaggctggagtgcagtggtgcgatctcggctcactgcaacctctgactccctggcttaggtgattctcctgcctcagcttcccgagtaactaggattacaggtacacgccaccatgcccagctcagttttgtatgtttagtacagacggggtttcaccatgttggccaggatggcgtctatctcctgacctcgtgatccacccacctcggcctcccaaagtgctgggattacaggcatgagccactgtgcctggccaatttttgtatttttagtagagacggagtttcactatgttggccaggctggtttagaactccgaacctcaggggatccacctgcctcggcctcccaaagtgtcagaattacaggtgtgagccactgcatccggctcgcagattggtttctatgagtagtttgtaatggtttattcagtcaacaagcatgagtgatcatttcataccatgtagtccctgttgtcaccgatgctttgagtctagaaggaggagacaaacatggcagcaagctgtgaaggagcgtgtcacagtagatgtggcaggtgtgtgcatgaaaaatgtaggtaaaccaaggagagcagtgccagttccactggcgctgggatggcactggattggccaggggagagtttgtagaggagctggcccttgggctggattgtgaaagatgagttagtgccaagtaggagaacattgcaaagaagtatatatcaaagcaaagagaatgagaggacaggaggtgtgaagcagtttcgccacttggggagctacaaatggttctttgtgcctggagagtaggctgtgagcagagggaggaggccagaggcagggttagagaaatgggggacagttatggggggcttcagtatgtgttgttacacaggacttattctgtgggacacggagctatgagagggtttaaaccagggatattttatgctgattattttgctttttttttttttgagacatagtcttgctctgttgcctaggctggagtgcagtggcgtgatgtcagctcactgcaacttctgcctcctgggttcaagtgattctcgtgcctcagcctcctgagtagctgtgattacaggcatgtgccaccacacctggctagtttttgtatttttagtagagactgggttttgccatgttggccaggctggtcttgatctcctggcctcaagtgatttgccaacctccatctcccaaggtgctggtgtgaggcactgcgcccgttcttttttttatttttattttttatttttgccaagagggggaagggagagagaaaggaagcaggtggaggcaaggagagggagaagcagagcattctgttgcattttagaaagattcttctgacttagtgtggctcagattggcagtggagagacccttaaggaatttttggagataggtgagctaggtgatgagggcttgaattcaggctgtgggagtaggaggtaggagagaaaaaatacaggaccagtgaaggacatgaaattgatggatttggttgccagtgtttgggagggacatagcattgaaaggagatgaaagagacagggtgacgaaggtgagcaccaggtttctgtctttggatgactgcttggagagtttccatactgagaataggacttcggttttggacgtaatctctggagttttgtggtacttgtacagtgtccactttgagagacccatttaaatagttgaatttgaacctgcaactccagagatgatcaacgcaggagtgggagtggaacccagggagtgggtgatgccacgggctgattgaggagtccaaggatgtcgtcttggaataccaccactgaagggctgggtagaggaagagatctgaaagggaaactttgaaggcaaatgtatataactcttcaggtaactagatggtaaatggaaagagagagagggcaggagctggaagttgcagagtggagagctttttgtatttttctgggggatattaagagtatttatagactcctttttatacctttggacaatgattccgagccagtcttgaatgaaaacattcatatgtgatgtgttgtaaacctccaggacgatcggtctcacatttcattttgtctgttctggcttctgtacacagcagctgcagactatatgtgtttttgaaacctgtttaacttcctttcttttgtgttctctaattctctgaaatattatttccaacagccctaagattgaaattaagagaacgtttgaatcttagctgcattctggcattttcaagtgcttcctgcacatttccccttggatatcccatcattgtccaagattcagcatgtccgagacttgctcctggccctttcattctggtgttacctctagacctctctaatttttaaacttttatcaccattcacttatcactgcaatcattatggcttgaaaaaaacactggattctttttcttgccatttaaattgtttcccatctatccaaccatccgtttgttcatctattcaaccatccgtttattcatctattcaaccatccatttgttcatctattcatccatttgttcatctattcatccgtttgttcagactttttaaattctttgtgtcagggtatttgctttatgctcaggctgtgaagaattttaagatataggccctgctttccagaagctcacagtgtagggcggttcacgtggaaatttgctatggtggaaataccaacaaatgctatgggagcctggggactttcagctttcactgtgttctgagtgagatgtactttaaaaaaaatggttttaaaaaatttagacatggggattcactatgttgatcaggctggtcttgaattcctggcctcaagcagtcttcccatctcggactcccaaagtgctgggattacaggcgtgagacaccatgcccggctgagacgtacttttgagcaaacccaacaggcagttacctactgggatgaagtgagatgggaacatgccagagtaggtgtcactgctctagctgttcccacactagcagttaactgcttgctgcacatgaagttcattgctgaacatttttcgtaagttctcattgaaccctcacagttaccctgtgggtggcaacaaatactgtactgattttataggtgaggaaatggagaagtagagagattctaaagggacatagctgctgagtggttgagctggcaccacaagctagatttctcaggctccatgcacaggccatgctttgaatgggctttttctatactggctgctcattcacacccccctcttcatttttatgtcttgtacttttacataccttatatgctatttatgtcttttcattgttttttctttttctcagacctctcagagatgaatttatgtactttctaaacgttctttcttctgggagtggatacagagttttgtatcttgatatagtttggacagagttttggttaaacctgtgttgctggttattaaacacatttacattgaaagagccattgttaatcttagggttgaaatttgaggagtttgtaggatcatgcagtaaaggcagtatctttttccttaatcccccgggtagcatttagtttaggggctgctgtttccttccagggactctggtaaactgggtttgatgttgtggcaacaagaattactcagcctggcctttgatgattccctggagccagaacatgttttgtggttgggccactagaatttatgagaaatccaggtaaccaggtaaaggttaacgaatcttactgagcttgtctctcagccattttcaggggtcttttcatggcttctcttagcctttttgccctttatgactaaataaaaaggctgctgaaagaactcatttaacagtgagacaggagaacactagcagaataatgtttcttccagggagttacagagcagctcccagagtcttcctgcccgaagtcctgacttggaagctttgtctcctgctagaggaggggctggcttttttttttttttttttttttctgtagagatgggatctcactatgttgccctggctggtctcaaactcctgggctcagacgatcctcccacccccaaagtgctgggattacaggtttgagccaccgtgcacagcctaaggctggtttttgacagggcctcattggaatgtgagtactgtggtagggtcaccaaggatctcaagacaagaccctctagctttgcaggttcaaaaatagactttaggacttggatttgtgccactttattcatgctattgcaggatttaaaaaaaatcaagttgtgatcatttgcctgctctcagctcagctgtggactctggttcttggggagcacatccagggagccctggaaacaccactgtcttgtgctgtggcacctcttggtgtttgtcttctgggggaccatctgggggaccatcctgactaaaccttctgtttagtcaggacagcaaactgacaataaaatagagtcagatacagcttttgagggcttgccatttgttttgcttggcattgaaaccctcttggacttctgaatagcccacttcaggcttgtctcctctactccacactggcttttactgatttattgaagacggagacttcttcaacttgttctctaactttgacaaagacttctgcgatttctctgtgtccagactgcagtgacaaagcatggaggaaattaaattctaaaaagatttttagaattataattgaaatatttattttatgggtttatgatatcccaaaagaaatagggattccaacctagactttggggtctacctttagaaggagccccgttttctgggtgtgttccatggtccactgaggaaggcttctctttgagtctactgatgcctcagggagggcctcccggtgatcctgctcctgttccttgggacccatcagggatacccatgcccctctgctcatgcactcagcaaactccttgcggtgcttggtacacaccaggcacgctccccagctcgggcctttctccagctattcactgtgctagggatgcttttcctccaaataacctcatgctcagttcccgcactctctcgacaagacttcccctgtttgcttgagcagccagtgcccccctcctctctgcttgccacccttaccctgcttgactcccaataatgctcatcccccgggaacctactcattatgtttattacgcatggtcagtcttctccagctgaagtggaaactccacaaggcaggaatcttcatcccttttgttactctcccctatcccatgtgcatgccagaaacagggcctggcacattgtaggctctcagagcttgttgactgaatcattaaatccatgctcccccactccctctgcttttgatatagaaacaaaggtcactgaaattgctcatggaaacttgggagttgcagttaaaatagatccctcttacctcgtgcatacatctaatttcattcttccattattttggggtttatatataagcctggttcttgctgaaactgcttatgttgataaccagttagtgagttcctcactgttgacttgctgggaagtttatagagacattttttatgcattcagagatttcagtacaaatcttgaaaaagggacatttaggccgggcgcggtggctcacatctgtaaccctagcactctgggaggctgaggtgggtggatcatgaagtcaagagatagagaccatcctggcaaaaattagctgggcgtggtggggtgcgcccgtagtcccagctactcaggaggctgaggcaggagaattgcttgaacccaggaggcggaggtttcattgagccgagatagtgccactgcactccagcctggacaacagagcaagactgtgtcttaaaaaaaaaaaaaaaagacatttagatggaaatattattttatggtattagttgtgagcttataaaaagaagaaaatgattattctatgttttgttttttctttgagacagactctcgctctgtcacccaggctggagtgcagtgatgggatcttggctcactgcaacctctgcctcccgggttcaagcgattctcctgcctgagcctcccgagtagctgggactgcaggcgcacaccactgtgcctggctaatttttttatttttggtagagacagggtttggccatgttggccagactggtctcaaactcctgacctcaagtgatgtgcctatctcagccttccaaagtgttgggattacaggcgtgagccactgcgcctggcctattctatgtttgaaagatgagtgtagcaaataaattctttaagaggaggctagcatactttcccccttatccatggtttcaccttccatggtttcaattatctgcagttagctgtggtttgaaaatatgtgagtatagtacaaggaaatattttgagagactacattcacgtaactcttattacagcatattttatagaacaacttattgttctttattatttattataatgttctttattattagtttattattaatctctgcctactttataaattttatcataggtatgtatgtataggaacaaacatgttgtatatagggttcactactatttgtggtctaggcatccgtggggggtcttggaaagtatcccctgtggataaggagggactactctataacctacagtaaggtgatttgtggtgtgaatccactttattctaggaagtattaaggtgtttgacaaatgtgtatataaatgtgtgtatcttgagagggattaaaagtcttttttttttttttggcacggcctcggctcactgcaacctctgcctcctaggtttaagcgattctcctgcctcagcctcccaagtagctgggactacaggcatatgccaccactcctggctaattttgtatttttagtagagacagggttttaccacgttggccaggctggtctcgaacccctgacctcaggtgatccacatacctcttcctcccaaagtgctgggattacaggcgtgagccaccgtgcctggccaaaagtctttttttgagattaaaaacatccagaaagcagccggacggacatttccattgtattagtttcctgttgctgccataacaaattatcacaaatttagtggcttaagacaatatacattattatcttacagtttggaggccagaagtctggaatgggtctcactgggccaaaatgtatttcagcagggttgtgtttctttctggaggctctagggaaagatctacttccttacctttccagcttctaaaggctgcccacactccttggctcttagctccttcctgcatcttcaaagccagcagtggctgattgagtctcacctctcatcactctgacactgattgtcctgcctccctcttccatttggaagaatccgtgtgcccacttggatactctaggataatctccctcttctaaagttggctgattaggagatgtaattccatctgcaatcttaatccccttttgccatggaatttaacatgttcacaggttccagtgattaggacatgtatatctttgggaccattatcctgccgactacatctatacatctaccttagtgcctttgcccatggaatgtttcttgtgagaatgggcagtttaatccttcctgcatatcattttcttcttatggaagtgtgcctcatgggtattaagtattgcagtactttgtagactttgtctgacttcgtgaagcatttctagttttagaagagtgctcctaattcaaaggtaggggaaggcatgtgcaaaaaagccgccctttccactctatattctgctgatcagcaacactatttgtcatcaaattaccggaacagagactatcttgagtcagaaggttatgttgttgctctctgttcttaggaatgtttttgtactctgagagtaaagataatttttcctgttgtcaggtaatggaaatgtccctgaacaatggaccttgataggaaaaagaagtttattattctagaagatgttggcacaacattatttggtaattatttttccagaaatctgctgttttcccccatgtcacatgatggacacctcattgtatggaggaagcaggccagatgctgttactctttcaaacgtttatgttaaaggctcatttggtttaatttccactcagaatagatgttaaggatacaaaaccaaatgtctagctgactactactgttctttccctttcctgctcttgctttggactactgttttctcaaacgtataaatgtgtgtgtatagcattctaataagaggaatttaagctttaaaaagtttttaaaaataacactcttttttttttgtttttgagacggagtctcgctctgtcccccaggctggagtgcagtggcgtgatctcgtctcactgcaagctccgcctcccgggttcacgtcattctcctgcctcagcctcccgagtagctgggactacaggtgcccgccaccacgcccggctgattttttgtatttttagtagagacggggtttcaccgtgttagccaggctggtctggatctcctgatctcgtgatccgcccgcctcggcctcccaaagtgttgggattacaggcgtgagccaccgcgcctggcccctgcctcttgatttttaaagaggttttaataagctttgagtagtgtgagtgcttttagttccctgtattatcacgttcccaaggtcaattgattttaacacaaaaataggttacacatcaccccattccagcctagagcaggactagaaaaagcagttcctgtgagaattagttccccttggagatctgaaacttgaaatctgaaaacaagaacctcttgagttgggactcagaaggtggggaactgctgttgtgtaccagaatgtgtgcacaaggnnnnnnnnnnnnnnnnnnnnacttgtaaatctcgaggctgggcgcggtggctcacacctgtaatccagcactttgggaggccgaggtgggtggatcacaaggtcgggagttcgagaccagcctgaccaacatgttgaaactctgtctctacaaaaaatacaaaaattagccgggtgtggtggtgcatgcctgtagtcccagctactcaggaggctgaggcaggagaatcacttgaacccgggaggtgggtatcccatttatcaagaaaatatatagagactgtctctgacttatggttgactttacgatgggtttattgggaagtaaccccattgtaagttgaggagcatctgggatatattttgattttgagaagtgatgtcatcagacttacttgatacctgtaacttttagaaagataagtatatgatgctttttgtgtaaaattactttttcacttctatttaaaagtcttaagttctgttgtaatgcgatttttgattttctagtgtttagaaaagagggttttaagatagtagaatgttgttgctttcttttaaactatatatatacatatatatacatatatatgtatgtgtatatatatatacatatatatatacatatatatgtatgtatatatatatatacatatatatacatatatatgtatatatatatacatacatatatatacatatatatatgtatgtatatatatatacatatatatatgtatgtgtatatatatatatatacacatatatatatgtatgtgtgtgtatatatatatatatatatatatatatataaacctgctatttggatagaggccagaattaaaacatcagtagtcaaaagagggaattcagtgtttcttgagtttttagctttatatgtctaaatttgtaaaattcaaccatgtattttccgttccacatgggcaccttttgcaattgtggtagcagatgtcctaggcagatgaacatgcagaagtggtttgtttagccttcccttttaaagttcgtaatctagtaaatttgggttagaatggtggttcccatacttgactaacccgcagaatccctggaggaatctttcaaaaaagccatttattctggttccttactctagccataccaaacgtaccagggcagatccaggaatgagtgaatgaataaatacgtacatacatgcacatgcttgtacacacatgcacacaaatatacttctaatgcccctaaatttggggaccccaggtgtggaaactcacgcttcagaacctctaactgttctctccaaggtcacatcacacaggcaggctctggcttgagttggcctggccagagatgcttcccttcatttcccgtgttgagtgtataaaatgatttcacaagaatttgtgcgtccatgattgtaggaagggatggctgagtgttgaatgcatttcctcagctgtaactatctaatttatgtggttttgctttaagccattcagtattccgcttggagggttttgaacttacagaggtttttaagaagaggctcaacagatgaaagaagcaagaataaccaaccttggatttttgtttttactcctttattatagctaccaagtatatagctacctacccactttagcttccccatgtgtctttgtgtggttttctgttttgttccttttaagagataccgtctctttatgttgcagctgttgctaggcagccagtggccaggtgccagttttagagccctgatctgtacaacagtgaggaagcaacctaaaaagacccctttgcctaccccgttggatgaaagagaggcttggcgctgggatgtagactgctaggcgcatgagacctacgaagaactgaggctgcgtccacttacccagagtgtctttggagagtaccttttagtccttcctcggggcagttgccatatagtctgaaaatgaagccacctcaggcagtgggcttcgattggctacaattgtgcccttcttactttagcactttggcaaacattgagaaaattattattatggaaattttctttctgttttgagacaggatctcactctgttgaccaggctggagtgcagtggtgttgtcatagcccactgcaacctcgatctcctatgcttaagcaatcctcccacctcagcttcctgagtagctagggccacaagcacatgccataactccgtggatgccgaaagtagataacgagacctactggatcagaatgaggcagattagtacacatcgcacagcaaatagcaggaatatcagcatgaaagtgctggtgcccctgacctcaagtctcgtggggtgacatgatgggcccagatgatgtctatgcatgaattgggtttgcctacagctgaggaaccaaggaccaccaaggacttagcactttcctttctttttttctttcttttttgtttttttgagatggagtttcgagtttcactcttgttgcccaggctggaatacaatggtgcaatctcggcccactgcaacctcctccgcctcctgggttcaagcaattctcttgcctcagcctagcgagtagctgggattacaggcatgcaccaccatgcccggctaattttttatttttagtagagacggggtttctccatgtttgtcaggctggtctcgaactcctgacctcgggtgatctgcctgcctcggcctcccaaagtgctgggattacaggcgtgagccaccacaccgggcctgggcttagcactttttatagcaagtgatagacaggccaggcttcttctcctcaatgggggcatgtcatgctacagtctccttgaccaacttcatgtcgccagctacaagaagacagaccttgcagtttggcactctcagcaaggacatgcagggatgcttggggcctcggccaaaggcagcatgatatagatggagcatagtttaattaatcatcctgtcttgttatttagaagtttccactttgttcctgtaagaaagaatcctgtaacattcttgtggataaagttttgctcacatttccagtgattttcttaggctagattcctgtaagtggacttactgggttagggagtttaactttgtagtctcttgatatgtactgccaaatgggttttcagaaagtgtgaatcagtttacacctcataccagtatatgatgatacttgttaatttatccttcctgacattgaattactatttttttaaacttttttttgaatttttttttttgaggcagagtcttgctctgtcacccatgctggagtgcagtggtgcgatcttggctcactgcaacctccacctccctggttcaagcaattcccctgcctcagcctcccaagtagccatgcctggctaattttttttgtatttttagtagagaaggggtttcaccatgttggccggactggtcttaaactcctgacctcaggcagtctgcccgcctcagcctcccaaagtgctgagattcaggcatgagctactgcacccggctgaatatttttttaatcttttgggttgctgatataattaaaattttttcctgcctctctcagcattggcagaatgaactttgttctaagaacctcggctagtgtttacatgtattagaatgggaaaattatagcagcttctttcccaggtcgttttttattcatctattcaacagatacttattgaacacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggtggctcacgcctgtaatcccagcactttgggaggccaaggcaggtggatcacgaggtcaggagatcaaaaccatcctggctaacacagtgaaaccttgtctctactaaaagtatgaaaaaattagctgggtatggtggcgggcgtctgtagtcccatctactcaggaggctgaggcaggagaatggcgtgaacccaggaagcctgggcgacagagcgagactccatctcaaaaaaaaaaaaaaaaaagaaaaaaaagaaaaaaattcaaaccttgaaattccgccttgtgaataatcttagtctaatttttgccatgtttattggaatataggccagtggttgaactttgtgttcctaacctctcagcatccttgtgtctcctggtgattatgaaggcttttttttttttaaatgagatcttgctctgtcaccgaggctggagtgcagtggcatgatcatagctcactgcagccttgacttcctcggctcaagtgatcctctcaccccagtggtattttctaatagacatctgtgtccccaaaatgtgttaaagacttttgaagatgagtccactcaaataatgatttagttctgaatagacagatttttaaattcttttttgttttttagatggggtctcactgtgtcactcagttctctgaaggacttcaaatagcctcattagcaaactaggggtactaactgacattttcagcacctttaattggtgatgatgagcacattaatttccatttgtctatttgctgcagacttttcaggttccttctccttgttttaaaaaaattattgaggtataatttacatggaataaatggtatccatttaaagtgtacagtttggctgggcgcggtggctcatgcctgtaatcccagcacttcgagaggccgaggcgagtggatcacttgagatcaggtgttcaagaccagcctggccaacatggtgaaaccctgtctctactaaaaatacaaaaattagctgggtgtggtggtgggcgcctgtaatcccagctactagagtggccgtggcacaagaatcgcttgaacccagggtgtgacggttgcagtgagctgagatcacgctgctgcactccagcctaggtgacacagcaagactctgtctcaaaaaaaaaaaaaaataaaaataaataaataaataaatagtgtacaatttgatgggatatattcaacagttttgtacaccagtgaaaccactatcacaataaagcacaatattttcttgacctgaaaaagatgcttcatggccctttttgttttgtttttctttttttgttttgttttttttttgaggcagtgtcttgctctttctcccaggctggagtgtggtggcatgaacacagctcactgcaacctcaacctcttgggctcaagcagtccttccacctcagcctcccaagtagctgggactacaggcttgcaccaccatgcccagctaattgtttatttatgttgcccagactggtcttgagcttctgggcttaagcagtccccctgcctcagcctcccaaagtgctgccaccgagcctggccgccgcttcatgtccttttgctgtccattcctccctctaccccggccccaggcaaccactgatctggtttttgtgactacagatgagtttgtatttcctagaattttatgtaagtgaaatcatacaatgttacaatgtatattctgtgtctggctttctttcctttttttttttttttttttttaaataaacccactgccaacatcatacatgtctggcttttactcagaatgatgtgtttgaggctgggcgtggtggctcacgcctgtaatcccagcacttgggaggccgaggcgagcggatcacttgagatcaggagttcgagaccagcctggccaacatggctgtctctgctaaaaatacagaaagctactctggaggtggaggcaggagaattgcttgaacccgggaggcggaggctgcagtgagctgagattgcgctattgcactccagcctgggtgacagagctagactctgtctcaaaacaaataaataaataaataatattatgtttgagattcattgttgggggtatcagttgttccttttcattgctgagtaatgttccactgtatggctgcaccacgtttttggtctcttcacctgttgatgaacatatgagttgtttccagatttgggctattgtgtataaaactgctgggaacattcatgtatgagtcattatgtggatatgttttcacttctcttgtgttatacctacacatggaatggctggattgtgtgacagaccattttccccttaaaaatgttttattatatataaaatataatagaggttagttaggaatggaatgtacaaatgatatgtaactagtttcaaaataaggcttagaagagcttttatttaacataagtataatatgcaaagcagttaaagatttttataagtatgttattttgcataaatttaaaaatggatttaccttaaaaaagtgacataaaacttcagtcacaaactaaatgcaaaaatttattttatattcttgtactaaaaatcacaattttgggctgggcatgatggctcacacctgtaattgtagcattttttgaggttgaggtaggaggattgcttgagcccaggaatttgagaccagcctgggcaacatagtgacactctgtctctacaaataaaaaagaaaaaaattagtttggcacgttggtgcacacctgtggtcccagctacttgggaggctaaggtgggaggattgcttaaaccagggaggttgaggctgcagtgagccaagattgcaccactgcactccagcctgggcaacacagtgagaccctgtctcagaaaaaaaaaagaaaacaaaaaaccccacaattttctatttccttaaaattgagggaaagtcacgtaaaaactagaagtataaattcttatgggtgggcaaatctgcgtaagagggtttgtttttgaagcatggcagatcagagaagacagttgctcttggaaagttctgtcagcatcacacgcatgcctttcctttccgagtttatctagatgcgctgcttctcagtagccggtcgctttgtccacgacggtcctgacacacaatgtgacatagcttcacacaacggccactttgaccctccctccctactccacgtgtatctagaggagaggatcctagcatgccatcagccaggtgtttgcagtacgctggattgatgatgtcattaccactcagtggtgaatcattttaaaaaaggggtgaggtgggggacttcttatattttttaagggattattttaaaaatcattttagaacaattctgcaagggttttttggtgtttgaagtactagactagacaacatactttggaactaagattttaattaaaggttactctaaagaatcagtgattgatgtccccagatgagatagatggcaggagttaaaagtaattaaagtttgcagaagttggtgttttcataattggagtatggcaaatcacctatttagtccatttagtaccttattatacactgtcttctgtcctaactgttattactgctcagttaatgtttataatctactgttagattccctaagggcagtgcacaaaccccatgtaattagggatgtcagcagccctccgattctttgttgttatctttatttatttatttatttatttatttatttattaagtagagataaggtctgaccatgttgctcaggctggtctcaaacttctgggctcaagtgatcctcccgaaagtgttgagctaacaggcatgagccactgcctggccaagagcatgagtcttctggggaggtttggcacttgcctgtggcaccggccttgtgacttgtttttattttttctttcttttttccttataattaaattagagatagggtctcactatattgcccaggctggtctagaactcctggcctcaagcaattctcccacctcagcctcccaacgtgctaggattgaaggcatgagcaaccacgcccagcctgaccatttattgacagtctgttagctgtgctggggtggcatgagaggcttgcctctgattgtcctcatgttcctggtgactctggtgcccctctcccaccctgccctacactcactcatacatgtgccttaagactttgggaaaaggaagagtaaacctttgggggagatttggtaatcctgagtgtactttttcttgctttatgtgttcttgtgtgtcctgtttcccaagattatgaatgtcttggcaggactagtcttgaactaaacaacaacaaaattcatgcgttatagtactacctatggctttgtatttaattaggcattttaacattttcagtatcgtatttaatctgtataatcacattgtgatatgaggtgtgtgaccttacttatatttacatggttaagattataaactgaaatacgttgttgaagttctctctcttggccaggtgcagtggctcacgcctgtaatctcagcacattgggaggctgaggcgggtggatcatgagctcaggagtttgcggccagcctggccaataatgaaaccctgtctctactaaaaatacaaaaattagctgtgcgtggtggcgcgcacctgtagtctcagttactcgggaagctgaggcagaagaatcacttgaacccaggagacggaggttgtggtgagctgagatcacaccactacactccagcctgggtgacggagcaagactctgtctcaaaaaaaagaagttctctgtcctgtctgagatgatcggcagcattgtttatccctgtagccctggtactctttattgatagtagagattttactccaattaggtactttttaaaggtaatttctatgaaaatctctataaaaatgcttattaaaaaactcctttacagtggaaaagagtaataactaacatttccctttttcctcacaagctctaaacctactagaaatagaaaaagaaatctgaacatggagatcatatgatcagccttgtaactggcgaagagagggagatggaggagtccttatttcaaacatctaggaaatatgttgcaaattagtaaaataggttaaatttctccgtttctttcccagtaataggatctttgaactagactatttgaaattatcatttgaggccgggcgcggtggctcacgcctgttatcccagcactttgggaggccgtggcaggcagatcattcgaggtcagggtttcgaaaccagcctggccaacatggtgaaaccctgtctctactaaaaatacaaaacaattagccgggtttgcagtgagccgagatcatgccactgcactccagcctgggtgacacagtgagactccgtctcaaaacaaaacaaaaaacaaaaaagatgaaattatcatttgatataaccaatagcagagagatacctgtactctgattccttcttcgtttatgcagtcaatccttgttatttgtggattttgtattcatgaattttcctactcactaaagcttatttgtaacccgcaaatcagtccaaaggtagtcctttcgtggtcatttctggacattcacagagcagtgaaaaatgcagtttgctcagtgtacacatttccagccactgtgaaacaaggtgactgatttcttgtttcagccctcatactgtaaacaaatgacctttatgtggtctatttagcattacattttttttttttttgtatttttgtgcctttgctggtgacttgctctttaaaatagcccctaatcataatgctgaatttctgtctattgttcctaagtacaagaggccatgatgtgccttatggagaaaatatagtatgttagcgaagctttgctcaggaatgagttacagtgctgttggccatgagttcaatgttaatgaatcaacagttggctgggcatggtggctcacatctgtaatcccagcactgtgggaggctgaggcaggtggattgcttgagcccaggggtttgagaccagcctgggcaacacgacgaaaccctgtgtctactaaaaatagagcccatgtccccccgccatgcgcccatggttccagctattcaggtggctaaggtgggaggattgcttgagtctgggaggtagaggttgcagtgagccaggatgtcaccactggactccagcctgggtgacagagtgagaccctgtcttaaacaaaacaaaacacaacaatatatattaaataagccatctttaaacagaaacccatataaacaaggttatgtattgttcagttgacaaaagtgtgaccagaggtctgtaggaacctaacctgtatttcccctaggagcaacggtttagtcttttccaattcagtgttagcaatgactatttttgttttttttttttttgagatggagtctcgctctctcgcccagtctggagcgcagtggtgtgatctcggctcactgcaacctccacctcccgggttcaagcaatactccctgcctgtagctgtagctgggattacaggcgcccaccacctcacccatctaatttttgtatttttcatagagatggggtttcaccatgctggccaggctggtctcgaactctgacctcgtgatccacccgcctaggcctcccaaagtgctgggattacaggcatgagccactgtgcccggcaacagcaacaactttttaaacaataactactttgaatagcaagaatcagctatagcttagccctcttcctacccctaaacttcaggctgtgacatcccagtgccacatttgacatctcctgggggatacctacagggtctctcacagttggcatggccacagcagagcccctggtgctgtgtccctctttattcaccccacctgagaaatagcatatccgctcacataggtgttcccatcaaatgttttgaatgttttgatatcagccttccctttctcttgttctgcctatccagttcattagtagtatggtttattctacttccaaaacgcatcttgaagtaatctgtttttctgcatctctgctgctgatgtgctagtggaggccactgaattacttgcctggatgccacatgagcttcccgtagctgatgccactctgtgcacccatatctcatgttcccttccttctgggcacgtggagaagcatattctcaccccctggccattgatttgctatccttttcagacccagagggagcaggctaagaaatattttgtggaataagtatgtggtattattttaggagcacttggtatttctttgggtaatagtagtttctgcaatttgaggactgcttctaaacctgttaggaatattttttgaactgtaagggaattttttttttagggcagagaaacatctgaacaatgtattaagtaaaagcttggagaaaatcttgggaaaaaaacacttcaaaaatagattgttttagagttctttttttctgaaaccacctgccttctaaagcaagataattagattttaaacaatggtttctgcttagttaggtttttttttatttttttatttttatttgttattattatttttttgagacagggatctcaatttgtcacccaggctggaatataatggcatgatcatagcttactgcagccttgacctgtgggctcaagcaatcctcccacctcaatctcctgagtagctgggaccacaggcacacccaccaaacttggctaatttttaaatttttttttgtaggggggatggagtctcaatctgtcacccagactggggtgcaatggcacaatctctgctcactgcaacctctgactcctgggttcaagcaattctcctgtctcagcctcccgagtagctgggattacaggtgcctaccaccatgcctggctaatttttatatttttagtggagacggggtttcgccatgttgaccaggctggtcttgaactcctgaccacaggtgatctgcctgccttcgcctcccaaagtgctggctggtctcagacttttgggctcaagtgatcctcccaccttggcctcccaaagtgctgggattacaggtctgagccactatgcctggcctagtttgtttttaaatcaataacaggtatcaagaagtttggactggctgaccttggtggtcttactgctgccacctttgctctgcctcacacagtatgtgggtgtgttgggcccttctcgcaagctcctctgtcatgtgatggttccgtcttcagggctgtggcaggaccgcgctggttcagtttgctctgtgtcagctgagtaaaggatgggtggagtacaccaattttgtaacttgtaacatttggtcttgtggttttgcaaggaaggggtgatatataattagtaaggcaggagagcaaaggaaacaggaaggggatctgcagtgctcctgtatcaaagtagatctccaaagcaacaagggacaaaagcaagcacactcctcccgcccacccgtttttacttactcttatttgatcagagaactttgctttcataaacatccttgaattaaggctggaattttttggtaaaaattcctaactgaatttggtttagaagtatacagaaaacccaatgaattaattgaataatctcccttacccccttcttcagacaattctcctgtattctctcaagtaataaaagtactagaaagatcaattgtatttatcattaaatggctggtgcttataatttattccttgaatccagttaaacagtgagctttcctgataacctaggcattgttgtcccctacagtaacctgggcctgttggatgtgtaaacattttcctttgacccaggactgtgttgaaactatttgttaatcacacagcaggatgatcaatacttacaccagctgacgggacacctggcatgactactcagtgatccagtaaaaccacgccaagctggttccatagagttttcatttttgatgataggactcgtagctctcagaatcagagaatgtttagaggtgaaacttaccacaaatgtgggtcagcatctttagtttgtttccggtgtgtggggtgcagtggcggacagtgagagagccatgtgatgggaggaggctgcagagctggactttgaataatgggtagggttcagaaaagtagaaaatattgtgaaatttattttattttgtttttttgaatgaagcaacaaaaacagagatttattgaaaatgaaagtacactccacagtgtgagagtggacccgagcataggggctcaagggccaaaaatactgtgaaatttattttaatcaaagtggaacatagatatagttttaaagatcctatacaacacaaaattttacgtgcttatagcagcagttttcataagaaccccaaagtggaaacaaccagatgccatcagctcatgagtgggtaaagaagatgaagtctgtccctacaagggaagattctttagtcataaaaaggaatgaagttctgacacatgctgcaacatggctgaacatagaaaacattgtgccaggtgaaagaaaccagtcacacaaggccatgtattaggcaaatctgtagaggcagaaagtagattagtggttgtcaggggtttggggatgcgggaatgggggtgactcctatggggtatggggttttcttttggggatgatgaaaatgttctagaattagatagtggtggtggttgcataactttgtgaacatgctaaaatcactgaatagtattctctaaaaatgtcctgcctctcccagacagtgcctcctccccgcagatgttgacctctagatccttcaagattgggaccgcagtgcagtatttgagtctccccagatctcttcctaaataccagagaatgctgctgagagtgtgcattttcttaaaagtcactcccctcgttagtatacctgtgccactatcttcccacccctcccagggactttttctattcttactctacgagcctggcatactctgggccttcagagcctgatccttagcatgccatgtagttttttctttttttttttttttttttttttttggcgctgccattacctgtgtcctccaatgaactcttgtgttttgaagagggagatactttgttttcttgacctttgtaggtctagctcttggctaacatagtgcttggcacagttcaacagacatcatttagaatgaacacatggtaaagagtcaaatctttttttaataaatcagtgtacacttttattattattatttttgagacagagtctgactctgtcacgaagactggagtgcagtggggtgatgacagctcactgcagccttgacctcctgagcccagatggtcatcacctgcctcgccctctgaagtagctgagactacaggcacgcaccaccacagccagctaattttttagttttctgtagagacggagtctgtttatgttgtctaggctagtcttgaactcctgggctcaagtgatcctctcacctcggccttccaaagtgctgagattataggcacgagccatcacacctggcctttcaaattattactctgatgagtaaatcaatatgtgaagagcagctagaaaatgggagagtcggcattctaaaagtgttaggctctttcagatggaaagtaagagaatctcaggttaccatgtagtgatacttttaccctaggaagacagaggaagtaggaaactcggtcgccgcactgtcactgtgggtcttggagctcgggtctccttgtgggaaagtggcctttgtaataaaatcttgcaggtgttgcgtaatttcattagtctacatggtgaggaatagaggaggttcagagaagaatatacatgtattttgtatacctcagaattttagaaaagagaatcctgaatatttttttggaggagttgaggaagaagtaactgaggtttaaattttatctttgcagtgatgcctgttctgaccgtcttatttaaaacttaacaatacctgaccccaccccctgccacatacttctcttttccccatagcacccatcactttctagcatgttacttattatttattgtgtatatagttttttgcctatgtctgcctgtatagtagaagcctattatcactatccctcaaattagccagtgtgtgtggacaaagggcaaaccaatgttgatattaacaaagccctttcaggaaatcagtactggtgaatatacacataggaactggcacatgcgctgggtagaacatgaattgcctctcctctccctatatatgttcaaaaggtaatgaaatttttttttcttttttttgagacagagtctcgctctgttggcaggctggagtgcagtagcacaatgtcggctcactgcaacctctgcctcctggattgaagcaattctcttgcctcagcctcccgagtagctgggactacaagtgtgtgccaccatgcctggctaatttttgtattttcagtagagacggggtttcaccatgttggccaagatggtctagatctcttgaccttgtgatccacccgcctcggcctcccaaagcgccgggattacaggggtgagccactgcgcccagccaggtaatggaattttttggtgcaatttctatgtcaatcttttaacaatcttttcatgtagccagcagagggcagcacagatggaatttatgacattcagtatttttgactttattttaaagggcgtttaaaactactgtagcaaccacttctaggagtagtgtgaagtttatttcaatttcaggtttcttcttattctttctcgcttgtaaattgtgctgtttctgctttgtctttatggaggaggttatttctgtttaccttatcatcatgaatatgtcaaattaatactttccaaagtctttttgacatgtttccagatgcctccgagggctgtggtgaggttggcgatggtgggtcctgaaggggcactgttcttttgcctccagaaagtagcaattacttgaaccagagttcttcgaggtcttcccaatgctcccaggctccacggtgcacaggagactgcagtcctggctcaagggtcctctctgagcatctgaccaatgctcttgacccccttctcagaaagaaaaatccccaaaatgtacatactcaaaaccacacagtttttcagttttgtggcaagttatggaactggtcatggattttcttgatagaaactaaataagatcagtctttgtgatgcatacctctcttattttttttcttgcaagagttactggtccttaggcaaaaattgaagtaaatgcaaattgtgtacataaaacaaaggatatggtttaggttttctttttttttttttttttgacatctaatcggttttgagtttttcttttgataacaaaagtgctaaaaagtctgtgtcatgaaggtatgtactagcaaatgtgatcagaaatcccatagcttgctttgctaggtacaaggtaagcctatgtcaaggaatggcaagttctttgaattcttgttgacacattacatatatcctttgccatcaactcttttttcccccaaggtctaatagatgcatttatgtcaatacacaaaaatagtatacctctatgttttttaggtaaccaaagtagaaggaacctttgaaagaattgtgcagtgtgtccaggtgtctggatttctgcctgcagaggctggacaagtctttgttatgctccaccccaccttgcagatgttcttcgggactttggaggacacttgcgtgattgtatgccctaagctgtctcccatttggcagcttgttaggaaaggtctaagctgcagagagaggataccaggaagcaaaatgatttacccccaaattccagaaaggctgcagggtacccagcacctctgagaatggagataaggaaacgagggtggtttgaaagtgttcattgttggcagttaagatttccaggtctcctctccatctcctgcagcaaggcagtttctcttgcacttctggtaaacatgaaggtttaatttctgaagaaggctgtgaagatacagagagcgagtgaaaatctatatttattttaaaaaataccaaccaagaagcagcaccgaaaaagcccgtatatttaactgtgagattcccatcctttcttcctcagtgtagcccccacaaatactggtggtcagttttacactccacacagcccaggtaggggattggagaatacttctttgggtaactagtctaagcaaaaataagctaccgagccccacatgtggggtctctacacattactgccttatcatattacattgccacacatcaatctataggccatgcctaccacacggcttttaaccaggttattagtgtgtcactcttaaatgagaagaagtagactatgcttgctagagacttaaggaaaatcttcagtgttagcaagcaaaagagcaaatagtttaaggaaacaggtcatgggacatgtagaagaaagccttaaaaagtatatacttaagagtctcagatattaaatgaatgaaacaagaataggctgctatcaaaaaggactatgggttgagtatttcttatctgaaatgcttggaaccagacaagttctagatttcagtatttttttggattttggagtacctgcattgtacttgccagagcatccctaacctgaaaactggaaatccaaaatgctccagtgagcatttcctttgagtgtcatgttggcactcacaacgtttaggatttgggcatgtttcagggatttgagatttgggatttgtgttaggtagacagcttcagaggccatgacacgggagcgaagctggaaagtaagactgctggctggagaccagtgtggagtctggtgtactgtggacgagaacagagaaggaggggctggtgagtggacggagatgatgggagaattctctaccatcccaccgcccagagataatgattgttaatgtgtttagtatatattcttcctggcttatttcttttttcatttttatagtctatgcatttttgttacatgattttttcatttaacagtataacatagacatctttctgtctctacaaaaatagttacgcaacattttccaattactttttttaagtgccaaggaatacttttaagtaactcacaggacaaatgcccacactaaataaatacaacagaagctctgacaccaccacaccacagaagcgtagacattaaaatactacattatgtctgtctagttggcgtgtgttttaaatgataatccacactgtgcatttagctgtggctaggctagcactttattttttattttacttatttatttatttattgagatggagtcttgctctgtctcccaggctggagtgcagtggcaccatctcagctcactgcaacctctgcctcccaggttcaagtgattctcctgcctcagcctcccgagtagctgggattacaggtgcgcccaccaccacgcccagctaacgtttgtatttttagtagagacagggtttcaccatgtcggctaggctggcctcaaactcctgacttcaagtgatccacccaccttgtcctcccaaagtgctggaattacaggcgtgagccagcacacccggcctatttatttttgagacagggtctcactcttgcctaggctggagtgcaacagcacaatcatagctcactgtggcttcaaccttgcagattcaagcgatcttcctgtctcagcctcccaagtagctgggaccacagacatgtgccaccacgcccagctaatttttacattttttgtagagacagggtcccaccttctctcccaggctagtctcaaactcctgggctcagtcagtcctctcacctcagcctcctaaaggcctgggattataggcatgagccactggcccagcagggcagcatgttagaagacagctggtaaatgaaaacagttattttggaaatcagtttcatagcagtgtatagtgagccttaaagtagttcgtatcttttgaccagctcttaagcccacttagagaaatttagcctaaggaactagtaggagctgaggaggcaaaggttacaaggatgttgcagcattttacaggatataaggaaagaaaaagattaatgcccaacagtagaagtggttaagtaagttacaacatatacataatgcaaccattaaacataccagctccttcaattccattccaaccttagggttctttctagccttcccccttttcatgtttccaaattccttttcctgacagtgggaaacctggcccccaggatctggcttgagggttgcacccgacaccttccttttgcctccagctctacttcctgtccggctccatcctgctgtctgccggaggctgtcctggagggagtgtggttcctggttgggtttgaccaggagacgcaagggtgagagaagagtgaagtcaaggtgattctctcctgctggtaactgaggcttgctgaatcctctactgacactcttgccagagagctcccatttgccacttttagcagcagtatgatgccctcgcaccccgtcttgacttagcagtgatgggggctgcccctgttgctagtctggggggctttattactccttggtgtcctctctaaactctgccctcacttttataggtggtgcctatcttacctttctgcacactcccactctaggaatgtttctgtctctgggataatgattgatatgggtattatgctttcaaaaaacaaaccttccctagaatattatataaatattcacgtttttttttctactgtcatttatttaatttttttgtagaaataggatcttgctttgttgcccaggttggtcttgaactcctggcttcaagcagtcctcccaccttggcctcccaaagtgctgggattacagacatgaaccacaactcccagcctagttttgaaacattttagaccattacatgcttgtgtattcccacctaatctattgctggagggggtgaggctaaaatctatttaagggatttattaattaaaaatataaaatgtcttgaatcaacaacacttgcatcaaaatggcctaatgtgtgctttttaatgtgaatgacgaacgagtgttttcttctactttgttgatttattgcttttcatagggcctgtgctagctcctgtatgtttccgatatcatttgttcagacactgctctgaggccctagattattgttctggttttgtaatgtgccattatttttttagttattttaaagtgtactttgaaactttttaaaagcttccatttaaataaatacgtagtaatctaacactctgtttgggattgatgttatagatatgcctcatgagttgggttattatatgttttagtttcccagagacaatcccagtttatgctgactgcctgatgtaattattaatagtacccatttgcaatctcaaaaatatctcaatatggatgataaattatatggtcacttatgagtgagtgaaacatacaatttggtgatgcagtggttaaatgtctattttaaggaattggagacatgagattcattatttccttttttaacaaacagtggtaattgttgtactagagatgacagtgtggtgttgagccaggtatgccttgccatgcttccagctttaagggacgctgcctggccaggagcctatgaggtggcctgctgtgcccaatagggatgatggctattaaacgagccagtcagagtccctcttttgagaatgtgaactggaagtataacaagaatgaggcattgaatagtgggagcagaagctcaaagtcaaaaggtctggaggagcaggggacctgtgaggccatgggtgggtggaaggaatgatggggcctttaaggcagaggctgtggggagtggagatgggggacctggttggcagcatatcagaagatagcagctccaggcctggtgcaatggctcacgcctgtaatctcagcactttgggaggccaaggtgggtggatcatttgaggttaggagttcgagaccagcctggccaacatggtgaaaccccgcctctactaaaaatacaaaaattagctcagcatggtggcaggcacctgtaatcccagccactcgggaggctgaggcaggagaattgcttgaacccagtaggcagaggttgcagtgagccgagatcgcgccactgcgcttcagcctgggcaacagagcgagactcagtctcagaaaaaaaaaagaaaagaagatagcagctccattctttcacttgccaggccagaaagctcggagtcacccttgacttctctcttttacacctcacgtggactccattgggacatccttggctgtaccctgaaagtaaatatagcaagaatatggccacttttatcaagtaagccgccaacccgtctcacctggatgactatagcagccccccaactggtctccagctcctgtgctggctgtctccagtctgttcttccccacagccagagtggtcttgttacaaaggaagccacaaaatgctctgttgctcagaaccctggcagcagctatgcatctcacccagaatggaaaccagagtccttaaaatagctgccaaggccccatgcagttcgcctaccaccctcctcacctctgcgaccatatcttccactcctccctacactgttcttcctgctccagccacagtagcctcctggcccttctcagcagaggccttccctgactgcacttccacttcccccactccacagtacttattttctgacatactgcatattttacttacttgtttccccacctttcccatctcgttagagtggagacgccacgagggcaggcattttgtctctttagtcctctgatgtctcactagtggctggcacttaatgtgctcagtgaatgttgaacgaaacagataagacaaaagatacaactatctttgtaaaaactttttaaaaacaagtgactggttatgacaaaatatttgtaacatttcatacaaaggatttgtaatctacaaatcatttaaaaaatgataagcaatagaaaggtgggcaaaggctttgaaaaagcaattcatgaaagaggaaatacctcaaacttacgaaaagataatcagcatcatcagtaatcaggtcagtgcaaatgaccaacaacaacgagaaaccgtttcccactgtctgactggcagaagttaagtttggtcccatcagggacgtggcaagcactttggcagcatctgtgaaagctttaagtactcaggcctcatgaccagcttttctgcctttgggtgtctattccagagaaacgctataccatttgacagtagggagaaaatagaagtgacctgccctcttacaagttgggatcactggctgtgaatcagacctgataccagaagatagaaatgctgtttgggaatcattaaacataggttttgaaatggtgcaggctgggacttacaactgtgattttgacatactaaaccaaaaggtgacacgttgggtttatattaattgcctctacaaaacaaagtgttttttttttttaaatatatgcatatgtatttattcaactgttattaggcaagaaagaagagaatgtgatgaagtctttgccctggagtcatgtcagcaccttcagagtctgactggagacagcgccccgttgtcttgctgtagatgtgtgtgttcccagctccccagtgagacttggccaaagtctagcacttcctgcaaagctgctgcaggtgtttgcatttacaatgaagactaataggagaggggtttgggagtccagcagagagcagggtgcggaggatgggctctgcagccaggtctcgtgctttggcaagccatgcaacgtctctgggtgctagcatcctcatctgtgatctggggatggcgaggacactcaccccatgggatgttttcaggattagatgagttaggtcacatcaagctaggcacagagtaagcatgcaataaatgttatctattacgatgatgaggtgggaagctatgtctggatccagcagttctacttgtgagaatttttttctatggagataattaaagagatgtgccgaaacgtgtgcacacgtgtattgagatacgtagaagaattggaaatcacttagaagtcttacaatatgggactggttaaatattatgtctagactgagaagaataataaatgtgatagatgtccatttacagtcatgaaaaaatgttataagtaaaaataagtagctataaaacgacatataaaatatcgtgtgtgtgtgtgtgtgtgtgtgtgtgtatctatagaagagagagagaatatatataatacttataacaaaagtctggaaaatgtctaccaaaatgtcaccaatggctatctcttggtgataggattaaggtgttttttttccttgttactattttctaatcttcaacaatgaatatgtgtcatgaacatgataggactgtgcaggcaagaatctttgggtgcagcatattagaaatcataatggagatgaaactgaacttagattgggagtttggcccttggattttttttttttttttgcctctaatatctgctttctgcttttagcctgtgacctcataacatgctgtaatgattacgatctcttagtcatgctcttgggaaatgggctattatctcattgtgaggggaccagggattttaatgattccattttaagaaaatgtagtcggctttccatgggctccccatccatggatttaacctattgtggatggaaaatatttggaaaataaaaaaaggtcacacctgtactgaatacatacagacttttttcttttcattttctttaaacaatatagcataacagctgtttacatagcagttacattgtatttggtattagaagtaatctagagatgatttaaagtatatgagtggatttgtgtagcttatgtgcaaataattaaggactcaagcatccgtgggttttggtgtccatcggagttcctggcaccagtcccccttggataccaagggacaactgtacttgaaagtgaagagaaaaacagcagtgagtcctggctatgactttggttgagtttgagaaaagactagaagtgtggctactaaactagtttgactccagtgtaagattgctttcagggaagcagatggttaacacactcggaaggtgcttgagctcgacttcaggaactgggtggtggcactgactgggagtgccgcttctttggaggctggaggttgattggcccaggcgtgcagccagccattgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacggtgagtcaaagccgcagcccccggccgggactgatgcggcttggggtatatggagtggagttttaggtatctcttttcattagtatgtgaaatcctgtgaggatagtttactgagccttttggggaggagttaaggaccaacctagactctggtttttatcttactgttttcaggagaaagactgcatagtctcttagtggttaggaagctgaggctctctcgggtgtgtgtgtgtgtatgtgtgtgtgtgtcagagagtgagagagaggagagagagagaaagagcgagaagagagagagatattaaggtaactcagtgtttttaaaccaaagaagttctcctccaatctttgctttcgttagagttccgccttgggtgtttcttggtagattccacttcatacttggtgattgtgtctacttcctgtatcaaaataacagttggtcagaacttctgggaattccacaaatatccagaaagaatctgatactaaaaagtaaagacattagagatcggattgaaagaaccagtgagatttgggataaatagtacttgttttgttaaataaaatgtgtctaagggaaaagacgatgtggtcttctccctttggttgttaggtgaggactgtttgaagcctgggagggcagggtctgtagaacttcctttatctgctccacacctgtactgtaaacagtggagctatgagtaatgggatgacaagctgtgccttctaaatcccaagagattctgctgaagagctgtgtcttaaagccctgggtcaacacaggagttgtgtttgtggatgtgtgtgtgttttattgtattttattgtggcaccttatcagatggtggtgttgtaatgctgcaagacaaaatagtaaaatgcgtactgggttgtagctggtaatgtgtgatatttttaagtttggaataaatatctggctatgtttcaagtggattttgtgaaagttgtaataaaacttgggtgtcctctttaggcttttcccactctggttcactataaagcacatttgaaagccccacctctaagtgcaaatgatcctggacagtgtccacgggcgacactgaaagctgcagcacgcgtgggggacgctgggagggaagcatgcacaggtgtccataacgatacttctgtatctgaagaggggtcagtagtgaggggacgtgccaggccagggctgaactgcctgcttggtgcttttctaactgaaaggtgagtccacactagccaagatctagttccaaagggaacacttttgagagtggaagaggacactagtgactatgctgggacagcaggagtgagccgggcctggccatggtccctcacgcttacttgcttctggtccttccgggtgagcctagcttcagacccaccggaggtgctgtgtaatagtcactttttatcctggaggcttcaaaagtcaacataaactaccctaatcaacagtgggagtgatgggggtggggcatgaggttaggggccgggagcttagaggtagaattactgaacagctttgctttgaccaagtaaccttaaagaactggtgcttcttcgcttcccttaccccctcccatggtatttccttgtgttgtcacctgggactgaaggcagtgttgccctttaaaccactgctaaaatagatgcccttagacattgccgtgagagacagagtggcatttaggtaggtgtaaaaggagggggacaaatggagtttcctctggcaggtccctgagatcccaggggagggcagaagttaagagtcagttatgctttccatagagctgcttttaactagacttacgccctaaagaacacgcctaagaaagggtatgtgggggtttttgaaaatattctttaaggaagtcagactcttctgctgcattaatctcaaacccacaatttttaggttaaaaatattgctttctggctgggcgcgatggctcacactgataatcccagcactttgggaggcccaggcaggcggatcacctgaggtcaggagttccagaccaacctagccaacatggtgaaaccctgtctctactaaaaatacaaaaattagccgggtgtggtggcaggagcccgtaatcccagctacttggaggctgaggcaggagaatagcttgaacccaggaggctgaggttgcgttgagccgaaatcgtaccactgcactccagcctgggtgacagagtgagactttgtctctaaaaaaaaaaaaaaaaaaaaaaaaagcttttttttacctggtacattggtacattggtacatacattcgtcagttttcattctgtatatgtgtgttagtgagaattaaccagtttaattaattgggcactattttcttaactgccataagttattattatttttagctatttaatcttgttaatgtcagtcccccttgatttgcctttttttttttgagacagagtctcgctctgttgccgaggctggagtgcaatcttggctcactgcaacctctgcctcctgggttcaagcgattctcctgcctcagcctcctgagtagctgggactgcaggtgcatgccaccacacccggctaatttttgtattttttgcagagacgaggtttcaccatgttggccaggcttgtgttgaactcctgacctcatgtgatccacccaccttggcctcccaaagtgctgggattacaggcgtgaaccactgtgcccggccttgatttgcctttgaactctctctttggcatctctttgggatagattccaaaatctttggtgtgggacctgaggcccttcacaggcagacactaagcccccttcagggtgccagttcagccctgctgtgtcctgggccttgccctgtggtgtgcccattgttgctggcctctgtcacttccatacactttatcttgcttggtatacaccattctgttcttgtccatctggggaatccgttggtccttcaagttctggctcacaggttggcccctctgaagcctcttggcatcgcctggaattctgtgagtacttgctgcacttggccgctgtggccgggtgtgctgctgctacgggcttacatgcctgtccccactggccttcactttctgtgcaggccagggactggagctgtttaaatcccagctccaagcacaggctgcgcctatggcagatgctcagtaaacgctgagctgaagtgaatctgtgtatttcagtaagagaaaaaaaaaagagctgaggatgcagccggtgaccggaatgtgaattgggctctattggtagtgtacccgaggtagattatttgtactcattgagtctttatcttacctgtaaactgatgagaacagtgtatagttcattgtcaggaaatatgcagagttacagttgagctttgttggaaaatttaaaaaagtggaaatgagaaaacattttaagctgtaagatagcatgtgtgtataaactagtattatttgtaggaaaatatgccaaatagaatgaagtataggcttcctcagtgggacactggattttcagattgcttctaaaatgctgtccttgacgtgaactttccatgttatcctttttttttttttttttttttttttttttgagatggagtctcactctgttgccaggctgggcgtgatcttggctcactgcaacttctgcctcccgggttcaagtgattctcctgcctcaggctcccgagtagctgggactacaggaacgtaccaccacgcccggctaatttttgtatttttagtagagacagggtttcaccatgttggccaggatggcctctatctcttgacctcgtgatctacctgtcttggcctcccacagtgctgggattacaggcgggagccaccgcgcccggtggttatcccatgttttaatgcgtgccatgtgattgtggtagtctctagttggacaagttgctcaggttgtggtgtttgcaggaagacctgaggtgctgtaactatcaattcatatccccctagatatttctcactcccttccttatggattttgtattttgcagaatcagaaatggttacatctttatttttaagcaggagcatgtttggcattgtacaaagcacacatcatagcaagaaacctgtatcaccatctgctgtgacaagttttgaagaggattcactctggtttgaattttataggctttcctgttgagtacaccagagatgaatgctcacggtattacacagaggattagaactgccctttcttcttaatgaaggtgaatagaaacaagggcttggattctgcccctctgaagaaagctgacccttatccattatctgagtctttgtgtagcctcccaagttttctcttcattatggaatatgaaagcacaggactggctgtgggggatcaagacccaaagtctgattagacaggagggatgtggaaggcaacaggtggaattttctaagatgtcagtatcggtggagagaaaaggcaggtatcttaggtcttggtaggcacaggtctgggcattaagagcctttatcagcctgcagcgtggtcagccgaagggaggacaaagtcagggactgtagatgcagataggaggtagagttggagcaggagtggccctaggaaacagcagagattcccgttttcatccacccctccctgtgcttcaggagggttcgcaggaacctgtgtgtggctgcaggctgacagaacctgcatgcagtttactgctggttaaatcagagatgctgggctagacctcctggaaatttttagtagtatccatctctcatttttcccttggattttgataatcctgcaaaggcaactttactggatttatagtgttcttgtctctgcctttctttctgttttcagcctagctgagatttcctttttatttgtttttttttgtttttttttttttttttgagacggagtctcgctgtcgcccaggctggagtgcagtggcactatctcagctcactgcaagcttcgcctcccgggttcacgccattctcctgcctcagcctcccaagtagctgggactacaggcgcccgccaccactcccggctattttttgtatttttagtagagacggggtttcaccgtgttagctaggatggtctcgatctcctgacctcgtgatctgcccacctcggcctcccaaagtgctgggattacaggcgtgaaccaccgcgcccgacgagatttcctttttagaaaaggactcttaaaactgccaccatcttctcctgtttaccttcagaagaactttaacttgtggggaattcatatgggttttgtgttacggctggagccattaagtaattacctgggacagagtcactaacagtagtgtaatcacagactcttaaagccatgaggtgccttagaagttatctagtctagccctggtcagttctgcaaatgaaagccattgctgtggctcctgggaaggactctgaaaactgagtccaaatcagccaggattttaagtttcaacagccactgttgagttatgctgatctcctgccttcatatattccaagttacctttttgtttttctcctgactatgtgatgcgttgattctgtagccctaggtaatacactaggggaaaaatggagacagaaaagtcaaattctgctttcctgtagatcagctggtgtgtgaggactttccctagcacattcacttcttccttaagaagataatttcggcccgagcgcggcaattgcaaatggttaacctcttatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgggcggacagagcgagactccatctcaaaaacaaaaaaataataataataatttcgtaacttgtatcatgttcttccttcctctacagaggaatcatggaagctcaatttctgacctaaaaaaagatgcagtgaatttctttttttgagtcagtgactgttgttttttttttgagacggagtctcgctgtcgcccaggctggagtgcagtggcgtgatctcggctcactgcaagctctgcttcccgagttcacaccattctcctgcctcagcttccagaatagctgggactacaggcacccgccaccatgcccggctaattttttttttttttttttttgtatttttagtagagatggggtttcaccgtgttagccaggatggtgttgatctcctgacctcgtgatccgcccatctcagcctcccaaagtgctgggattaaaggcgtgagacaccgcgcccggcctagtcagtgactattgacgcctttccttctggtgtctaaagtctctttccctttgtgttttctgtgaagaattgggattctgagtcacagaattcagacgagagaccacatacgaaatcacagcagaatgggtgtagttacaacaggcacttcatgggcattaaaacagaatccaaggatgtttcttctataatagaaatattgggccagtctgagcaaatataagtggctgggggcatttctgtattttctttgaataaaaacttcaacatcaaattttgtgttagttgtggatccagatatacagataggcagaagaggaagagtccaggcctcccccactctctttccacagtccttgctttgaaaggtgattcctgctagcagtttcaagtgtgtccttctcagaagctccctgtgtgtttagcaagcgtaggtgttacttgtgagaaggtattctgtgccatcctgtttcaccagatgtgtcttagagatcttttcatgttagcatttacaaatcacctcattcttttaaattaccaagtagtttttaggtagtttaaaatttttggaatttggggagcatatccactcttaagtggaatttaagaatcaaattcataagtttgattcaaatcaaatcaaaaggtgtgtgctctttatgttttgctagtgccaaaaggttgtaccagtttacactctcccagcagcacgggagactgcctgtgtagcccactcccctgacagtatttcgtctcatctggcattctgattcctgccagactaatggaaaatggtatgttattcatgttttaatttgcattaaacacatagtgactgtgagcatcttcttctgtgtgaccatttgtatttctctttttgtaatctgtcttttatatcctttgctcattgtattcatctttgctttactaatttttatgctgctttctttgtgacttaaataaattaaccctagccaggtgtggcacatacttatagtcccagctattctggaggctgaggtgggagtatcgcttgaggccaggagtttgaggctgcagtgagctatgatcacaccactgcactccagcctgggtacagagtgagaccctctctctaaaaataataagttaattaatttaaaaaaagatattaaccctttgtcatatgttttgtgaatttattgtcctagttgtttaccttttagcttatgggatattatttttcactcagaagcttttcattttcatgtcgcaaatgagcagactcaccaatattatgactatactaattcatgctctattctagaattattcaggttttattttacattaacatctttgattaagctagaattcatttcagcttagttttatcccaaatggctagctggctatttatttgctcagcacccttgactgaataatcctatttttctttaccgattcaaagtgctacgtgtgtgtttcagtatttcttgagtttgttttctggtctttttcttccgttgcagtttcaattaccaaagcctcacgtgctttaatctcaggtagctacaccctcacgttaccctttctccctttcatatttttctgactattgtcatatatattttttcccatgtgaagtttaatatcctttttattatatttctgtaaacatcatgttggtaatgtaaataatttttttttttttgagatggagtttcgctctcattacccaggctggagtgcaatggcgtggtcttggctcactgcaacctctgcctccctggttcaagtgattctcttgtaataccagcctcccaagtagcagggattacaggcatgtgccaccacacctggctaattttgtatttttagtagagatggggtttcaccatgttggtcaggctggtctcaaactcctgacctcaagtgatccacccacctcggcccccaaaagtgctggaattacaggagtgagccactgcacccggcgtaaataatgtttttaaacatcgtggtgtatgtacgagaactttgattactggggtctttctacctttgctcaggtcccctttgttttccatgtttctttttcctgtctagatgagaggctggccctgctgcaggaaccagcctggcttggggaggatttaccagtgtttggggtagaatagagtttgtccagagaaactgactatatcgtgccacctagaggtgggcatccatttgtcgtggagggaggccataggacacctgcatgatatcagggactcactgccctctcatgggtcagcacctcttcagctagttctggagtgggtgtgctgccctggatctcaaaggtgcagagcttggcctgccttctgctcctcctcactgctctccttggctgcccctgccataggtctcgtctttcttcctcctacagttctgccccctgcatgggcaggagataggggacggtccaagagcagcctcatgagagcagccaagacagagaagaagaagcctgccctcctaacacactgagttggcaccagaaggatgcactcgccaggaggcttgggtcggccgtgcctgctccagccttgccctgctggtaggtggaggcagggggccagtatcctggaccttcccgcgacttggaaggctggtgccctagtcagctccttcttacacctctcccaaacttttgcaaacccggactcggggcaactctggtaagggtgatgtctggaacagggagccagtttgtttctattttgaggtgcaggtagaaatgaccttcctttcaagagatcttcaaggacttctcagagcaggaacagatgccagtttttgcttctttgaagaagattttatgctcctagcatttactaaagaataatgaggcatttttaagtgtaaggagtggaatagaatttaaagaaaaaagtaaaaaaaaccccaggcctctgttttcatgggacacagaaggaggggagattgagaatgctgactcgcctaaaagctttatgcttatcatgtctgtggtgcttggagcctgtggcccaggtgatttggggtttggggacgcctcatgggcagagaggacctttgagcagcattgtgaattcgtgggtttgggatgctgatgaaactgcgagatttgaatgtattccttgtgcctcattttccgctttagaaataaaatgattgatgcacattgcccttgcacgcttgtcagagggtcactttctggttgcacctgtccttgagcctgagagagagaactggaaagaggatgggaagtcagtagtggtttggggaattagtgctggataaggatggtagttgaaggtgtgagttggagtagggcaaaaaaccacttatttctttgctaccgcttctgaacaggagtgcagaccgcggtgcagtgaagactacgcaaagcttccagtcccttttctttctcatggcgcctggctgccgcttcttgctcttccagaagagcttctttatctctcgcccaactcaacagcagaatagaatccacctgtctcggtgtcaaattcaaaggcaccacagtctgcctggagcttgctcttccagactctgtcccttgtgttgccctttccacctctgcctggactgccctctcccaggctctcgcgtggaaccgtcttggactaacctgggccctgctcttctctgagccccactccgcatagcaccttgcagacagcatttatttggcatttacgggctgcctgtttcttttttctttaaaaggaatagtaacacatgagctcttggagggccgaaaccatgtcttttcagcattgtgtcttccacagtaactgacagggggcctcttccacagtaactgacagggggcctcgtttccatgcagtgaactttttaaaagattgttgaggccgggcgcggtggctcacgcctgtaatcctagcactttgggaggctgaggcgggcagatcacaaggtcaggagatcgagaccatcctggctaatggtgaaaacctgtctctactaaaaatacaaaaaaattagccaggcgtggtggcgggtgcctgtagtcccagctgctagggtggctgaggcaggagaatggcgtgaacctgggagacagagcttgcagtgagccgagatcgcgccactgcactccagcctgggtgacagagcaagacaccgtctcaaaaaaaaaaaaaaaaaaagactgttgaattatgagtctgagaaattattttttaaaacgttcatgttttctgttggtcctgagattcctattctgtggccagtcgtttcctgtgattctctctgatggatgtggtttcataagcttgattgtgtggtatatattgtggcatctgttttgttcagatatgaggagggccacactgcagacttcttggttgcagcttttcttgtaacttctttgtccactgacatccttttctcatgttgtctgtgcctagaattaactgaaagtgcaggtttttgccacctgcagtctctggcctgggtcaagctaaagcctttgcctaggttcacacaccacaggtaaaccccggctgtgatccactctgtcggcgtagtggaagctggccatgttaaagagagagtcatagtgagccttgcacatgatgactgagtcttctgtagagagtcacgggtcagaactcacctgctgggctctttcaatccctgaagagagtgtgtatgtgtatatgtgtatttgtgtaaaaaccagtgatgtcacctcaaaataagacagcccttaggactatgaaaagtgctatgagaatatttacagtacaagatattactgaaaagcaagagcttaatctcacatgaaatccctgggaaacatggtggtagataaccagcgtggatagtccaggctgtcttcactgagtttgtttgtatcacgtaatttatcacctggttatttaccaagtgataaagaaggtcatcaggtgatggttaatatgggtaaactgagcagggagcatggctggaggaatctgagttctccctgtaggaggtaagactcgacggatggcggatggtgaggatgagcttctgaacaagaagaaagaagcaaagagatgtaactgagtactctggtggatcccgggaaagtggaatcttccttggactgggaggagaggtgggatggcttactagacagtgagaaggaggaagacaggggcccagggacgtgttgcactgggactctcaatatacattttgtagaatgtagaattttagaatttgtttttcatggacttagtatgattcttttaaataagtactactctcttgacactaaaagaaaattgttcacactatggctgtttcttgaaagacaagatacaacgcagagccagggtatttgggtcaggcctggtggcactgcctggtgatgaggacgtctgtttgcattccccagccagcccaacccccatggcatggcagtggaggcagggcttgcagaggggcgggtgccttccatgactgatttcctaacggcaggagactggaaaggagggagggtatgggagtgtttttaggatttccaccccctcttccattgtttatctagagcaatggttcttaaccaggacagttttgtcccgcaggggacattcagcaatgcctggagacatttttggttgtcaaacctggttgtggggaattgggatggggatgctgctggcacctagtgggtagaggccagggacgcagctaagcaccctgcaaggcacagggaagcccccaccacaaagagtgacctgctccctgtgccagtaatgcccagactgaagaaccctgctctagcacggtgatttcccttttactttctctccttggttattttagaattgtttaaaaaatatctcctcccttcttagtcaaaagctgtgtgtggtctgcagtaaccctgtattctgtgtcacttaggggcctgggtctctggagttcatgcttttgggactggggtcccaaatctgcgtgtttaacaggcgcccttggtgattctcgtgccctctgaggtttgagagctgctatcctcaggctgtagccatatttcttgtcaccagccatcttgtattatcatccccaaggttcgcttgcctaacattccaacctgataataggcaggtgtcctcaaaggcgatgccacagcctctggtgaagaaataaccattggtggctgcgagtgtactgagtaggaggcgagtccttcttggtgaaaaggctggagtgtccctcgtggaagtggagggcatgggatccctggaggaagggagcaaaggatactcctcctgaagcccctccaggacggtgttggagcagtctggtcagtgccactttgcctgctgacctgatgcggggcagtggaaaggactaggcttgtgcctttggggtgacagaacatccaccccctagatccagtctcttgtttatccatgcagaaaggagagggcatctggagtaaggttggcattcttgcagtgaaagcaggcattaggcttttgcttctgagggagagaggaaagcaagtgcagcctgtgcgcaaatgctggtggtgcctcccctcccccccgggaggccgggaatgggggatagtaggaggggctggctgtgactgcattcatggaaatgagcctggaggagcggagcagcacacactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctgtccttgctccggctctccctgcacctacagctgtgggagctcccggcagcctggtactgtggggtcgctgcacggagccaccatggcctctgacgtggagagctgtgacctgccgaggctttgatgttgctgcccagggctggccaggacactggggccgcaggagaggggactcaccgtgggtaagaggctggtggatggcgtgtggagccctgtcagcagatttcccattatgcgttgctgcctgcctgcctctcccacccagcagccagcagtaggagctgatgtgtgcgtggctgtctctctgcatgtctgtcctttgggtctgcattctatgctctcctctgaaggtttttccactacacttttggataggtatccaggcattcagtgtcgtttcttctaagcctgagacttaggaacatgccagtagtcaatttccttggtccagcttccgtgaggtttgaaataggggggcagaaaacagcgggacagattcagggtgatctcccctctaggcctgccacccgtggagtttctgttttactcggtaaggacttgggaacctttcctgggcacgagtagtcctctttccatcaatacacatagaaaaggagttggaattgtacgtcgcatttaatgctaggggtcctttccagctgtcagactgagggagaatatttcaatgtacagaaaaattcagagcattacaaagggctagcaaacaaacagatctgagccactgagggtaaagtgagagagaattgacttccaagccaccaagcctctcttttggacacggaaggggtgtcgtggcccagctgtgcaagctgacagtggttgcagctggcaggcacggggagtggcagcttcacccaggggacaggagcctgcccccttgggaggaggggcgagcaagctgttttggcttgtttggaggaagagggaactccaggctttccctgggagtgaaggagcaggccacttggctcaaggaggctagggctagaaaatggttcttccctgtggagctctgcgcccagtccctgggatcctttcgaaacagcagtggagtgctagaaagaagctgctgggaaaccccagctatgtcagctatatcaggtgttgtcactgtgagcttttagaaaaagttaaggttcttaaaatggttgttttctagtttttagcttttattgaaagcggatgttaactttatttttctaaaccaaattcgcaggataaaattttgtcacttaggttctgttactaccttgaaatgcaagctaagtctttgagttctaggatttattaaattaaattttttgataccttacttttttgttttgtgagatggagttttgctcttgttgcccaggctggagtgcaatggcgcgatctcggctcgctgcaccctccgcctcccaggttcaagcgattctcctgcctcagcctcccaagtagctgggattacagatacctgctatcatgcctggctaattttgtatatttttggtagagatggggtttttcaccgtgttggtcaggctggtctcgaactccttacctcaagtgatccacgagcctcggccttccaaagtgctgggattacaggcgtgagccactgcgcccagccaataccttccttttataagatagttgagaagggctgggtgacatcctcattacataagtgaggaaactgaggctggaagaggtgattgtttgctccaggtcacaaagtagtgagtgaaagcccaggcagcatcgcctgtgaacgtgaggagctgtcagatgagacggctccaacactgagaagaggaccgaagtcttccctgaaaatgcagaatgcagtaataaaagcctttaatagatttactgttagtggggaaactgggtagtttttgcatggaagaaatttaaattagaatagtctaaatattcatattggcaatttgccggaaggcacctctgcctctatgttgaataccatttctgctagctgcctgctaatttaactctttttggtcctgggtagtgtgtgtaaatttttttatttttattttttgagacggagtcttgctctgtcgcccgagctggagtgcaatggcccgatctcggctcactgcaacctctgtctcccaaattcaagcgattttcttgccccagcctcccaagtagctgggactacagctgcatgccaccacgcctggctaatttttgtatttttagtagagacagggtttcaccacgttggccaggctggtcttgaacacctgacctcaggtgatccacctgcctcggccccccaaagtgctgggattacaaggcgtgagccaccacacccagttgtaaattcttttaacaaatctcttaggctgcaaattggtggtgagatacttattttaaaatgcactacgcaaaagtcaaatcatagtttcttgggaaaggaactaaggtaagcagacagagaagttagaatatgctgtgaaatttttgtttattttatatttttatttttttgagagagggtctttctctgtcgcccaggctggatgcagtggtgcaacctgggctcactgcaacctccacattccagggcttacgcggtcctcgcacctcagcctcctaagtagctgggactacaagtgcgtgccaccacatgtggctaacttttgtattttttgtagagatgaggttttgccatgtcacccaggctggtctcaaactcctgagctcaagccatctccctccctcagcctctcaaagtgctggggatggctgggtgaaattttaaagtaatggtatttataggctgggcgcagtggcttatgcctgtaatcccagcactgggggaggccgaggcaggcggatcacttgaggtcaggagtttgagacaagcctggccaacatggggaaaccccgtctctactaaaaatacaaaaattagccaggcatggtggcaggtatctgtaatcccatctgaggcaggagaatcgcttgaacccgggaggtggaggttgcaatgagccgagattgcaccactgcactctagcctgggtggcagagcaagattctgtctcgaaaaaaaannnnnnnnnnnnnnnnnnnnttgggtgacagagcaagactccattccaaaaacaaacaaataaaaaaacaaatcaaagtgccgggggtattataggcatgagccaccatgccaggcctttatttttaatggtggtaaaatacatataacaaaaaatgtaccatcttcagcctgttaagttcagtagtacattcatacgttcatattattgtgcaatccagtctctagaactttttcatcttgcaaaactgaaacccgccattaaaccttcattctcccactccccctctccccagcccctggcaacatccatcccactgtctgtctctatggtagtttgactactccaggggcctcttatcagtggaatccttcagtatttgcccttttgcaactggcttaatgtcctccaggttcatccgtgttgtagcatacatcagaatttccttcctttttaaggtactaagtttgaaaagtattactgtgtttctgactcagtgagtgggaaacttaattggtttcccaaagtagatagactgtgtgaaggtgtgaactcttcagtgtattattggcagaaagtgtcacctgggcctcctgctctagtcacacccctttgctacatccatctttcttcatcctctgatcctaacatttatcctgaggactgtctcaaaatttcaggcttccagtaaaatcctggtatcattacaactgtttgctttacatctctcttccgttacattttacctgaaagatacactggattttggttgcattcttatccctgccttaaagatctgaccccacatatttgtaatgtcagcatggagttttgtgaaagttgaaaattacttttctcagtgaggggaaaaaagttcccctaaaccaagccattctccacttgcagtaatgatctgtaagaactttatctttgactcctcgactgtttttttttcttgtttgctgccttacctgcagttgttagccatgcctcacagcactgccttcttatcctatagtttttaacttaccagattttgtattattgtgggtcatttgtatgttccccaagtgatataaaagctgtagtcattttaaacagtactctgctcaggaagcaacctcttagcttactgtttgctttgaggcacagatagccgaagtaacttgcccagggtcatccagctggtgagtgtggccccaagctaggcttaggacccaagaccactccctgtagagtggcagtccccggatccgtcccagaagttgggtgaggcacccatgctgtggattcatacagccttgtgcatgatccctcgttaacatgcacacctgaagtcatcaccttctcagtggatgcttccagggactgctgctcctgccggaaggaaccagatctgtctcttcagtgttgtacccccgctgccttccacctagtaggcaagcagtaaatgcaggctgaatgcgtcaatgatgacattgttagaaagaagcaaaagaggaagatgaattgggtatgcagataaaggaaagacatttggcatttgttgggcacctatttgtgctcacagctttatcttttccatcacgcattcctcacaacagtgctaataactgcagtgccattttacagctggacaaaactgaggcccagagagattagcagtttgttgaacattggtatgtctccaaagcctgagttgtttccagtattttgaagtttttcaaattataagtcactgggattttctgggagacaaagtgacttacacccatagggtagtgcagagggaggtgaacacgctggtttgtttaaggtctgactagtaggattgacacaggtatgtggcgagtaagtgctgaatactggaaccagtgctcaggatatttggagtttcttagccctcacgccatgatcactgtatctttggaggttggaggaacaagatggtttcccagatgcgcgcttttgagcccaaagcctggtttgtaaatagccagttgttctcctctgagcaggtggtagtttctgtagaggctgtagaaaagctgggtgctttatttcattactgccactgctgttttaggcagagcttaaggttaagagagaaggagcgtgtgtgtgtgtgtgtgtgtgtgtgtgtgtgtgtgtgtgtgtgtgtgtgtattcagtgtttatgaaacttccaggtctgtaaaggggtgtggccgtgattagcaggagggcacccgttggcagcaggccagctggaggggatgaaaaggaaatggcaatgacctccttggcctgggagcaactctgactaaggtagttaccttttgtatatttaccttctccgcaaatgagggctcactccttaattactttataaaatgtttccccgcattgttggtttaaatatggacctttttatccattgaaaggcagaggctgtaagaaggatgctggttaatcattatagtggaaaaaaataaggcaagtgatgtatttgaaagctaggcagaggggtctggtgccagctggatgacctcaaagagacatcctggtcctaaagcatgccttggacacgttcatttgacggtacccacggggatttaggacagtgtggtcctggcagctgctatgtgtctgccaagcagaacctgctgtcagagagctgcgttttccgtggaactttatggcatatccccgggcatctgcctgtggccggtggagcgcgggttgcaggattttagactagagcccgccgtgtgctcatgtatcgtcctctggcttggaaagagggctctgtccctttaagacagtcctcctttgtatgccactggctggaacccatttcagctctgggtttctgccgactgttaaaatctgcaaagcaacatttaaataaataaataaatgaaagcttcccttgtgtggctttcctattcacagccaagcacaatagcgccttgttgtttttgtcactttaatcctcttcattaaattggaaccctggaaaggaatggtgatggggctgatgctggaccgtccccctgactgccagccggacaccttgcagattaacctttgtgggcatggattccgggtgcccctctggcaatgggcgaggagggcgagcgaccgggtggtgtgtcagggcggctccccctctggtttgtctccattgtgctcaggctgccggcagggacaacctgctgccctccccagtggccattcttttaaagagcaaggggttcagccgcctccctggcacaccgcctccctggcacataagcatggctgcagcacgtggcagtgggggagggaggagctgtttgttgtgctgccatctggcccatctgagccgttcttttgcagtttaaccctaatggctacacaggagagaagcggcatgaatagacgggtttcccagggtgcggacggtgctttcccagaaactcccgggctgtgaggtagacatgggtatttctgaccaccacctttcttgttccagctgtggccttcgcagtgtcctgaagacactagccaagactgtaggaatcaatcacacctcagctctccagcaatagtgttgattcttcatgctgctaaatgaaattaagcattttgtttttggatgttttttctgtccggggcagcatgagaatgaaggcttgaattaaagatttgatgttgcattgttaagtttatgcagaggaaaatacttattaaaatattagattttgcctcatctcagaataaaattccactagaaaaatgaggtgtagttcagctttttaaaataaagttcttgaatgattggttgagccagaaggggagcagcattatgatttaaagttagtaagtatggaatggagaagtaatttagcagtcatgtggcaaatgtcaggagattggatcaaaataaatgtagataaatgtcttatttattctagctacaaattggccagaagcgttttctgtctgactccaaggacacagaagggctatcttttctagtgaccatagttgtacatttttagtcttttgttttcaaattgtcatagtacatatatatatgtattttaaagcaagtattcaggggcttatatgtcctgtctctctattcccagacccactccccaaagcagccactattaattcacttttttctgcttttaggtcttctagtgggtgctgccaagttcttaaattggtgattattttgtcaagatcaaaggttatctcctgccttctgcctatgatggatgaggatgcagctcacaccattctcttccttccttctctcactgtccatttttggtagttgatcacaattttcagttcctggatttttacctttggcatatttacagcgtgggtttcttgttcatgatccttatccatgcctctggtctctagtgttgtaggaggaagctgtggggaccatttgggaccctgctgccctctccactttgcttccctcaaactttggtcagctcttccttcaccttggtaacagatagctttgcttctccagcctgggttggtctttcatgctttgtctacagggtgattctgtaagttaactaccagcgaccagcaccatgacaggaatgtagataccactcaccgtagagccaggtgcccactcaaagggagctgttcctggcgtccctgatggcccagaggacaccactcggggggcatgtttcatttcttctgtgatttcctgtagttgagtttttcctgttgcccagtcctttttattctcttgagaggaaaccgaatgatgcctgttggtatcacacagttttctcagctgctttctccttcattctctggtttcgagtctgatttcattctttctgatggcattcctctggcagccctttggcttcctgctctgacccggtctggtggctgttggccatcacagttgatggcgcttgctgtcctcaggctcctgagtcagtcccgttccttgatccacatcttgctcctgaagtagcttcttcagaaggggtgcacagaagacaaactttctgatccttatgtatctgaaatgagtctgttttaccctcctacttgactgagaatttggggttcagataattttcatttagaattttgaaagttccactgcgctatctttagtgtgcgggctcttatactgacaccagcgagatcttccctcgtgggtggtctgattaatcactctccttaacctctgtggaggttttaggatcgtctttattcctggaacttctgaatttttcctatgagaatttctctgtgggatttaaaaatatttttattcaaccgagtttatttttttgcttatatttccaggtttgcttatattttcaaacctctttgttctacaggaatgccccaactttatcttttaatccttcgttgacttttttgatgtgggggacaaaagtatgtttaatttgcaaggccgtattctttttctgtaattgtcccttttccagagttttctgttcttttaaaggttttttttttctttcttttttccccctaattatctctgtttgctctagggtgagttttctgttccctgtcttgtcctttctcactcctggcataggtgtggttatctctgtaagtgtaagagtgaagcagtagacatgttaagcggaagctctgtgcatggctgggccttgtgggcagggaggcttggcttcagggcgagtgagccagagcctgcttggggtagggttctcttaggtgtccgctgtctacatatggaggctttaccctggacaccagctccacacttgtctgctcatgagaaagttggcttcgttcatgtgtgtgtgtttgtgtgtgtgtgtgaaatccttagtgtgctaggccctgtgctgagtaccacaaacacaacagtgtacaaggcatacggtgtccctgcctttgtggagtttttattctagaagatattagcacttagcactgtttctttcctttctctgttctggaaatttgttgaaatctcttctgatggcccttctctgtgtactctttgatattgtaggtttatggatgtttttgttcctttactattttttttaaatttttaaatttttttgagatggaggcctgctctgttgcccaggctggagtgcaacgttgccatcttggctcactgcaacctccacctctggggttcaagcgattctcttgtctcagcctcccaagtagctgggattacaggtgtgcaccgctacgcccagctaatttttgtatttttagtagagacggggtttcaccttgttggtcaaacgggtcttgaactcctggcctcacgtgatccacccttctcagcctcccaaagtgctaggattacaggcgtggaccaccgcgcctggcctattcctttactatttaaaaaataatatcttggaagatagaggactagaagggcattttgaatttataatacagaagctagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagatagggatttcttttatacgattgctctgtttttcatcagcttcattatatggaccttggatttagtcttgcttctgctgggtagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagataggaatttcttttatacgattgctctgtttttcatcagcttcattatatggaccttggatttagtcttgcttctgctgggtagagatacattgatgatctgattaagccagttctgtagcttcaaaatcaaatcccaattattgagcctcttgcggagcagctgtttttaaaaaatgaatgttgccttaatttcaaaaccatgttatattggaatgaatatgtatcttctagaacctgaagaaattaatttcttaaaggggtcttctacttggactagaaatttttctgggctgtgaagcacagaaaaatcagagtgaactgctttaaacatgcgtttctgtagaacggtgtacgcatcagtagagttgatgttgtttttcaaaacggcttttgctttaaccagagctcacttatttgtctgactttttcctgaagcagccattttaatatatatatatatattttttaatgttgggagaactgttcagcctgggaagaaacatttggggtggtgggtttggcgggggtgcagggttagaatccacataatgctgatggattgctgagctggagtcctgggtcttgacacaggaatgggactggagagcaggtgtgtaggtgaacttatttaaggctccgtcctccaatacacacacctgagtgatcacccttgagttctcagggacgcagtttaaggcccactcttgtgaaggtgacctgggttggatttagttggtctgttgggatctttagagtggctgtctcttccagcctctaaaggaagagtgtttttcaaaccacaggactcagtatattaggtaattatacgattacctaattgattatgaaataattattttttattttttatattattattattattatttttgagacagagttgtgctcttgttgcctaggctggagtgcagtggcacgatctcagcccactgcaaccttcacctcccaacttcaagcgattcttctgcctcagcctcctgagtagctgggattacaggcacctgccaccatgcctggctaattttttttgtatttttagtagagacggggtttcaccatgttggccaggctggtcttgaactcctgacttcaggtgatctactcacctcggcctcccaaagtgctgagattacaggtgtgagccaccgcatgcagccataaaatcagtttactggactaaaccactgttaagaaagctcacagtgaaataacagacatggtgagatattatttttgatacttttatgtatggtggagattgggtcatgatgtaaaatgcatttcttttctttttctgtttctttctctttttctttctctttctctctctctttctctctctcctacctccctccctccctccctccctcccttccttcctccttcccttccttcctccctcccttccttcctcccttccttccttccttctttccttctttccttctttctttcttgtctggctctgttgcccaggctggagtgcagtggtgcgatcttggctcactgcaacctctgcaccccaggctcaagcaatccttctacgtcagccccccgagtagctggaactacaggcatgtgccaccatgcccagctaatttttgtattttttttagtagagacagggtttcaccatgttgtccatgctggtcccaatgggctcaagcagtctgcctggtttggcctcccaaagtgctgggattacaggcgtgagctacaaggcctggactaaaatgcttttcttattttggattttgagatgtttaaaaaacacttttttagagaaggttggggaaaacctaggttaaaaaaaaaaaaaaaggaaaagtcggcttttctaatgtagctaattaacccactgtacacttcactgtagtctattgtttctaccctcttgtgatttttatgaaatatttggggaaagtaactgctctgtgaatgtagtagattaagttttaatgccatgggcagaaggaaagtatgtgtatcctaactgtgctctcaagcagagatgttaattccaactctatgctgtctagaaatataatatgagccatagatgcacttttatttcatactagttcctttgagatcaattaaaataatacatttcattaagttatatcaatgtgcaatcaatataaaatattattaaaaagtcattttcctttgtttttatagaaagtctggtgtgtgtgtgtgtgtgtgtgtgtatatatatatattatttatttatttatttatttatttatttatttatttatttgagatggagtcttgtactgtctcccaggctggagggcaatggcgggatctcggctcactgcaacctccacctcccgggtttacgccattctcctgcctcagcctcccgagtagctgggactacaggcacctgccaccacgcccagctaattttttgtatttttagtagtgacggggtttcaccatgttagccaggatggtctcggtctcctgacctcgtgatctgcccgccccggcctctcaaagtgctgggattacaggcatgagccactgtgcccggcctcggtgtatattttttacctacagcacatctcaaactgggtggtgacatttcaagtggttaatgtcacgtggggctcctggccgccatattgtacagtgcagctcaggctcacataggcacccactgaaggatagaaggaccctcaaaccacccctacccttgagagtgtgggtgccctttgctgtgccatggagggaacaagagccaacacttctgagcttctgctcagcaccaggcagggtttgaggcactttaattactctacatcatcttcacagcagccttatcaagtgggtgatggtgggaccacttcattgatgatgaaatgtgacccaagtgggttacataacttgtctgaagtgacctaatttgatatttggtagattggagctaggatttgaacctggtttgtttgattctaatgcttgttcttctcatttgcccacatggcttcccatagcatgcttgaagggtcattttagagggtgtctgtccaaatctcctgttggtataggtgggggagattgagccattggaggatggcagaagtattttgtggtgagagctgtgatctgggaattaagtaactttcttctgatgataagagcacattgtaaaacatcgaaacaatgaagaaaggtatgaagcagaaagagaaagtcccatagtcccagttcccagagttaagcactgattttaggtgtatattctagactttttttatttctcagtgcatacatagtctctttctccaaacccctcccagagatggcacaaaattgttcgtacacgttgctttgcctcttgcctcccctccccacctcagggggtcatggacatctttccatctcggagactctgtttttgaccatgagggagctgaggcctagagagattaattaaatgtcagcctgaagtctcccagctggaagggatgaaaatggccaggcgctcagctaatattcatcctttttcattcatagccaacctaatttaaccttcagtaatctcttctctctcgtttttccttccaagagtttctcagagcttttctgtgtgatttaagggccttcctttcttagaaatctgataagaattggagccataactatttctatcactcagtcatttctgaaactgacttctagtttctttcttgatatctttctccttttgtggcctctggatcttccttgatttttggcgagataaaagctttcttgtaacattgccctccatttttgtagttcccagtgacctgacagcagaggagcgtcaagaactggagaacatccgacggagaaaacaggagctgctggctgacattcaggtaggagagtggcatggtggtttcaccaacgtaagaaccacagtgacagttccatttgtatgaaagggtgtcctttgcagagtgtctcctcaagacacttttgacctgccctcactacagctctgcacaaagcgtaggtgttgataatcagtcacctttcctctacagctgaggagatgcagtgtcagagaggttgagtggcttgtccaggttcacccagttggtcggttgtcggagctggagatagcctgcaagactcctgtctcctgagtagtcctctctgctgtgtttgcccttgcggagcagagtggatgaggagaggcaatgagaatgtgggcttcaggcgaagctcggcccacgccctggctctggctctgccgcttactggctgaatgatttgagacaagagagttccggttccttgaacttcagtttcttcatctgtcagatcatgaaaacacctgctacacagttggaaggacttagcatgaaagacagcataatttctggtccctatagatgtacttagtgatagcaattttacaattacaatttttccaagttcctttttgtaactatcaagcttgtaggaaataagtctagaagccaatagttggattattttcgccctaagacagcaaatgttattctttcagaattcttcacaagacattaggagtggggttaaggagggaatcctgttgcccaaagtagcaaaatgaggaaagacttgactttctctggagttgatttaagtatattttgatagttctccctgatcctttgatttctgcttcactggtagatcgtgagaaagctaagcagctctccacttaagccccacttccccgtgagagcccatccattctgaccaacagtgtgctggaatgaggagggtgggtgcggatgcacagccgatttgatcagacattccctttgccagccgcttggtggcattgttgccctggcacagctactgcaggctctgcagcctgggctttgggtaggagactttgtcctctgaattttctggcatgcttgtgtttagtaagctgcagacttgttctgaaagattgtgatgaggcagccaggttttgtttttcacacagcatatatgcttataaactttcctagaccgtaaactccttgaggtcagaggctgtattcttttctaccttggtgttttctggaatgcttactgtttggtaggcactcaataaatatttctgaaacatgaattttcctaatttactttttgcatttttgtcatattttgtttcattttgctttattttgtttttggttggagggagttatgtgagattttagaagttttaatttgatctgcatctgcctttcctgctgactctggactgtctgttttatagaggctgaaggatgagatagcagaagtagctaatgaaattgaaaacctgggatccacagaggaaaggtgagtctgccctgctgccaggtggcttctgtggttgtaattccttaaagcacccaggccttaattatgcttacgtggcacattgaaggaaaaagtcagctttgtgtctttctaattctagcaagcacatacacacccataatgtctgccttccatccttcaccgcaaggcctcctgaacataggagcttcttccagtgtttaaaaaattgaactggaggccgggcgcggtggctcacggctgtaatcccagcactttgggaggccgaggcaggtggatcacgaggtcaagagatcgagaccatcctggccaacatggtgaaaccctgtctctactcaaaatacaaaaattagacgggtgtggtggtgcacacctgtagtcccagctactcgggaggctgaggcaggagaattgcttgaacccgggaggtggaggttgcagtgagctgagatcgcgccactgcactccagcctggtgacagagcgagactccgtctcaaaaaaaaaaaaaaaaattgaactggagaacttcaaaggtcccagaaagccttaaactgctcctaaatttttatgtgaattactcccctctgttgtccactgtcggtgtgcattttaaagtttctgtttttcctttgtgtaaaggaaaagcttaatgaatgctgctgatacgatttcaaagggctggagtgtccagtcatgtctgaggataatcgtgagcttatttgcaccttcctaatgcttaagggaagaaaatgtagaaatgcgatgatagtataaaaggacaaggactctgcttttttttttccttttattttcatgaaatgttagtgactttgagagtttagttttgaatggggttcccagaccgttttctgactgcttaatgcaataaatgagctgtttccaattcactacatgtctgtatttttctaagcctaagtcttcctgtctggcttcgtaggactgtttgatttgttgttttagactcctgtgggcagtgccttcagggtatagtgaggctgagtcctccacagaaggcagccagctcaccacggccagtctctgtattgtccatttggtattttggattagtttcccctctttccattttaaacactcgtagcttaaatgaaacggatacgttggacttcataaaaatttaaaacttccgcttttgtaaaagataaaactattaaaaactattaaaagaaatgaacaggcaacagattagaagtaaatatttgtaacaaatatatctgaaaaaggacttgtatctagaatatatgatagaaaggcagcccaaataagaaaatgggcaaaaaacttggacactttacaaaagaagccatatgtgtagtagacacatgaaaaatgcttaacatcattagttgtaggggatgtaatttaaaaccaccatgaaacggtacttcacatcccctatgatggctagaattaaaaagactgatggtacctcatgttggcaagtgctagtgagaataaaataatataaccatttgggaaagaagtttggcagtttcatcagcaattcaactcctagttacttaagagaaatgaaaacatgtccatacaaagacttgtacaagaatatctatagcattcttatataaaataaccaaaagctggaaataccctgaatggctgccagcaggtgactggataaacaggtcgaggtaatagactattactcagcagtgtgaaggaatgaactgctagcgtgcagcagcacggatgaatctcacgaacattgtgatgagtgaaagaaactgtgggcaccgtgtgcttccatgcgtgagcatctagaacatgcaaactaagctgtgctagtgtgctagccgaaatcatgacagtgctgcctccgaggtggttgctggggcggggtggggtggggttgactaggaagggccatagggaacttacagggatggcaggaatattctgtattaatctgagtggtgcttcaagggtatatgcactcatcaaaacaaattgaactgtgcacttaaggtgtgtgcattttgttaaatgtaaattttacctcgatcttaaaaatgtaaaaaaaaatggcttttttctgactataaaggtaatacacctttactgcagaaaattggtaaaatacagaaaagtataaaaaacaaatttctcataaacacttatcccagagataatcaggattcatattttggtacgtttcctttctgtatattccggtgtctgcacacacatattcagaattcagtgtgccctttgtttttctcttgattaattctctgtcagttaccatagaacagcaaggaaacgcagacaccaggaacgtgagtgcatccaaagtactcagccagtgaatttgggaagacttgtaactcatgaactgcatctgaagttgtgagtcaggaagtagtctttaggttattattattttttaatctggaacttaaaatggttttccggtatcgaaagcgccaagacggaagtgattctgcacatccctgaggatccatccatacgggtactcaggctcaccctgcatttgtttctcaagcaggcattacatttgctcggactttcttataggagagaattcatgtttctcatcgacgatctgatgcattttgtaggaatgatcctaaatactatttaatcaagcagaaataatatactcatgtagtacaggatttcactttctgaaatgtatacgcgtcagttaactaaggcgatccagtagcagtaagctgttttcctttggacaccttaactggggtgtcagacctgtgtaggctggggaaagccacttagagaagtagctgcctaaggcctagagctataggggctccaagtggggcagatagagaagtgagctggctagctaatgaaattagggagccatctctggtgtgtgtcccaggcagtcatgtggcacagactgtgactggcggatatctgggagtgtgcgttctggtggctgcaggaaagcctttggtgaggactggactgaggcccaggaagctgagcattcccaggagtttcaccccttgcttctgtgggcacctctgacgctgcctcaccacttacactggaaaccatgaaacaggccttccttgtggtatttgtttggaaatactgatcaaagtaatcttcctggatttagaaaaaaatgattagacaatcattttagttaaataggaatttctagatacctggtcataacccttcattctggctgaaattaaatggtgtttcccccatgactttgtttcctaaggcagctgttgacaggggagcccagattatcttacacctggaagttctgatactactcacagttttcaggtgttcctttcaaaaggtcaaaacagcctggatgcgatgactcatgcctataataccagcattttgggaggccaaggtaggaggattgcttgaggccaggagtttaagaccagcctgggttacatagcaagactctgtctctacaaaatattttaaaaagtagccagttgtggtagtatctgcttgtagtcctagttactcaggaggctgaggccggaggatcacttgagctcaggagttaaaggttgcggtgagccacagtcacaccactgtactccagcctgggtgacagagcaagaccctgcctgtaacaaaaacaaaaacacaaaaaacaccaaccctcaaaacacttaggaatattttcttccctccatggatttagctagagaacacatgtgttctttaaggcaataacattttatgattttatttccgagcaacttttttgctctcggagattataaaattactattgatattgatggcagtggttcttaaatttgggtgcataccagaattactgcaggaggttttaaaaattcaaattcctaggttctgccccttgtacttctgagttactcagccggtccagggccttgctactcagactccacacatgggatcatgttaaacatacagcagaagcacaggccccttctcagacatagagtcagaatctgttttgttgaggccccaggtgacgtgtatgtataaacgagcggagcgtcttcacgtctgatatgctcccaaggctgctggttggtggaccagactttgagaagcttggtctgtgaatctgcatttttcattctgatacagtcaagaaaactgcctattatttagcaacttcttaaaaagttaaatacagatgtaccgtatgacccagcagtgtccacccctgggtatctacccaaggaaaatgaaaacgtgtccacacaaagacatatatgcaaatgctgatagcagccttctgcataattgtcccaaactgtaaacagcctaagtgtccatcatctggtgaatggataaacagatgtggtttatccataccatggaagatgacccagcagcaagaaggcatgtagtactggcccacgctccagcaccatgaccttgacaacattatgctaatgaaagaagccagatctgaaaatccacatcttttatgattctgtttgtatgatatgtccagaataggcaaatctgtggagacagacaatagattaatagttgcctggggatggaggtagaagtaaggattaactgtaaaaaggtgtgaggaattctgtaggggagatgaaaatgttctaaaactggattatggtgatgttgcacaacttagtaagtatactaaaaattcaaatatgtacctacagtaggagtattataagtaaattataccctgataaagtttttttttttttttttttttttggagacggagtctcactctgtcacccgggctagagtgcagtggtggatctccactcactccaacctccaactcccaaattcaagtgattctcctgcttcagcctcccgagtagctgggattacaggtgcccaccaccatgcctggctaatttttgtatttttagtagagacagggtttcaccatgttggctgggctggtcttgaactcctgaccttgtgatccacccacctcggcctcccaaagtgctgggattacaggcatgagccactgtgcccggcctaccctgataaagtttttttaaaaatcatgttaaaaaaagaaaactggctgggtacagtggcttatgcctgtaatcccagcactttgggaggctgacgcaggcagatcatttgagcccaagagtttgagactagcctgggcaacacagtgagcatggtggcatgcgcctgtggtcccagctacttgggaggctgaggtgggaggatcacttgagcccaggaggcagaggttgcaatgagccgagatagcaccactgcacttcagccttcagacagagagagaccctgtctcaaaaaaaaataaagaaaacctctgttccagggtagaaggagcaaatgagcttggagcttggagccaggttcaggcttcaggtttcagttggcctttcatagttccaccagattatgcctgttgctttcctggataaatctttcaaaaacctgtgtaaatcagtggaaatcatattagtctttcaagcctttccgatggcctgaagtactaaaatggctgtgatggttgttttacaggaaaaacatgcagaggaacaaacaggtagccatgggcaggaaaaaatttaatatggaccctaaaaaggtaagtgagaaagaagcgggaagtggtccatattagatggggtttttttatagtgctcagatagaccctaaaaacgtttttttccaagcgttacagttcatgttgccgttttgtagagcaaatgttatgcactaagcccttgttcctaaactgtgactccccggctttataggtcacttagcaagtatttattaaatattccagtgcacccacacccatttcttcctgtgccctttccccttcttttcaactgtttcccagcaaagcatcattggcgtctttgttgtctttttctaggggatccagttcttaatagagaacgacctcctgaagaacacttgtgaagacattgcccagttcttatataaaggcgaagggctcaacaagacagccatcggcgactacctaggggagaggtaaggccttggggattatgcgcatgctagggaaggctgttcaggaacgacacaaagaaacaaactcccaaatactctgaagttcttggaggggtttttgccttaaagcatctgtagccccactggagttgaggggaggcttttctggggaatagtgatgggtcttttctgggggtcatggagacatcttgcttgttcagccagtcagcagagctagccagtcttcttgcggacagtgtgcacaagtggctgtctgggcaggagccacaggaccacaggacgcagtgtaggagacatggcctggctggagattctcagtgttggtgcctgactcctgctttctctcccattttttgtcttttctcgatagagatgagtttaatatccaggttcttcatgcatttgtggagctgcatgagttcactgatcttaatctcgtccaggcactacggtgagtattcttgaggtgagcccctttggaaggagtgggaggctagcctttgatcatgagtctgtcctggggggcattttattgaaattatatctttgggtatgatttgaatattttgaagtattttggagggaagaaatctattggtctctgactgggaatgactggatggtcaaggggaattcaattctgttacgttctggaggccgattctgtaacactcttccttgagtcttatatttgaggttttagaaattgatgaatacttaaattttgaaatttttcagtttagaaaatcctttaatttcttgccctggaataagtagttatacatttcattttggaaagaaaaaagtaaaccttaattttttattaaatctgttacctcatgccttttaagaaactgtcattctgtattttcactgctgtaggtgtaaataatgacttcatcttttgtgctatcatttagctggatggaaacaatccacaattaaacctgtcagctgtgggtctttctttctttgacttaaagggatcgattgttaatgctttgacaagacaatcttctctttttctgccacccatattgtttccggaaatagcgtttgtttaaaatgagcattatctatgtttcagtcttgtatattattctgaggagggaaaccactcctcagtagggattgtttccctcctaatttttcactttttcctaagaaaaattttacttttgattaaggtaacagtggtgtggatggcaactttgcatctgttcagagttacagtaacagaaggctgcagcccagcagggttccctttgcactttgatgttaaaaaatcattggcagtggtcaggcaccgtggctcacacctgtactcccagcactttgggaggctgaggcgggtggatcacttgaggccaggagtttgagaccagcctggccagcatggtgaaaccccgtctctactaaaaatacaaaaaattagccgggcatggtggcgtgtgcctgtagtcccggctactcgggaggctgaggcagaagattgcctgaacccggcaggcagaggttgcagtgagccaagatcacgccactgcactccagcctgggtgacagagtgagactccatctcaaaaaaaaaaagaaaaaaaaaatcattggcagtttaacaattcatagagaaataaattgcctccccaagttctggaacactctgtctttacccactcaggcagttcctgtggagcttccggctacccggagaggcccagaagatcgaccggatgatggaggcgtttgcccagcgatattgtcagtgcaataatggcgtgttccagtccacgggtaaatacgatcattcatcctagtttatgatgggcgttttacactggattattttcttggcaccagataatttctaaaacaaaagggctgagattcatgcctaggaacgtttactcaatgatagttataatagtaaaatgttggaaataacctgaaagtctgacattaaggcactatgaatttaaattgtggtacctctgaactacgaaatacacagctattaaaaaccatgttttagctgcatgcagtggctcacactggtaatgtcagcaccttgggtgggaggccgaggtgagaggattgcttgaggctaggagtttgagaccagcctgggcaacattatgagaccctttctccaaaaaaatttttaaaaattagccaggtgtggtggcttatgcctgtagtcccggctatttgtgaggctgaggcaggaggatctcttgagcccaagagtttacgactacacgcagtgagctatgattgcaccacagcactccaagcctgggtgacagagtgagaccctgtctcaaaacaaaaactaaagaaacccatattgttacaaagaatttttattgacataggagaatgatattaagattagcaaaaaagcatgtgtatgtatttgtttgtttccagttttgttacagtatatatctgtgagataaatatgtggtgagttatacatagtcatatttacgtagaggaaataaagcaaaataaattattgctagatagtgggattatgggtcattacaggtcattttgttttaaacacattgtgtttttcagagtttctacagtgtgtgtattctcctttccaatctgaaaaaataaacagctttaagtcttgaatactttatatactttttcgtgccttgctcctttcagacagcagtgtgccctggagtgtacccgtacatgtggattcatctcattcttttgagaacatgtttttttttttttttctgagatggagtctcactctgtcgcccaggctggagtgcagtggcgctatctcggctcactgcaagctctgcctcccaggttcaagcaattctcctgcctcggcctcccaagttgctgggattacaggcgcgtgcagccacgcctggctaatttttgtattttagtagagacgggttttcaccatgtgggtcaggctaggcttgaactcctgacctcatgatctgcctgccttggcctcccaaagtgcagggattacaggtgtaagccactgcatctggccgagaacatggttttttattcctgatttcatctgataccactcttgctcttgcgggtgggatgtttctgaacatctgagcatgcaacggctcccctttgcttttctctcatctttagatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccgggtaagcaaggaagaatggtcttcattcaagtcaagaaagagttcactgggaacaggatcgtcttttgtaggaaggaagaaaaaacatacaatttatcaagggtctcctcttttaattttttaaccatgtgaatttcattaagaaagtggtagtaaggcccagctagggaatcagggaggggacagtggtttgtaaacatgaaactaaaagcttgaatagaagtcaggctgcttctttattttcctaattgggaaggcttatttattttgtcactgtgagctgcctgaaagcagaaatggtcataatcttctagtctcagcatctagcaggcttggcttactataggcacatgaatgcttgtggaatgaatgaagagaaaggggaggaggaaaaaatatttctagaatcagagacataaattgtcatcttttatcccagaatctctatgagagcataaaaaatgaaccctttaaaatcccagaagacgacgggaatgacctcactcacactttcttcaatccagaccgagaaggctggctattgaaactcggtaagcgcacctctgagtcagggctcctaaagctgagacttaggaagaaaggcggtgtgtgtgcgtgtgtgcgtgcgtgcgtgtgtgcgcgtgtgcgtgtttgtgcgtgtgcatgtgtgcgcgtgcgtgtgtgtgcacgcgcatgcatgttcacacacattcatggacacacacgcaccatgtaggaaagggggtggcttatagaggactccagagagactttggtatgagttctgttctaacaaaggtcggcttccaaaagggaagtgacttcatagtcattgcccccatgggacacagagactactggggacagacttactccaccataaatattgcccacatgtgtctgtgctccacatttttacccttgaattggttgaccaggttttgtttcaaggcagttccctgagcacctggtccgtttgccttccctgtccccataaccactgggagggtggccgaccttgtccatctttctacttcccatcccacagatttgtacctggcgctcctgcccccaccccagtgcatcgtcacttccttctgcatctggctcccccacaggcagtgtgcatggcaagcctagagcccttggctgcagctcaatccacagcactcttactcattcttgggcagtggttttttttttttcttttttttttcccctccttttcaatctgaatcagccacattaattattttgttcatttagaaaagctgaaaatgcatttctcttccctttgccagaagtgatgagcttgtattgctgagatttgtggtcatgccttgccgtgaaggtgacagggtaatcaataggaaagactttagtagggttttcatacacattcatgtccacatgtgtttactttattaatggtttcagaacatagagctctagactctctggacataatgatgtcctttttttttttttttttttggacactagcagggtactttcctctgttgccttctgctttagcctttgatgagttgggttctcacattagcaggggctgttccgtcctataccagcccaactgcttgccccagtgattagaagtcagtactctcttggtcattactgacacatctgggaaggctaaaatggaatcctttatttctgactaggtcagatagcagtagactttatatttccttttaaagtcatatcccaagtccttgtgcttatacataatgacttaattcataaattccccttacagcaccacttcaccgatcagttttaaatatctcttgaattggccatcattttatatatctttaagccagcagaatctttgaagttaaggctctaaaattactaaccccataggcagccttcccttccacattcctattgccaagtggatggagttgaaaggaaacctactggaaacgtttaaagtgtgttcaagtttggatttacttccccctacagcgagatttgtttaaatgctaatactaagtgttagctttgacagcccagatactaaaattagaacagtacaaagattatcttggttcttagaccaggatgacatgcaaattcatgaggcatctcgtattttaaaaaagagaaaatttaaccaagtgtgggactcagttttagctcattgcattactttttctaaacctccatcaaatccttctagactctgaatattgtgttttcattgtagcacacttagtatcactctttgtgtttatgtgctgcagaaggcagggcttccagccgtctgtagctgtgtgtatatgtctgtgtatgcatatagccataagaatgtgtattcttgtgtatacacatcagtacatgtgtactcatgggtatatgtgtgtgcattcttacacacactttaaaaagtgacagccatctcaagaaagacatttaattttccctgaaataaccttagctttctttgctctgattctggatatactagtaaacattggctttgtaaaagccgatttgtggcatctttggggccaggtttccagtagtgcctcaaatcttgccttgatgaggtggaacgtggcatgtaagagcccctcgttcacgtgccagacagtagtgggatcatttgcccgttgagtgtttttagttcagctctctccccaggcaggcatgaatgtgactgatacattgcactttaagattaaggaatcgggtttaatttctttgttttaattttcttttctccctcatttgtatgtttccatgattttggctctccttttccttgccccaaactccaggaggtatgtaaccctcagcctgctcgctcgctctgctaggccactgtcattactgcagcattttctgatttcgttatttttggttattttgttttttaattgccggtggtagtgttaatgctgcttctaacttattgtacagtccctagggaactggtcaggatcaggggtttggagcaattttcgtttttcttttttggaggagtatatgttatattcattactgaatgcagtaatgcaagaaaacatactaagagtgggtttgtaaaagcagaggaagtttccatgacattttcacttggaattattggctaagacatgcgctatgtttgatattcaatttgacgtccattaatcagcctgattgaaagttaatctctgacgtggggaagaggagaaagaagagaaggaagtctttcttttttcttcttttttcaagctgagacttactccagagagaacaaagtcttgacttcccaaagctatggaaagcttctgatttaccatgatggaaaagcaaactagggaaagaactaaattagatgatacttaagacatttgcctttgcacgaaaaggggaaatggtatttcctaaactcaaaatgataccgagtgaaggtgaaaaaaacaagtccaaaccaaaaaaccctccctgaagtcctcgtgtttagtttcctggggatcagagaagggtattaacagcctcggctctgttgttatgttttgttttgctccctcgctttttcagcgagtcctcgttaaagccccgaatcggtctcctggttatggttttggtgtctcctctccatttgctggtttttttggggaaacatattttcttagcccaagacccctcaggtttgtgcctaagcattccctgagcagtagctacacttaaaaagaacaaccccaaacacgcacagttactgagatgcttcagggacttgtcaggttgttctcaactgtaggggaagatggcatccggccttgatgtctcggggaggtcacaggaggcctgaggagccgtgcagtgggaggtggtcctgtgagttccacagggactgtcctaggcgcacattgatctgtctgcttgtttcatgtctgcttttctttccacgtggaaatgttccccgtgggcccacagtgatgctttatggtagaggtctctgtaatgcaacaaattgtccaggcataataaccaagcttttgtaatcaggcagagaatttcttctggctttgctttttctccttgatttctttccatcttgtttcttttagcatctgactcgctttttccatgatctcctatgtccgaagggttccccgggtagtgtcctgtgatggagcgcatgggaggtcagcatgggttgatgttccctttgtgccgagcctccgtgggcaaccaatggcccgccaggctggaagaccaaagttctcagactctgaattggtggagggggttcctttttaagaacaaattggcttcaatcctgaatatagtccttgccttctttatcctccttatttaattctgcccgggctttcctgttttccacatgcatgtcatagtatccatttatggttttctcttaattcatgccatctaacctttagggaccagtggcaagggctcacatgaaacttagaagttactggagggagagtctcaatttgcttgatatagcacaggatgggcaggtggagggcacgtgcttgcttacagcaaattccctcgcataacctagatctgtgtcatttggaatcttggcaattaatgatcagtcacgtaagcccgcctagggttcagcatccaagcagggtgctaaaaactggcctgaaagtccagtggtccttttacttgtctgccaggacctacgctggacattttcttttcataacattatttgcatactccccttaggtttctctggtgtgagcatgcaggcaggtcctggcagttagaataatccctgtaaaaccattctcctctttgctcagctatttgtgatgagggcaagagagaaagcatgatcggaggtatgagatttatgccccatgatccttgctatttaggaagattggagaagcggtattgtctgtaggttaagtcttagcaaaagagcaggcacaagaagtgtttctagaatgccatgcatagcttcacaggtcaaggccttagggataagttttgagtggttcatgttcagaaaatgttcccttgatgggagagaggtggaggaagagaaagcctgtggtcccgatttgacagcaggtgtagcttcattcagataggcttggggaaatttttccttccttcatgtctgtctcagcataacttcacggccccaaccccaacttttttttttttcttttttttttctttttttttgagagggagtctccctgtgtcacccaggcgggagtgcagtggtgcaatcttggctcactgcaacctccacctcccagttcaagtgactctcatgcttcagcctcctgagtagctggaactataggcatgtgccaccacccctggctaatttttatacttttagtagagatggggattcaccatgttggccggctggtcttgaactcctgacctcaagcgacccacccaccttgacctcccagagtgctgggattatagacgtgagcccctgtgcctagccatgaccccagtgttttgtgctgagaaatactaaaaagaaccaagggaggcccttgccagcctcccagccaccaccgccagagcttgttttgccatggctgtatttgccagctgtttctgttataagctccaggtgagaagcccagaacggaaaaggctcctgaggccacctctcagtacgagttgattcttccttgatagaggaattctgctttgattctcacccaggacccgggagattttgttttcaggacactagcacataaggttaagagccagtgtagaagctcactgtaatcatgaaggtgaagaagagagtagaaccatggggatttacttcgtgttccagggaaagtgtggatttgaaggctcccagcatctcccctcctgcttcctccttccttcacttccagtgaaacactccttatgtgccgggctgcttgtcagtagcagagtagcctgcactaggtgctgacccttccctctttttctgttctttggcaatttctaccacataggctttttgctgactctggcaaatttgcattgtatgtcattattgccccgggttttctcgccacaaacccatgctcatcctgccgtcccgattccatctccgggtgtcacctagatgcgcttgctctgcttgtacccacaggctttcactttgtgaaagacgcttctgtttcagctctgtgtcttgttactgatgtcaatgttgtgggctccacgttctcctgatgcctctcccccaaccctctctgagaagagagggtgtcgtgtgtgtcgtggagcctgcacttgtctggttgtctcttgtcgaacgtgcatctctttttgctctgcaggtggcagggtaaagacttggaagagacgctggttcattctgactgacaactgcctttactactttgagtataccacggtgagcacctgctagtcggcctccagactagggatgggcaaggcctccggttccaagtgtctctaatcagacatggttgaggagaccgttggatttgcccttcagtatctgtgggggatgggggagagtttaagcaaagtgcaagaactgaagtaaatctcagaatggggaacccctgagaagaggtgcgtgccttaaagggcacgggctcagagcaggcacccggttctggtgggacaggagatacctggcctggaggagggggagcactagaaatgggttttggaactgggctagaaagaatgaatttgcattggttgccgagaaagagtatgtggccctaatcgaaagggagatgaaaagaaaaaggaaataatcgtgatttagaaaattcacctattctgggttagcagaaatgtgatttcagaagaaacagcccaaggggtaaaatatatagtgggggaaaaggaagtgaagtgaaatgggaaaagtcaatttgagattatctggagttttaagaagttttgttggtttttattcagtgggagagacttatagctgcaaatttgtgttttatatacgtatatctcttttgtaataatagccaaagaaagtaaaaatcataaattagctcttttcagagctccctctaagcaaggtacccagaaccctggcaagttagcacttggtgtggagaccgtggctcaccggactggtgatggggtgctttttcatttctgccacctttcttggtcattgtaagggcaaagcgggcatactcccatggcatcgaacttttgtcttaaagtaaatcaaggccgttgagttgagaatgctttgcttttgttctccaagtgtatcttcatggagcaaaagtcattgatcccactgagaaaattaagactcagaagtatcttttaaaatcagtttagagcaaaatggggcttaagtaaaacattgaaatcctgaccatattcaccagtcacttatttaggaccaagaaacaggtacacgccttggcattttctgctgtgaggtgtgaagatgggtttctgtcgtgtctaacacttagcgttgttctccatccccatggacatcatgcacatgcagcttctcacccagggaatgcacttcgtagcccatcaggctgcaggcaagagccgctgcttctgatggtttggtgactgaggatagtaaatcactgtgaagggaattctggccgggatttcatatgttgtaggggctcagctcatgccctgcaagttctgcactggctttgcttttctgttgttatagtcttttcatatgagagtaatacacttcaaatatctgcaaaataataaaaagaaagctgctttctgcttcacccccaaagtaccactgtgaacatcttggtacaattttttctgttttgttcacccttctgccctatattttgccttttttctgaagacacctacactaacgatgtctttaacatcgtgtctgaatttgtctcgctattttctgggtcaaaatgatacataagcatctaagtggtgtacttctaagtcctggacaatcctatagcaatgctacgagattctagaatcttgtggtttttcgtgatgcccaccgtagtggtgtcaccttaatccttaattcagcaatatttattcagcaaagtgtagcattttatcaagcaatggaaatacagagaaaaatacttttttttttttgagacggagtctcgctctgtctcccaggctggagtgtagtggtggtgtgatcttagctcactgcaacctctgcctcctgggttcaagtgattctcccatctcagcctcctgagtagctgggactagaggcgtgcgccaccacatccgtttttttttgttttgttttctgttttttaagtagagatgggatggggtttcaccatgttggccaggctggtcttgaactcctgacctcaggtgatctgcacccagcagtaaatacatttctttttttttttttttttttttttttttttttttttttgagatggagtctcgctctgttgcccaggctggagtgcagtggcacgatctcggctcactgcaagctccgcctcccgggctcacgccattctcctgcctcggcctccggagtagctgggactacaggcgctgctgccacgcccagctaattttttgtatttttagtagagacggggtttcactgtgttagtcaggatggtctcgatctcctgatcttgtgatccgcccatctcagccttccaaagtgctgaatacatttcttaagacacagagaggatgctgtcagaattaagatggtagattgaaacttccacacagaattacctaacagagcaaaagactagtaaaaaaataagtagggaaaaatagcaaccaagcaggggaaggggcagaacgaattcagtgcactgcagccctgggcagcagcggaagcagcggtggcaggggcagcagtcaggagcagtgtgcagggtttctacctcacggcccaggatttgaggagacccggcagtctcgctggtttctcaggtctgggaggaggcaaactgaacaggacttgttattttttcctccctgatcaaggagtagtaaaatcccctgctgggtggacattggtgaaatgggaaaagtgaaaaaagcagccgttatagacataagtaaaggctcaagactgtatattcactggggaagactgtccatggagggtctcccatgagcatgatatccatccccaaatacaggggtcctcaacctcaggccataggacggtaccagtctgtggcctgttacgagccaggccacacagcgggaggtgagtggcaggcgagcggtggaagcttcatctgtatttacagccagctgctccccatcactcacatcacctcctgagctccacatcctgtcagatcagtggcggcgttagattctcataggagcacgaaccctattgtaaattgtatgggccagagatctaggttgtgcactcctcctgagaatctaatgcctgatgatctgaggtggagctgaggcagtgatgctagtgctggggagcagctgcaagtacagatgaatgttagcagagaggtttgactccacagagaccataataatacatcagttgcttgcagactcatcagaactctatcagtgagtggcaagtgacaattagcctgcctctggtggcaggctttatagtggcaagtgagctgatgtacttcaattgtacagctgtatctggtggcaggctttaagtcagaatccaacacttatttcagtccgtgcatggcctgcccgttattttatttaccactgccatccacatctctttcccacactgtgtacttgtctcagccatggttttggtaagcccacccaccaaccctagccaaaatgagtaaaaaccaaacgtcactggagagcttctttgaaaagggggagagacccattgatgagacagcagaacacgccaagactgccaacaaaaataaagctgcattgtaaagaaaatgccaagagttctactcaaattctaggttcatttcaacaggtgatcacattcgccaagcccactttgtagaatatgtggtgaccaactacccaacaaagccatgaaagcttcaaaactgcctcaccgcatggagaccaagcaccctgcatcaaaagacaagcctttggagttttcaaaagaaaaaaatgtaaacatcaagaacagaagcaattattgaaggccaccacttcatcaaatatgtctgcgctgaaagcatcattcttcgtgtctaaccgcattgccaaagccaggactggctgttggtgaagagttgatcctgcctgctgctaaggacatttgtcatgcgcttttaggagaggctgtggttcaaaaggtggcacatgttgctctttcggccagcaccgtaactaggcagattgatgaaacagcagcagatattgaggcacaattgttagagaggattaacgagtcactctggtactcaatccaggttgacgagtctaccgatgttgacaacaagacaacaatgcttgttcttctgtgacatatttttcagggggatgttcatgaggatatgttatgtgtgctttagttgccaaccaacaccacggctgctattcaagtctttgaattattacatatcagggaaactgaactgttttgttttgtggtgttatatgcatggatggagcggctgccgtgactggacagctttctggtttcactactcaggtcaaagaggtcacttctaaatgtgagtctatgcagtatgtcatccatagagaagtgctggctagccaaaaagtgtcacctgaacttaacaacatttatgcaggatgcgattgaaattaccaaccacattaaagtacatggcctaactcaggtctgttcatgcagccctcggaggagatggacgcagagcacacacggcttctgtgatacacagagtgagacgctctctaaaggcacatcactggccagagtttctgagttgcaacagccacttcagagatttcttctagaaaaagtcaccactagcagcacatttcagtgacacagaatataggtcaggaaacttgtgtacttgtgtgacagattaaacctactcacaaactcaatctgtcacttcaggggagagtgacaagtgtgtcccagtcggcagatcaagtggctgctttcaaagccaaactggaattacaggggtgatgagtgaacactgggatttctgacatgtttcaaacattagagagattgtgagagacggagccagggccttctttgccccagcgcctcagctttcagaagagcttgagcgatacttcccaaccacaaaagaacctgaactggaaaggaatggatctgtgacccatttgagaataagccaggtgaatcacctttgccaatgctagaagaagatcaactgcttgagatcgcaaatgacagtggccttaaaagtacgtttgagacaacttcaaatctccatatgttctggattaaagttgaggcagaatatcctgagattgccccaaaagcactgaaagcctgcttccacgcccaacatcctgtctttgtgaagcagtgttttctgcagtgacagcagccaaagagtgattacagagtagactggacacaagcaacacatgttgggtgtcactgtctcccatcagccccagatgggactatctagttgcaggaaaacaagctcagggctcccattgattctacatcatggtgagttgtataattatttcattatatattacagtataataacaatagaaataaannnnnnnnnnnnnnnnnnnnnnnnnnnnnnnnnnnnnnnnnnnnnnnnnaaaccccgtctctactaaaaataaaaaatcagccaagtgtggtggcacatgcctgtaatcccagctaccagggaggctgtggcaggagaatcgcttgaacccaggaggcggaggttgcggtgagccaagatctcgccattgcactccagcctgggcaacaaaagcaaaactgtgccccccaaaataaaaataaataaattaattaacttaaaaaaatgtaatgtgctcgaatcatcccgaaccatcttccctcccctgcctttgtccgtggaaaaattgtcttccatgaaaccagttcctggtaccaaaaaggctggggactgctgcccagatagatggagcaaaccctgacgttggatacttacaatccgagaggaaagaccagaactcggggagtatcttcgatgagctctcccaccactcaccattctctacgagactgcataatatgctagaatgcagaacacctggccgcccaccacaggtcagggtaagtggttagggggacacaagcagatcagagattcacaggaggagaaccaggggtcactcacagatttaccagagccagctggaaggccagaaaagcaaggtttccgtcttcaaacaagtgagaacccaagcaatagcatatacttacagtgcaaccattaatatataatcatagaattataacttatttattcttaaaggtaagttaaaactttaaggagtggaacaaattagctgaaaatataatcatgtcctataaatataatgtcttaaacgcttgagccaatcacagagattatatctgaaaaagacaagtattaaaacaatgagagaaaagctagcagatgcagagaacagaagacgatcccaataataccagagtaattggtgtctgcagaatcaaagatacagtgtggcatgaggtgatttccctgagaaagaggaaaaagccctgaatctgcaaatcaaagaagacaccgtatttcaggaaactgttacagaaagggtcgctccaaagcctggccccttagaccattgaacttggagccaagtgtctggtcgttctgttggaaaaagcagatcatctccagcagcttttagtcccagaaattaaagtatcaaggtctgcacagttttgaagagaagaatgacccaagaccctttatccagccacgttattgtttaagtaaagcacagctggccgcactctcctgaagaaaacatgtgaaatgcggcactttggaaccttcttgaaaaaaaaattgcttgacagtaacatccagcacgtaagagaatgaatcacaagaaaggccctgggaagtaaaagactggtagtgagcattgaactattcatttaaatacagaactaatacttaaatatacaactaatactaaaatatgcttaagttcagaatacgaaaatatacttaagtatggaactaataccaaaatatacttaagtatagaactaatagctaaatatactcatatagaagtaatagctaaataaacttaaatatagagctaatactaaaatatgcttaaatataaaacaaatactaattaaccagaaattgtggctgcaggacgtaccatgaatgttataaacctggacaatgtaaaagtgaaataataaaaatcaggaggtgggaggaggaacaatgtgaagaattagaagattttgtactttttaaaatgcagagtcaagaaatattgttaaaatggaagcatgttgtattttttaaaagaataagtaaaaccttttttttttttttttttttttgagacagagtcttgctctgtcacccaggctggagtccagtggcacgatcttgcagtggctcactgcaacctccgcctcccggattcaagaaattctcctgcctcatcctcctgagtagctgggattacaggcacgtgccaccacatgcggctaatttttgtatttttagtagagatggggtttcaccatgttggtcaggctggtctcaaactcctgacctcgtgatctgcccgcctcagcctcccaaagtgctgggattacaggcgtgagccaccatgcctggtcagacctcttaatgttttcataaacttctttgtcttagcttgaataaggttatttcaggaactcttgtggtaaagaaacatttactttgaagttcaacaattcttcagtttctgcttccttttttccccctgttaaattctaaacaattaaaatagaatgtgttttatgaaaataataccactcgaaatatcccattttcataaaacctgtttttctccatctctctgcacacacacaaaatatcttcacctaatgtcagcaatgataatttaggagtgattggatttggagtatttttaaacctttcacctgtattcttttctacaatatttagttctttataataagcaattcgtatttttacagcaacagtgattgttcttaaagacaaatttaaaaagccaaagacgttggcctcggttatttccctcttcacaggggaagggagtggttattgggcacacacaagtcatcactgaggggtgcagcctgcctgttattaggcctgccagagtccagtgaaagttctaggcaggggcctttttaatatttgggattttacattgctgcccagcagcttaacgtttagttgtttccatcagtggttctcattcttctttcactccagcactgagggatagcgtgagcacctgtctgcgatgctggctcactcaagccaattctcaagtggcaggatgagtgtgctgagaagagcgaggagggccacgctctgcaggatggagcaggaaagagggggggccaggaaggataccagaatccccagtgggttctcccggtgaccaggagggtcttcttataacctggtccccactcccaggctgaagagcatgggtgtaaatcatcttggtttaaaatcatattccatcaagaatgtgcatcatgcatatgtaacctggatgccgcaggcctcaccagtcaaagagtatacattatgtcacatacttattgaggtccaaagtgtgattactcttagaccacccacctgctcgcctggtgatgcctcaacccagttaacccagcggaatcctcaaaaggtgcaggcaccaattaaaccctagaagtgagaatggggagggtaaaaaccagaagcagaattggctgagaactgtttaggaaacagaccagctgttgccctcacctcatgcccctgagggcctgtccccaccacccaggcagaagtctgagtgctcgctcacaggagagactgaccaagcatttctggatgagggactctaggcccagttgaaggtgggggcattttccccagacaggagtgtggggtaaatgcagccttctcgaatgctgaggacttctcccacccccagcttctcctcactcagctctcagaaccacaggtagccaggtctgtagcttgcagacagagtgggaaacttctctgcccaagaagagatgcgtgaggttatttagtcagattccccagcagacagcctagtgagagggcccttgtagatggtcacagtgcacaggcttcaggtcccagtcagctcttagtcttccactcttcaaatgggacaaccaaggagtcccagatacctgaggaattcctgccggctgagagcaggtagagaccaaagcagccgaacagccaaagagcaacttggatgagagagagggaggggtccaggaagaagaagggtccaccaccagctgtgaagagactcagccgtctcaggtgacatcacagctgcgaaacaagaacaggatcctgtatgaagccatggaacaaaaataataaaaaaaaatcctcctggaaattcaaagcatggtagaagtgaaaactcaatggaaaagttggaagaaaagcattaagaaaatctcccagaaagaataaaaaggcagagggaaaataataaaggaaagacttttattttccaaagaagaactagtccaggaggtctagcatgttccagagaagctgagaaaacaaagagggggtaacccttgacaaaataatttttttaaacctcccccaaacgatggatgtgtttccaggttggaaggcttactgaataccctgcatgatgactgaaaatgaatgcacgccaaggctgcctccttagggggcctcagaacactgaggacacagaggacggcagtcgtgtgcaaagcaccagcaaccagaacagctttgtgtagggtgatattgaatgctgaaggcaggaatgctgggcttcccagtcttggaggagggtcacgtccagcctagactgttaggcacagccagatagcagccaggtgtgagggtccaatagaaacattcttagccaagtgagatttcagaaatgttaccacccacacaccctttctcaggatgctggtggaggacaaaggccttggctgtaggaaaccagagatcttgaaacctcttgtttcaagagaggagggaagagtgctctggaatggagagtgctgaggttaaggatgaagcagtttaccgagtatcaaggcaaccagtccagactggaacaggtttcagaggctccaggaaggattacttcaagaaatgaaaattaataggatgcctgatacaaattagcattagcaaggagattttgataagaggttaaccatttgcaattggttttggtggtaaggtcacagaaatataaatcaaaggaacaacccacttctccaccctccataattttggttccagtggggaaggaagcttttcaggaaggaaaaaattaggaagttcactatatggcacaggtcggaagagaaacgtggtgttaatgaagacactgtgtatagccctacctcagatgaccagatagttattttaggaggacggggaatatgaatatgcccgggtaagaggagctcagtcctcttctgtagataacatctaaaatcaagcagtcaaaaggcagttctaatatggtattttggagatgtgtgagatacagaggtaaagaccaagcaggttggcttgaagaagttggaaatagttgctagccaggatggggaaatggctgaaagactctttttcgcttttagagaactcatagaactggttggttttttttttttttttttgagacagagtcttgctctgtcacccaggctggagtgcagtggcgctatctgggcccactgcaggctccgtctcctgggttcacaccattctcctggccaaatataaagactttaacagtgctaggacttggccatgggttggctggatatcaggggactgtgaaactgccgtcaggcgtgtgctggaagtgtctgcggtgccgtgccctctgtagatgagatgggactagttggcgggtgcagctctgttctggacaggagtcaaggtgcctttggaaatccaggtggagttgtcaggatggcagtgtctctgaggattgtactgtctggcggtggggcgatggacagaggcagtgagtggttaatggtcagacccacagctgcagtcccaggcatcggggcgctagggtgaaactaggaaaggcttcctggagttgttgccccagaactgaggcttcagaggtgagtgggagagccaggcaaagggaagagggaaaggggcccgcacactccctgcttgaggaccgtgcccgggtcactgccggccacactctcacggtgtctgttgaatcttctggtctttctactcgcggaggacttagcagttatattgacaatcctcagacatttttggtgttattcttgtttagaatgtaaggagttccctcaggctgatttatgaacttcatgtcctgggagaaagcaggaaagttcggctgagtcaccggcgaggaatctgacagtgtgtgtccttaaactgtgatcttaaacttcctctcttcaactgttctgtaggataaggagccccgtggaatcatccctttagagaatctgagtatccgggaagtggaggactccaaaaaaccagtgagtatttttgctgagatattttgaggggagaaaggggatgggcatttcaaagattttttttaaaaaactcaaaaccaaaaaactgaaaagcgtgatcaggcttttatttagtctaattttttattatattgttcaagccaaagatgagactcgaaatcacttcttcctgtgccgtctgtctgctttatcgtttcacttagtgaatgtcacatggggtgtagaagttgcccctcctgcaatggcagcggcaagcacgcaggagtgggctatgtagtttatacccttgggacacctcccgtttagttttcctttgttttgggctgtcaggatgttactggcttgaagttaaagtcgtgagtcacctgcagttctctccgcattttacgtacattgcaagtggggccagcttatatcaggccggtgtgtttgcaaacgagactgacttctatacaatttacagtctctagaattccgcttctaggcttcacttttccacaggaaaatatgtattccttgtattttgtgaaggtcagaagaaaggggttttggggaaagaaatcagcatgtttctcagttaacagcttcctttgctccactctctccctctctgttttgattctcagaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaagtaagtgactgctgagaaagggcagtgcgcgcctggtgcagccctcacctcaccaggtgttgatcatcttagtggttaaacatgccgcccgcatctcttctgtgctccaagttcttagggaagcttcgtcctggttcccagctgacggcttcccaggaggcctttggattcttggctattatagcatatgtaagagagcacgtcccatctgggttccccacgtgtcctcatagacccaaaataggaagaggcgagtgagctacccacacagatgccatctgctcaactggtctttctgtgtctgacgaagccgctctcattctcatagtgacagctcagaggagatagtagtcatgttctgtaatttgtgaatcctgtgagacaccattttcctagctacagatgaggaaactgaggcccatagaggttaagaaatttgctggaagtcacataccgtgatccaaggtctgggaggagggagaagcttcctcagggttccacagctaagaagtggagctcccaagtccaggcctctgactcctacctctcgggctctgttggctccactgggccacgccatgtaaggtctatcacggggctgggaaatttcctgatgtgacaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccggggagctgcggaagcattttctaatggacacactgtctcttgtgaataggttccaggtcagcccaggagagccatagcagctgctggtgccaccgttcagcaggggtgagtgccctgcctgcagtcaggaggcttgtgcccgagctctggaacaaatcatcacttaggatacagcttccctggaaagaaattaagtgtcaggacttttagaccataagttgcttgaaagtcgagaatggcagacatagggttgtggtgttgccagtccactgcaggtgctccagcccgcggcgcggcctgcgctgctgtctttgaggctgtagcacaagcatgagctcgggccccctccctgtgcaccggagacccagccaggtccagccggtctgtccatggtgccccaccagcagcatcgtgctgggcagtgccgcctgcagagtcatggagccttagttactgagcaggtgcacgtggggggcttggaaggccccactgcattaccatgccagctatcacacaccccgtgccagaggactgcatgtgacacggcttgattacgtggcactcgctgctgcaaagcaaagtcagatgtcatcatggaaactcaagcaccagtctttttctctgaattggaatatagctgtaagaatgtggtatgattctgttcctaaatgtgaattgattattatgttgaaacaggtaaaaaccccaaaattttcttgtcacgtgttcctgtgtctctttcgaagtgtgtcaccttaggtcactgtgtggacacagcaagggtggaggacgctaacttggcctttgcagtgatggtggggtgggacaggtgttctggggcacgaggggcccctgagaaacccctgcctgggtgtgtttcttctgattctgtccctcacgtctctgttttctcccttttctgtgctccagagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctggctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagccatctttgttgttcgcggtgtctctgggctcaggcggggccctcgaggtgggaaaggggtgctgaccggacacttgtgcaggagggtgttactccagctgcaccttgagttcagttgtaacaccttgaaagtgggaggagggttctgtcttctgttaagaagagcagagtcagaaaagataagtaacttagtctttgcaccgcccccacttttttagaagaaacgtgaaacatcagttttaaattaagatcaagaaatatgccttcagtcaatataatacatttttagtatgatttcagtttccagagatgacttcataatgccagggaataaacagggaaaagtctcaggtgggctagaacccagaagcaggggaaggcgcttggtgaaccggcaccgaacagagagacagcaaagcaccaggctggccccttctgtgggtccatctccacgggctggtccgcgttcttccacacagcagcagtcatgcctgatgtttcctccttgcttcaagcccccagtctaccctgaccattccccaggtgactgccccactttactgagaagagacgaccattaggtgtgaagggcagcattcctacctttccacatcagtcagagttgtttttgttccctcccatcgccagaagaagtggcctgcttttttcctgtctcccctggatccatctctgtcaattatcctttgtcttatacatatccccagtttctttccccattaatttctttccctcaaaccacagaaacgcccatctcatttgaaaactccctaagctcaggaacaagacagagatgtccactcttaccacttctattcagcattgtactggaggttctagtcagggcaattaggcaagaaatgaaaggcatccagataggaaagaagagagattacatttattggctggtaacatgacttcataatgcctagctgagccatgggaacggggccactcccaaggctccagaactgtgggaccaccagcttgccgccccagccgggagagctgtatgtaggcactagatgccatcctgtgacagctgcggcatgggcagaacccagcacagggtggggctgctcctggccttgggggatcacattaagatgagtcagagatcattctggagtcttaagatttaatgtctgccctattgggtttcagacttacttgggattggttattctttccttcttgcccttttttcccttttggaatgggaatgtctatctcatgcctgtcccccagtgtattttggaagtgcataacttgttaaatttcgaggctctcagctggaggggatttgcctcaggatgaattgttccttgagtctcactcatatctgatctagaggagactctggactttggacttttgaattggtgctggagcaagttaggacttttggggcagtcgggatggaatgaatgcgttttgtactgagactggcgagtgtgggggaaccagtggcagaaagctacagtgtgaatatctgttccctccaaaactcatgttgaaatgtaactgccattgttacagtatgaaaaggtaggacctttaagaggtgtttagctgaactaaggaaaaatcctgcaatagtaatacatccacgaagttattaaaacgccaataaaatccatttgagaacagttcatcaccccaaagcacaccctgtctactcatcagcagcctctcctcctcttcccctggtcccgggcagtcctaatggttctgtctatgcacttgcctcttctgggcatttcatacaaatggaatcatacactacatgggccttcgcgtttggcttctttcacttagcgttacgtttacacgactcatccctgtagcgtgtgtcagagcctcattcccctttatgcccagataacattcatcgtatggagaccacgttgttattcattcatctatgggcgtttgggttgcttccgcctcttggctgttaggaggcctgctgctgctgcctttc

SEQ ID NO: 16590 - DNA, 112508 bp, Human; identical to SEQ ID NO: 16589
  misc_feature (1)...(112508): n = A,T,C or G

SEQ ID NO: 16591 - DNA, 8256 bp, Human
gtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgagcttatctgtgaaagtttctgtctgactttcgccagcactctttaatacttttactcaagaggatctggagttggaggagtgggagaggcaagggctagggaaaggcatgttggcgggggagtgatgcgccatagccgggccttcttcatggtctgggcaccagcctccccgaccccggctctccagctcctgggcagaggcggggtaatcaacccagcccccaccactgcctctgcagccgccttaaaccggagaacgtccaaccctgcagctcctcaataattaaagagcaggaaagctggtgacaggagggaggccaggggaagggaggaggaagggacacagtccccagagtccctctactcttaatccctgtgacttaaaggttggtgaaattaattgggcaaatgaccccgctaggagaatttgacaagtccatgacttcagagttttacccacgggctctgcttcatcagctgtctccagaggagtgagtgcgcttctgcagaagcctctggaatgtcagcttcctggaacctcgaggatacgggtggggaaggagctgcttactgggacacactggattaccctacccccttggtgtgtctgccgcctctgtggatgtaagcggcaggtggcatcggaaagtcagacctgcctgggacaccagagaaagaccctaagagtcgggggagagggaaaggctgcagaaacatgagaaagtgccactcgtagcggagaggaaagaaaacctcaaggatacggttcccgagcctgagcccgctcccagccttagccccccaaccccaggctccgtcccaggagcagtcgacgcctcaaagcgtacgggacaggaagggggtgggggcgagagtcttggttccccagaacgaacggatccatagcggttcccggtgccgcaggccgcgcgcttctccgaccccagcgcggggccctcgggcgggaatgagccgagccgggacttagcggcgggtagggggttgggtggcgcgggagagggcggcagaaggagggagttcgaagagagttgccgccagggagagtggcaagtgcccgcggtctccttggagacgtgctggccaatggcagaggcggaagctgtttatgggggcggagcgtcgccatggcagcaggagaagcctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggtaagggatggggagggctgcaggccagggggaagggtgggcaacggtaccaacccgctctctcattcgtccttaacggaagtggtgggcccagggactgacatcggagaagtctgggggaaactcgcctcctgccccccgttactgttccgtccccttccttcccaatgatcccctatcataatattccttttcaaggatcagaggacctccaccgcccccgccccgtcgtaccgccctcccaaacttctcgccccacttccatttgttgcgaggaggaagggggtcctgatttcctgctcttcgggagaaaaggatagcctcggatgcccctaccctcttcatttggctaataaaacctcgaagaggaaaggaagagggaggcagatctgatgggggtgggaccccagggccttgcttctgtttcccatacctcggcactaaaagatcctccccagctgcggggatgatgttagagagggcgtccccgtacacacactgtcccctcgggggtggggtagtgctcagctcccaccgtggtcctcgcaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcaggtagaggaggcacgggcggcggccgctccctccccattccctcctcgctccccacgctgcactggattcatatcccaaatctgcaggccaagtaggctctgcggtgcggccagcgccccagaagggagccctgcaaaggagcccagttcttgcaactgcccctcctttgacttccagagagagagagagagagaagggagaatgtccagaggtggagggctttaggggtgcagaggctgagattcaaggggaaataacctgccattcatccagcaggcccaggccaaagaccagggctagactctgcgtggacagaatctccttggggagagcgatgaactgaaggcgcattcttgtcctaagtcctagaattcctagacactgccctgccccgggatggtttgtcggggccgggagtcagaaacggaaactggaacgtggcctccctgccaggctctacgtcctgcccttttgcagttggcttggggagggtggaatggaaggggtgccttagcatgtgagggccaggtgtgtcccaatggagggtggagggggtaaggggccttcctaaagctgctgtcccagccccccacctcaacctctgctcagtttcctgcctccaacccccgctgtcagccaacctccctggggggacaattacctgagccaggtgccttccactggggctctgcctaccacactcacttcgtgttccacgtctctggaaccaggcactgagcagccaaggggcccaggccaccatgtaaacatcccagccttgctgccgggcattatccacccacctgccctgccgtcccagcccaggacccctgtcccccagcaggctttggacaagattaagcacctaagaatggacaaggcaggaggatggtggatttgaggctgggtaggcagtgccctaagagtcttcagccatcaccatcaagggctagttggagtcaggggccccccaaggacgcccagactcttccctgaagcacccaaagcgggcaggccacaggaccgcagtcccaagccatttccaatgcccctgaccctagagcagggtcatttgcagctgcaccgaaaaagcagagaccctcagccccaccctaccctaagcctgtgcagctgcgcttcgagaaacgggccccaggaatgagtgctatgctcttagctcttggctgggtaataatcaactgagcctggagtggggggagggggccgtggggggtgaaggcccaggccagcagccggctcaacaaacaaggaaagtcatcagatcccccacctctcatccctgcgctctctctctctctctccccgttcctctccactctcggctgcccacccccctccctggacccactcactcacagagagggccagccaggcccaggcaaagggagacggtggtccaggccctgggggagccgagggctttggccagaggctgtcagcggcagggtgagggagggagggcaggcgacgggggtggcaccgagagccaccctgcggctcagagctcggatgactgagcaggcagatatcccggcaacagggaacaaaagcctccgacagcactccgggctcccagtgccctgtggctggtgtcccagagctgcagccgcctgggcagaccagtgtgtctgtcccccccctcctctcccctgccagagaaaagatggggggtgcgcagcagcgccaggtgccatttcatctccccgtccccactgacctagcggttcctctctctcttgctctctccctgcacccagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacagtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaatatggacctgctcaaaactttctttgggaacaggtgagggctcagtgttctggagaggcagcgcttctctttgctggagggagggatggctgagaggaagatgcgggggcacttacggcctgcaaagagcactaaccaactccccatgacctcagcatccccggggaggaaggggctgaggggtggctctcggttgtcccctgcagcctaggcctcagtgcctccatctgtgcaatggggagactggggtccacagccctgggggatcaggagacaaagggaggaggagtggcctcagtccccagacccagggaatctcaaaggctaagtgtgccctgggctcggcccctgctgtcccctactgcgagggcctgcccgggcccgcctgccccagtcagccatccccggcctgggctggtctccagcacctccctcgcttggtcctctcctggagggacccagctccagggcccccacttgccacacaacctggcccaatgcaggtttggagaggaggaaggccaccagggaagggagtgagctcagacccacccctcccacctacactggcaggaaccagactaccggagttctgatggggaaactgaggcatgggaaatttgtgtctgggtgacactcagccagcacctttcaatcccccgccccccttgctttgcccgggagccaccttccaactcagtccccgccacatatacaccctcatgggtgcacgacgcctccagaaagccacttcctcgcacacgggcgcacacacacaggggcacaaacaggcaacgtcccaagcattcctgcccagcctccacggacccctttctcccaaagcccctttctttcttcgtcctcggggttggctctaggccaacctggcattcccctgctaaccggctgctttcacttgctaattattctaaatactgcaggagggcacgcagcctgcagggtccaggaaggcaggctgagggctgccccaattcccttcaccccgcaagcaactcccctctccttttccccactgtccgcccccttcctctccatggaccccagcaatgggggaacaagctgggctccagccttctccccacaggatcagcctccagctttggactgacaggctgggcgtgtagctgtgtgccccaggcctgtgctggggggaaggggggcaatgtctggggcaggcaggacaccccactgggggagcaccaggcctgagaagcagatcgaggtttgccccagcttgacagtcacctggaggctcctgaaaaatcccactgctgggctgcaccctggaccaattagaccagaatttccggggtgggacccaggcatcagcatttgtaaggtccccagatgtttccaatgtgcggcaaaaccgagagggggccctggagagggcatgactttcagcaggccaagctggggagtggcgagagtgtgggctaggagctcctcactcctattcacccctgccttgcccctcagtggggtggctttttcgtaaaaagatgttcatttacctctttttttttcttctttttttgagtcgtctggctctgtcgcccatactggagtgcagcggcgcgatctcagctcactgcaacctgtgcgccccgccccaccgggttcaagcaattctcttgcctcagcctcccgagtagctgggactacaggcgcccgccgccacgcccggctaatttttgtagttttagtagagatggggttttaccacgttggccaggctggtctcaaacttctgacctcaagtgatccacccacctcagcctcccaaagtgctgggattacaggcgtgagccacctcacccagcccatttacctcttatttatttccaggttcaatgtaatcccaaccaaaatatgttttgcaccatttgacagtacgttgaagacctgactccccataccactaaatacttcagtaagtatttccttaaaacaa

SEQ ID NO: 16592 - DNA, 11690 bp, Human
tgcctagaatcacacgagtaaataaggggtgaagatggcattcatacacaggtagttttattagagcccattcatttacactacatagattcaggaatgaggtggcatggagtgactggggccatggttcccaaactgtgccaaagtacaagctcacaagggtattgtggaatatttttaattttcagaggaaacacagcaatattttatatttcttaaacactgtgtgacctattaacttgaggtgattcacagttggaacattagattgtgctacattccttttgatgacaatatatctggccaggtgtggtagctcatgcctatactctcagcactttgagaggccgaggtgggcagatcagttgaagtcaggagttcaaggccagcttggccaatatggcaaaaccccgtctctactaaaaatacaaaaattagccaggcatggtggcaggcacctgtaatcccagctactcgggaggctgaggcaaaagaatggctcaaacccaggcagcagagattgcagtgaggcaagatcgtgctactgtactccagcctgggttacagagtgaaaccctgtctcaaaaatatatatatatataaagacaacatatctttacaaaagatggttttagaaggtccctctgataaaaattaagtattaagtaaaaaaaaaaagtactgtgtaaaaatcagcatggaacagaaaatgagggtggcagcattggattcctgcatgtgagaagttgagtagtgccaaacagatgtacatatcccgtaagtaactgtttgtggttatttaagaacgaaatttttttttcaatttgtgtgcattgttattttcaaagtgctagtaagttctcaggaaccagctactcactctgttgcccaggctggagtgcaatggtgtgatctcaggtcactgcaacctccacctcccgggttcaagccattctccctgcctcagcctcccaagtagctgggattacaggcgcctgccaccacgcccagctaattttttgtatttttagtacagatggggttttgccttgttggccaggctggtctccgacacctgacctcaggtgatccacccacctcggcctcccaaagtgctgggattaccggcgtgagccaccgcgcctggcctttatatataaatttttttttaattttttaaattaaaaattaaatgtaaatttaatgtaaaaatgtaaattaaatgtaaaaattaaattgtaaatgtgggcagaagtaatagttgtattctaccaaagacacgctatttatgttatattctggtacccgtgtattccgataacagaattttcttcgtgggaggagtcctctagttacctgaattgcttggatcaatattgcgcagatcaagggattatctgtgtccctacccaccaaatccatccttatcctttctgtcggcatctaggaccccggaattcttgcctgagaactttttcttctcccggtctgggcctggatgtgctctcctaaaccctgtatcctccaagttagcactgttgccgggggcgacccagcttcccttgtccagggagcaactcagacacagtctcgcttcatttttattctggggttgtacaatctaaggtatgaaatttttcctttttgaatctctcacggtttgctattgacacagctggaatgaggttgcaaggagagggctgggggctctcctccctacttctagccctatttccgcataggccttcttgctgggaactcctgccctgcggactggaatgggtaccgagatgaaatgctgggtgcgctccggctccccccgcccgccccggggcagaaggtttagggctgggaagaactctgattaggtttacagcccaggttcagccgattgaattagggtgtgtcaccatggagacagggccggcccgcgtgctcgcttgccattggctggggactccagggcaagggatataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacgggtgaggagggcaccaggcccgcaggacccttggggaggggcaggtgctgtgacccgggaacctggcacactgggcccagagggagctggcggagggagcgagcgcccaggggatgcagagaggcctggcactgagcctagtgtcgggagcaaggcggcagagtcatgcggcagccagcgcgggcagggacgcacgcgggaatcgagctggggtggcgccaccggagcaggaaggggacaggtcggtgcggtctaagctactccgtaaaagcagccgttgtgtgtctccgtgtgtgtgttaggggaacaagtggagagtgagtatatgtatatatccctcactccataccaggaggaggtctcctcaccccctgcgctcttcataaattcccatgctagggtctgggtaaagctgcgaggtacttttggtgctcaaattcggagttcctcctttagaggcaagattactcacctcctttgccagttgcactcctcccttccttccagactggcagtatgattaactcggtgggaagtgactgctaagtggagacggaaatcagtcaccgaactgagcaacagtcctgtgctcacttcccccaccccacgcctttgaaaactcttctctcggcttgggtcctggatatcccagtccaagtgacctgcattaggcatcacagttgcttttggatgcccagggagccagggtgttcttgaggggactgatagccaatgaggaagtgctgtgagatgtggctagacatgccatgtggcggcagcttcacacattcatttcctttgcaccttttggggatgccatttgattaacattttaccagcttaattgcttctctccattgtcctgtggctccgttgaccagcccccaacctacctgatccaactgcttccctgagggtagcctggtgtattgtgcaatcatgtctggtttcccgggctctgctttccaagtaaaaaatttcctgtgaaagcttggttagttgtgttcagctctgtcacacctcattgccacctctgaaagcaacgtttggtcttcccagatggatgtgagagaactggacttggaactgggagaaaagtaacacgggttgattcttgctagtgtaggggttctgggtaagtgccctgaggtttctgaagagcaaagatcctcggtggagagaaaggaaactgggaggaggcagggagggggaaggacaggaagaagaccacaggcaggtggaaagcaggagaaagattcaaatactttgtgtaacagagccataggtctttggaagttgttagcaagtattcaattcattttcagattgagcctataagatagatggggccaatttacatcccttgtttatacctgagaaaataatttaaagcacaaattacatgcctaaaaagacaatattgggactagaatctaggtcgaattctgcttccctccagaccagcaattcctaaacctggttttattttattttatttttatttatttattttggagtcggagtctcgctctgtctcccaggctggagttcagtggagcgatcttggctcactgcaacctctgcctcccgggttcacaccattctactgcctcagcctcccgtgtagctaggactacaggggcccgccaccacgcccggctaatttttttttttttttttttttttttgtatttttagtagagacggggtttcaacatgttagccaggatggtctcgatctcctgacctcgtgatccgcccacctcggcctcccaaagtgctggggttacaggcatgagccaccgcgcccagcccctaaacctggttttaaaatcaaaattacatgggcttcagaatctgttttttgtgggggttttgtgtgtgtgtgtgtgtgtgttttttatagggtctcactctgtcaccaggctggagtgccagaatctgtttttctaacaagcttctgctgagaatttgtgtagtcagtcctggtttaacctttgacaaccagtactgtggactgggtctgcttttttgtacagcagtttatctagttttttgtctggaattaacccccttgtgatccagggagctaagaatggcacgtagacctctaccaggggtggtcccattgtgttttattggttaaaacaaaaaagaaatgtagcccttaagtctttggctgaggaaggaactggaggaatgagggttcaaaaggaaatttgagtttatctctgccttcatagtagttggtcttaattacattttgaatgtctttggggaacaggtaaggtaataagggggattttactaggtgggcaccaccctcaggaagggcttaatcccattttgagtactcttcttgggctccctcctggccaagcccttttaccctccctaatttgattatttccttgcacttccccgtacactctggccccttcctctctaaacctttgtcataaggataagtatgcagcttgccagtgttcagtggatccaacactggagttgggcctgttagtagaaacaggctttattaacttttgccaggctctagaatggaggtagtttcatatcagacttgtagtgggcttgattcagaaagaagggtggctgagtagatggaagagcatagtatggcctttccctctgtgccagcttctccgtccctgctgcctcagtatacctgccagcctttttgcaccgaaggtcatttgtctgtgatgcccttggaatgggagcagaattcaccttgatattttttctcccccagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacaggtactggcaagggaaagtggggaatgggactgagggatgttcttggaattctgtggaacacaaccaaggaggccaatgtttctactccttgacctagcatttcactgaagacaaatgttgtaagagaggagaaaagcccaccatgagtcagagtgactttaggagatgcctctagcagacatcccataagagacaggacatgtgtgtgtcagtggactgaggctaagactcagaagagggccaggtgacaggggccaagtaaagggcaagggttgtttatttggtttacgtaatttctcaaataactaacttctgttggtttatttattaatttttaagatttctatcttcttttccctggagagttaagaatttttttttaagacctgtcagcaggaaaagacctttaatagctatttttttaaactctttaacacaagactggaagagcagagggagaaggtgagggaaatattaacagagggtgtgtgaagggcatacttctctaagggagatagtagtgacgctggctccactggccactcctacccccagtgagaagggcactgcattaaatgataagtgggttagtttttttaagcttatcaacatgtttattttttatactccacttgggtttcctttgtcaactttattactgtttttgttttgtttttttgcataagctcctctatctttgagaatttctcagctcttcctcttggttctagtccctctcccattccctaagggataggttggccgtctattagaagtgactgccagataaaagaaatggtaataatggctgttatgtctgtggggagttatctttgcactcccacgcacccctccgtgggcatgtgttcccataggactgttccgtgggtcataaggaaagagacacttgcatgcgttcaaattctttcccccttgttcagtagcctcttctttaagaagccagagtaagtatactatgagcttgcttgctggactgaggaggcaggtaattaagttagggcaatagataagaatacatgttttgagaactttgaaaaatttgaagaggtctataattactgcattcactgtactcactttattttgaaacagagtctcgctctgtcacccaggctcgagtgtagtgttgtgatctcggctcactgcaacctccacctcccaagttcaagagattctcccacctcagcctcccgagtagctgggattacaggcatgtgccaccacacctggctaatttttgtatttttagtagagatgaggtttcaccatgttggccagggtggtcttgaactcctggcctgttgatccgcctgtcttgggctcccgaagtgctgggactacaggtgtgagacaccgcacctggcctatttttaattttaatttttatagatttacaggggtacaatgcagttttgttatatggatatactgcgtggtggtgacgtctgtgctttagtgtaaccatcacctgagcagtgaacattgtacttattaggtaatttctcatccctcatccccatcccactttctcacctttccgagtccccagtgtctattatttcactctgtaggtccatatgtacacatttggttcccacttataagtgagaacatgtagtatttaatcttccatttctgagtatctactttttttgctcactttttactctctggcagtatggcttgtattatcttgaaatttctttaaaaagcccttccttctttgtgtgttcatgctgaacatgctgaacgcaccccatatctctaatcttgggttgtatttgtataattattagtaatgcctggctctctcaccagacttaaactttctgaaagcagagataataatgagtcttttacttaattacaacctaacattttgagcagagcgagtaactcacagtaggtgcttaatggatatgtgttgcatgaaaatataatcccattcatttctctttctgttttgtatacagtgccaggtcatgctggccgactggtgtttgggttcctgaatggcagggcctgtgtgatgatgcagggcaggttccacatgtatgaagggtacccactctggaaggtaagtcagagggataggtccggttggatctggaagaggcaggagagaactatctagcctctttcactacctagctatctgggctaggtggatttttggtcctctccttccttttctttcacgatgtatgtcatgcatttcagtgtagctgaattaatgaaattttgtaaatttttttcggattgtttgcttcgaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtatgtatgttactccgttttttttaggtgggtaggatttaaagacttctctaggagctgtgggagaatttttaaaattccgtttatgtgagataattcaacctgtgtcctaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggtgagaaggggaatttggctggaagcttgaagagggaggggtttagcaaaatgggaaggggaaggagtaggaaataacaggcctcattggactgagaggatctgatttcagggaagggtgaattaaactgacttattgaaatacaaactggtgagatttggtgtagcatcaaatctccctacgaagcaccaaggggttaacagctgcagtgctaatgaatgatctatccatgatttgatgactgttttttgagacggaatgtcgctgtgttgcccaggctggagtgcagtggcatgatctcggctcactgcaacctccgcctcccgggttcaagcaattctcatgcctcagccttccgagtagctgggattacagacgtgtgccaccacgcccggttaatttttgtatttttagtagagacaaggtttcaccatgttggccaggctggtccttgaactcgcgacctcaggtaatccgcccatcttggcctcctaaagtgctggcattacaggcgcgacgcactgtgcctggccaatgtgatgactgtttctaagaattctaaaaaattcactatagccaccttctgtacctctagctggaagatggaactctatcattaggattgagttcaaaattgccacaaatatagaaatgaaggattgtattggtaattttaagaaatgtgtatttattttaggcaatacagaagataatttagctgcttctttggatttgttttaggtggggccttgctctgttgccaaggttggagtgcagtggcaccatctctagctcactacagttctgactgcctgggctcaaacaatcctcccacctcagcctcctgagtaacggggaccacaggcgtacactaccacacctggctaattttatttattttttgagccgaggtctctttatgttgcccaggctggtctcaaactcccgggctcaagacatcctcctgccttggcctcccaatgtactgggattacaggtgtgaaccactgcacccggccatctttggatgttttttgagatttttaattcttgttgaaagcgaggctaaagggcaaggaaaagagttatttgaggatcctgacagttggtttccatctttctcactatcaggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttcatttttttgtgtaacttggtatggggctggggcacagaccaagattgacatgaaaggatgtgagatcgcatgtcttgtgtgactatctgcttctcagacaagcagttaggaactgagatgagatagtatgtgagggcagcaaaggatgaagaagggcaaaatgatgaaaggtgaggtggaaagaggttatgagatggtaaagaaaagttaacttctggcacttgattgccacttccgtcaggctggtcctgcctctctcccttgccttctgattgtttcatttcctgtttatttgatcatatctgaattagttcactggttagcctcttccttagttcccacttccttaccaaagccctaattatatttcctcttgtttgccttttctctcctactcttctctaacatctgcagccacactctccattcactccatgctgacaaggcagtggcaaacacttttctctgctgccagccactccactgttgactggattgctgccagccccaggcaaacctgtgaagttgtttcatactctgcttctctttgagtgcctccttctctccttcctcttcctttctgggctccagtctttctcttcacttgtgcttgtcagaacctccctgtgatactgcctccaggcatttcccccatgttggctcaccgcactattatctttgcttatcaacttgcattcagctggctggcatgtttcaaaaccacactgccctcccaggcctgtgtgccttttgagaaagaccagtgctggatgagcctctagtaatgacaacattttagttgttagtggtataatacggaagagatattttgcacaggctgctttggagaactttcaaattatcctttgtttggtaactgacctacttaactgcccaatacaaagaaaaagcatcttggagtggctctgtctccttttttttttttttttttttttttgatacagggtctcactgtcacccaggctgcagtgcagtgctgtgatctcagttcactgcaacctccgtctctcaggctaaagtgatcctctcacctcagcctccagagtagctgggaccacaggtgtatgcaaccacacctggctaatttttgtattttttagtagaaatggagtttcatcatgttactgaggctggtctcgaactcctggcttcaagcaatcctcctgcttcagcctaccaaggtgctaggattacaggagtaagccatcgtgcctggccttgccctacaatcttaagattcatttacaaagccactgttgtataaagcttgtacaaaatgagtacaagtcacacgtgggagctcaaaggagggattgattgtatacaccgaacagtgtgaattgggtagattagggaaagctttttttcctttttttcttttgcttaaagtgatggatacttaatattaggtaaagttttatagaaaactttgagcctagtcttgaaggatgaagcaggggaagaggatttcacatcaggatgaggcaaagcagagctgcaaaaagtactaggcatgttcgtgagtcgttgtcacaactggtgggactagatcaggacatggaaggctccggtgagacaggcagaaaggtaattggtttgaggagggctgcatttggcacttggctttcctacccccagtctccctcttggtcagattgaccaggaatcacaatggggccatctgaaaaatatgtcctagagatacttgagtggaatatttaagagtggaatatgtaagctttttagacttagtaagtagatttactaaattcatatttatttatatgaagacataatgtcttcagtttcttttttaaaaaacagctgtattgagataaaatttacgtaccatagaattcacccatttaaggtgtgtgattcaatggtctttagtgtattcacaaataagtgcaattattgccagttaatctgagatcatttcatcacttcaaagggaaacgttatctgctcccccatagcc

SEQ ID NO: 16593 - DNA, 4988 bp, Human
tatgcattgttcttggggcaaaaaggaaatcaaacatctgcccttcctcccacaacctctttacttccctctcttcctaacactgtatctcacatctacagctgcaggcacacagatatgacatacagcttgatatctttatgtgcaaaggcaaaagatggctatggatataggaggtggcatttaaaagaacaatatccatgtttgatactgctttcattatcaataatgaaaaggtagcctttcagcagaacaaagtaaggtacaggtcgtttggaagccatttcagtcattcacacagtgtgatccaccattacgaagcagaatttgaaatcaaaagacaatagtacccatatacatcaaactaggagttcaactggggtcagtccttggactgcacatacagagttgggctgcctgactctcaaaacattgcccttgctaatttgcgttgctcacttcctattgaatcagggatgatttttctttgctgtagtgaatcagccctgctacactgcaagaatcaagccgattcacaattcacatcaattccaggagtgacggccagatggcagcatctggctagtcagttggtgagtgagtccacctccaatcttgattaaactctgctgctgggaagtagcaattctgagcataaatgtctttgatatcctgaatattttgggtgtgggatgagagaggcagtagatagtggaaagagcacagggtgtagactaagataggcctggattcctttctttaatctgtcaatgaaagcaatgaatgttctgaaactacatggcaatgctttttttgttgccactctggcttttttttttaatgctataaaatatatgcctatttttcactgccaagaggtgacaacacaatgatgctgcaaccagagaagacagacagctaccaacaactattgacaagacagaaggaacatcaagaatagatgcaagacaaagcaatgtatctccatggcctagattttttaggttatgcatagaaacagcaaggagaagaagacacaatccaagttttcttttgagaatattgtgctgtttaaatttattttttaaacatttcttagcttttcttattagtcaatttcataagcctgggaaacatctttactctatccatttaattgcatttgttcattagcttactcatttcacttattagttcattcaaacagtagctattatcaactgtcttctaagaactgtatctgggtattctggttttgcttttttttaaaaaatagaattaaaaggatttccaaaaggacctgattttacattagaattagaataatacattttaaattaatgtataacatatattattctagaattagaatagattttaaatcacattagaataatagccacatgacaaaaaagaaaagaaaaataataaaattaatgacaaagaaaaacaatagtcatgtgagaggaaaggcaaagcctaaatattcctctgtcctcttcctccacctagattcccagatgtaaggtattaaaagtagtttgtaaactttctgtgacgtatgctgagtctatccaaactgtcgggaattggagcctcccgggaaccaaacactccccaaagatcatacacctacggagttcccccaagagacacacaactgcagtttcatgtaggttcaccttttctctctttttatactctgtccacacaaacctggcagccacgcagtcagtccctgccctgtgtcattgtactggccacagcaacttctctctgtaaatgagaaaggtcttgctttcagaaaagatcatgtttgcaaactactcactcttgaggaagaagggtgggaaaagtagcagagatgagtggggagatggtgcatataagaaggaggaaagaggagactatggagtcaggatgccggcttgctattctcaacacctttttccagtgcccagttcttaccttatttctcctgccccttgctttcttttctaggcacctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagctctctcagatcctatcctgtggaatttagttattatgtgtatttatgtagtatttcaaacatttcaaaatgctttcatctatgtttatcacattttaataccacagcacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttaaaattcacctgtcagggaggcattaaaaatttggaaatgtatgccagcaaaatgtgagctctgtattttttggcattcttatgtttgggtttaataagattaagaaaatgatactgggaattttctttttcctgaaactttgaatcaccctagtaagtcaaagtactaaaaaatgtactagatcattaagacttatgtgctcttactgattgaaagattttttatgttttccttgtaataaaggacctaaaccgaaggtacctgagaagactgtgctatggtattattttttttctctgacttttaaattcttgtttagtttataaacatgcatgcaccttaataacctcataaactctggtcaaagactaatgcctatcagatccatgaccacaacacagaagatttgtctcatttactccagagagaatgattcctctcaaagacaattctcacagctcttccttctcccttagaatatttagaagcaaattagggagctgtcaggtctctgagcccaagcctgcacgtatacatccagatggcctgaagcaactgaagaaccacaaaagaagtgaaaataaccaattcctgccttaactgatgacattccaccactgtgatttgttcctgccccaccttaactgatcaattagccttgtgacattccttctcctggacaattagactcaggagctccccaccagagcaccttgtgacccccgcccctgcccgctagagaataacccactttgaccgtaatttcccactaccaacccaaatcctataaaactgccccaccccatctccctttgctgactccttttttggactcagtctgcctgcacccaggtgattaaaaagctttattgctcacacaaagcctgtttggtggtctcttcacatggacgcgtgtgacatttagtgccgaagacccagaacagggggactccttcaggagactggtcccctgtcctcgccttcactccatgaggaggtccacctatgacctcaggtcctcagaccaaccagcccaaggaacatctcacccatttcaaattgggtaagcggtcttttcactgtcttctccagcctctcttgctacccttcaatctccctgtccttccaattccagttctctttcctctctagtagagacaaaggagacgcattttatccatggacccaaaactcagacaccagtcacggactcgggaagatagtcttcccttggcgtctgatcattgtggggatgcctgccctgatcattcacccacattccattggtgtctgatcactgtggggacacctgccatggtcattcacccacattcccttgatggcaagtcaatcgcgggatgcctgctttggctgatcgtccacgttatagcccagggctgctcaccaccccctttgctgtgtctctacctttctctttaaacttacttcttcactgtgggcaaccttccaccctgcattcccccttcttctcccttagcctgtgttctcaagaacttaaaacctcttcaactcacacctgacctaaaacctaaatgccttattttcttctgcaataccgtttggccctaatacaaacccaacaatggttccaaatggccagaaaacggcacttttgatttctccatcttacaagatctagatgatttttgtcgaaaaatggggaaatagtctgaggtgcctgacatccaggcattcttttacacatcagtccctccctagtctctgctcccaatgtgacttgtcccaaatctttcttctttctctcctgtctgtttcttcagtctccaccccaagctctgagtcctttgaattctccttttctacagacccatctgacctcttccctcctccccaggctgctgctcaccagccaggccaagccaggtcctgattcttcctcaccctctgctcccccaccctataatccttttatcacctcccctcctcacacctggtccagcttacagtttcattccatgactagct

SEQ ID NO: 16594 - DNA, 4960 bp, Human
ttatggtctgcttaagacacttcaataagtctgatatgtcataagcacagatgtcttcaggagccaggcaggtgtcatcactgaacagataggataaaagtcaggagggagagtggagtcagagaacagccctgagctagagccccttccacagacgcagctgttactcagctctaattgatacaacaccaatggtgcaccaaccaccatcatgtgatttttaaagataagacagtaatgaaaacttttagtgaactattccaatgtcaaactttatcttccaaaccaaacatcataaatagcattgtgtatgctgaaaagaagcactgtttagccaagtacctgccctggggctgcagtctatgtcttttgcctcatactatagacacttaagtgcaaatgtttctagccagtgtggctgtcagcatcacagaggggatactctacgtatcattcacctttacattctcatcacctacaaaaatgatctccacacaatatacatgaaaaaataaacttgcctcatgataaagctgctaatgaatgtcggccagaacaggacttcaaggcagagcaatattagctgcgcattgagtcctcaccaggtcaccattgtgtccacatttacctaaggaccccagtgataaaattattgcatttctaaatgacaggaaaattggacggtagtaaaaattaggcagattaactgttggaaggtatattatatcatttaagggtctactttccattttctaatctcaaagctagaccagatttaacatctgttagtacccaggccttacctttgcaattcacttctcacctctgtacaatttccccacatcatcccctgtgcccagaatgctcatctcttctctaaatcccctgaaaatcccctgcttatcctttaggacctgctgaaataaacttttttttgaagttttccttatttctcaagccaagtgatttccttcaccagcagtgtccctatgacaccatgttcacacaaatgctattacctctatcacactgtaatacaattatatgtctacaagtactttcctgtgtttctctgagggccaagaataaatgtatgctttgtgtatcaaactgtacacttgacctctatactttcaggaatacagtgctctgtccttaaatgttcatttgtaaatacagaaccatattcttgttaatatcacaaaatgaaacttaccaggaagatgaatgacaaccccagaacacactgttttgtagaaaataccataggctgaaaagatcacaggaataccgagtgctaggttggaatctttcatgacaccaaatgttcattcatcctctgccagattttacaactgtcctcggtgtgtttttaggttatgtaactttacacaaagtggaatcaataatcagggcaagacttaagagaaagtggatccaatgcaagaggagtaaagaaaaaaaattcctcaattgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggtttctcctgggcaaacagccctctgtggctctatttctcctaactactatgcctgccttcgtgtcatttagtcatttaggggcctgccagaggacagttataaaatctgtggtcattctgccagcagcgtatagttttcacccagagtccagatcccaccggcaaaactctgtctaacacaggatgacttggaattagagtccgtatagcagaaagagcagcagggctgtccttgggtatccgttgctcagccaagtcatcaaataaaaaggatgattgcacaagtggaccatgtgtcaatctgtgggtttctgcatggccagacccaccaagggaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggatcggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcatctggaagtgtctgtgtgtcttcctcggccgctctgctgtcatttagtgacaatctgctctagagatttgggtttatcatgaatctctccccctcaatatctgaccaaattccttgattcccccatcatccttcatgtgatacctgattccaggcctgccttaaaaaaaaatccaattgagtcaacttagcattggtctccctagccttaatatctcctctaagcaattttccatccactgactcctcccccaacaccaacctataacttgtgtatagatctccacttgttttagttgtattccagaattgagcccaatttgatattgaggtcccatttgatgctttatggtccgactatggtttttattgacatgatttctatcccaagaaaaaaagagctgcagtgaatcagctgaaaatgcacgtgcttcattatgatttatgaatgataaattttgatagaattgaacgttatgatagaaaatagaaaagaagaaagtagaaaaagtcaagaatgctataaataaggtgaaaccaagataaagaaaagtttagcctcagggatatttcttttaaatgggcacatcaagtctccagctattagcaatcgtaatagaggtggaaccagggtttgagtcaaatgtgcaataagataaattgttccgacagcagtaaggacagattgtaatgctgactggaggagaggtggacatctttcccaaaagttccatgtcctggagatggggagccgctggtcacgtgggaaggagaagggggaggaggaggaggaggaagtgggagcactcatgaaggtgagttggctcctgcccattctgccctccatagatgttcccaatggcgagtcaaaggttcattcaacacctgtcaggaagggcacagcctcgagaattcaggatttgtagacccagagagagaagaaatggatgatgagagccgctgccctggactccaacacagggcttcactcaggaatccatgagaaacaggggagaaaaaggggaagccccttcctgcaagttgtggacaggtgcagcattcaagtgattgttccaggaacagagtgggtctttttgaatggcccgactcagaacgcaagagaggtacgatgccatcagatctgcaccttggtccttcagtctgagatttctgacttctatatttctcctcctcttccagaccctgagaaacagcaatttccattcctcagatgactccatgtcagtaatggtgctttaattggcatcagacagcagctgtattgaagtctctcctctggagaagctattgagatcttgcttctccaaggtcgggctgtgaacttaaaagtttgcacagagacactgagtttgggaaatctcagtgctcaacagaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatctctaaaaccacaggatagagggatcagtccccacctgcccccacaccctctccaccttgtgacttcatcctctctcgtcattcattccttcgttcattcattcatccagcagtcatctactgagcagataccttgctccaggcacagtttgagggagtgatgatgcaacacaaaccaagacaggtccctgctcttttgaggccacattatacaaggataaaaataaacatacaaaattgttctaagcatacaaaattttgctaagtgtcaggaggaaaaatacacagcatagtacacagaaaattacacagagcagcacaatatagaggttctgtatgtgccacaaaagtgacagggcagagtgtcaccaggaaagacttatctcagagaatgaaatctgaacaggaggaaaagcagcc

SEQ ID NO: 16595 - DNA, 20608 bp, Human
ggacgctgcgggtcgtctgcctcgccgcgcagctttgtcctgccctgcactgagctggcggaaagctgcccacacccgggagtggcttcagccttcggacccgggagctagctgacggtggggcgggggcgcccggggcgcgattgcagggctggcggggagcggtgccctccacctgacccgcctggcgcctcccatgagagggataccgcttggaatcctcccagagcaggaacgctgcgcagcgccccctccctaggatcgtgccaaccccctacccctccgcgcaaggacaatttccccgtctcgtaggacagtgacacccctttgtgccgccgccttgcaccgtgacaggtctcacgccatgcggcaccccctcctcttagttcagtggcaccccgcggctcttcttccttagacctgtgacagcccccgcacccccatggcaccatcttttcccacaatgtcctccccaaggcgaaaagcctagcaccctctcattactctgcacctgaaccccaagcaggctctgtctccccagctttcccttattcaccactgtcagttcccccggccggtttttccttcttaaagccttgaccttttccatactggaaacccttacctttacgttcactccaccagcccagtttgctgctgtgggctcacctgaggacgctgcctggctttcactgaaggtctttccccttaactaaatgttccattcttgcccaaggtccccctctggttctcgggtgcccttcgctacctaccactcgatacctgtggacttggtgctttgccccaggctctacctccattttgcatctcctctcccagcctgtttgggactgagggatgggatgagtccaccaccttgagagaccgctcacccctctggaagaccttgacagccacaggaaaaggctttattttccagtttagaaaagtcctctaaagtactccctgtgaaattaataccagggctaatccaggaaatctaaaaccaaattaatgccttttctcaaacagtctaaattaatttgacccaaataatttggataattcaggcatcctgacatccctgcttcttgcttataggcacccaggccagaaatgagttacttcatgggcctggaatcacgatttcagatggaaggatttcttaattttatgagcctgcgccacccccaccccccagtccttatttttattgcattccagagctttttgaaaggggggtggtaatcagaaataactgtaataagcagcttgggtgatggaagtgtagtctgccagccctaggaccttcctcctgtgccctttgcctgcttattccactgcctggaagaggttaagccacactcccgggtccacattagggcctaagggctcccttctcttctccttataccctttcctggaatgtttgaattctgtgaattagagtgccggaagttcaggccctgcgaccttctctgaagggtagtggagcccaagagactggatgctctaaaggttatgcctgggggccccaggcctgaaccaactggagtaatgcctaccgccattcctgcagccgcaggcaggcaggcaagccttagtgagtcactggcgggagcccgagagtctgcacaggagggggccgaaaaggatcattcctgagctcagtgctggggagagggggcgggggttactgatgctcagccccaggaaagggagggtcaaaatggccttagaatcctgggcctaatctctctctgtttctttctcccatctagtgtggaataaacaggaactggagcctggctgaggggaggggcatgtctgggagggctgcagggtcacttactaaagggttgagtcaggaaagaagctccagtgacctgcacagctccacaggggatgttggcagcgattctgaggtcttcttttaccctgcccccgcctgtcctaggtctgttctcagagcgatgggccgcggagactgatctgccgccatgattggaggcttattcatctataatcacaagggggaggtgctcatctcccgagtctaccgagatgacatcgggtgagtcccctggcggagccagctgtgccccaccactccagccccccagccccagcatacaggattaggtcttttcccaccattggcttgacttgggccaccctgacccctggctgcaccctggaagctcagctagtgtagcctggctcccattaggtctggtggtattggcccggcagccagcctgccagcccctaggtgggacctgtggaatggcatggtcccacagctttaggaactccttcccttcctgcatcctgtttctctagttacagtgcctttgcccaggctggtgaattccttctttgaggaggaggaggagaaatgtctccagtgggtggggttagtggccacgctggaggcactaatccatctaagccttgctctcagaagcccttcccatatcaaacgccttcactggattctgttgaaagcccctccaggctgcccaatcctctcctgctccctttctcaggagtcgtcaggctgctgactcagctgtcttcagttcctctggcccattccctggggagtggctggaagcgtgaggcactctctgggtcactgtgggagggcagggaagccatgctaccctctcagtagacccagagcagctccatatcctgggccttcacacagagccacagcctgccttctcattctgcgcccccttgcacgcccttgttctttgcgactgaagggacctatcctagcctccgaggcgctaaagagtaggctcctctggttcctgctgcctgtttttcttcctcagagagcttgagataaagtcacagaatgggcctgtggcagtgctcttcatttggctccctggctgatgggctggcttggcccttgcgggcgtttgtccattggctggtggtgtggcatgagctagagctgcagctgtggcaaggcctggcctgtctgaacctggctggctacaccccccaccccagaccccctcctgccttggatggactgggcaagccaaggccaggtcacacgccgccttgcctgtcttgtctgcttctgcctcacggtgtgtgccgccctcccggtgtgttgtgtgtctaaccctctctctcgttgctatcactctcctcttcttgctggcgtcatttctctcatcccatctcattggctgccgtagcaataggtaagcggcctctcaagctgctgcccaggtacaggtgggtgggggcctgcccccatcgttttcctgcatcctttttcattccctcaacttgctctggagttggatcctgggcaagaatgggtagcacaattccatggccccttggtacttctccctcctttgtgacttctgaagccatgctggctttgtctaacatctggaggagtcggccctccccactggtgggatcactagcgggaggactgaagaagcagtgtctctttctgtcctggacctgggagcttacagggaagctagataaagctgggaaattagggccagccctgggagtaaggaatatctgtctctaaacctgatgaacctcactttattaaggttacatcagccttaatagttgacttccctatttcttgtggcctttagacactagcccagctcaggcactcttcccatgcctccacagggagtcataagaagggaaccactccagtggtttaggcattggctttctttggagtgtgtgtgtcagacttctgcagaaaggagggtggggctgttagcagctgtggttgatccttatggggtaaggttcacctgggtgctgagcaggccctatgcactcttttccctcaggaggaacgcagtggatgcctttcgggtcaatgttatccatgcccggcagcaggtgcgcagccccgtcaccaacattgctcgcaccagcttcttccacgttaagcggtccaacatttggctggcagcagtcaccaagcagaatgtcaacgctgccatggtcttcgaattcctctataagatgtgtgacgtgatggctgcctactttggcaagatcagcgaggaaaacatcaagaacaattttgtgctcatatatgagctgctggatggtgaggctggcgggctggcacggcagcgggcgtagggtgggaaaaaaccaggctgggcctggcctgaaggtgggtgtaggtccgaggctctggtacactctgaactttctttcctgagtatttggtctcttgggctaggatctctatgcccctcagaaggccagttcacatccagacctgaaggctggtctgaagtagaacacagaaataggccagcaggtgatcttccaaggggctaggaacctgactcaggtttggtggctgaacctcctgtattcatcctctttcctttgtggcttggaccttagttcactaactgtccacccagttttccatctcagcagctgcttcagagcctgggggagagtgagatattacaagcctcttggggtgcactgttatctctgttcctctgtagagtgtgatctaagagaaggtgaatacttccaccttcccaatgtctattttctggagaaaacagctcaaagcttcttgacttgccacccactggccatgtgactcttctattgatttcttttcttttttttttttttttttgagacagggtcttgctcttgtcacctatgctgagtgcagtggtgcaattgcagcttactgaagcctcgacctcctaggctcaagcaatcctccagccttagcctcctgagtagctgggaccataggcacatgccaccatgcttggctcatttttactattttttgtagagctgggtctcgctatgttgcccaggctggtcttgaactcctgggctcaagtgattctcccaccttggcctcccgaagtgttgggattacaggcatgagccactgcacctggccttgatttctctatttgaaaaaaatcaaacatttgaattgttttcctgtaaagcacaaatcacagaataaatgctacaaagctagaagactttcttgcggatgatcccacatgggctttgggagctgtgccggtcagatgtgtaggcccaagtaggggctggaatgaagaagctctgtccaggggctgatggttcccttctttttgcagagattctagactttggctacccacagaattccgagacaggcgcgctgaaaaccttcatcacgcagcagggcatcaagagtcaggtacttgaattgtgcagactatagtcagggtggagtccaatctcccttcatctcagctggcccctgagccttgtctgagctgactcatgagccctcccatgacaggaagtgctggcctgagcctcctgccatgattgcaggccgattttgctctgtgtggtcctcccactgcaggagcagccaattcagcatctctattaccaggaatacagctcaagcagtttccttttgcactgaggggtgggggaggaggcctggtcttgaggcctggtattcctcaggaggagcgagcttgggccctctcctctaggatccaagcctcatagctttctcctccttttctgcctcccttgctgcttcatgtgggcacctcgttggccctgcggcctccagcatcaggtaagctcttccctcagcttccacccttgcagctttgctttgtttctccaggccctgccctttggggcttataggggaaaatggattacaggtggggactagaagggatggggaatgagggtggagtggggatagagacaggatgattaaagggacagaggagtgaggccattgctgtttgtttctgccctcatgtagacaaaagaagagcagtcacagatcaccagccaggtaactgggcagattggctggcggcgagagggtatcaagtatcgtcggaatgagctcttcctggatgtgctggagagtgtgaacctgctcatgtccccacaaggtgaggtccctctcacgacaaagttggagggggcccagggcaggatcctgggcctgcctgcctgactccgctgctccccatttatctgttccatcaccagggcaggtgctgagtgcccatgtgtcgggccgggtggtgatgaagagctacctgagtggcatgcctgaatgcaagtttgggatgaatgacaagattgttattgaaaagcagggcaaaggcacagctgatgaaacaagcaagaggtgcctgaggcaggagagctggtgggagagggtgtcccttggagggctcagtggggtctagtgaaccacaagtttcttctggatttcattcccactgtaattgcaaactctgttcctgacggtaagcctggctgttcgctcttgacattagtgctacgagagatgaggggatcgtcctcagagagcaagcccctttgtttggtccctaggaccaaggccttttctgtacatactgacagcctctgcccagtgtgcctgaaacacccaggtccctagcagaaggagccccaagagatgagcttgcaaggcttccctctcatcccaagctctggggcagacctccgagtcacaaagctgcattctagcagcttttcatagtctctggtgccagcctggggtggagtggtctcccagcatgacagctgtcattctcctgtaccaatgagacctcttctgcccctgcttgcagcgggaagcaatcaattgccattgatgactgcaccttccaccagtgtgtgcgactcagcaagtttgactctgaacgcagcatcagctttatcccgccagatggagagtttgagcttatgaggtgccattggggtgtgaggaggcagctagtgctgctggcagactggggagaggaagtgggtcagctctttggtaaccttgcttcccatcccttaaggtatcgcacaaccaaggacatcatccttcccttccgggtgatcccgctagtgcgagaagtgggacgcaccaaactggaggtcaaggtggtcatcaagtccaactttaaaccctcactgctggctcagaagatcgaggtgaggacagggggctcaaggaggaggaagaacttgtccctaggaataaaggtagctgatgtcacagcttgacagagctccctgacaggtgtgtcacttctaggtgaggatcccaaccccactgaacacaagcggggtgcaggtgatctgcatgaaggggaaggccaagtacaaggccagcgagaatgccatcgtgtggaagtgagtctttccttcattaggccacagcagggctcaagatcccagtataccctcttgttttcagctttgatccttctgaatgaggggcaggggagtgtgcctgtttgcttttctaggagcctctgcttgtactgtcagtctttatacctccatgtgagtatgtacacgcctgcatttgggttcatgcacgtgcttattttttaagatgctttggcatttccctttgtaatgtatacattacaaagggaatacattgcctttgtaatgtatctgtgaagcagacaaagcaaacgatagcatgtccaagtgtctaggcagaaactgcatcctgttgttctaaagaagtagacccaagtttccatagcaagtggttagcagggtcctgaccacttctccttgttctggcacctcctgcaagctcctgggctctctccttgcttgaaatgggcaactgcccttgaaactcctccaagccccaatgggctgcccattgtccctgtgttcccaggatcaagcgcatggcaggcatgaaggaatcgcagatcagcgcagagattgagcttctgcctaccaacgacaagaagaaatgggctcgaccccccatttccatgaactttgaggtatggcagaggaggggcctagagtcatgccagggtatgctggaagacctcttagagatcattccgataaactgctgcaccttagaggtgaggaaactgaggcctagaaagaagaactggctttaattcatagatccattcttcccctttcaagcctcttagtagaaattactatttgtaatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagcttcattttgtacacgtgtgacttcgtccagttacaaacccaataaactctgtagagtggagttgctggcttagtgttgatgtgggagctacatggggagggaactggtgttgctctccgtgcagttttctgtactgaatactctaaaggctctttccttgtcttgtcccagttaggcccctcctgggccatccaagcccttatccttgtgggttctgggcccaggtttcctggctcctcttagaaagcctcaagggcatgcagccgcagcgggccccagtaccctggggatagattctttccctagctcctttttattccccctggtcctcggactcctaggctcaagagatcttacctgccccagcctctggagtagctgggatcacaagcacgcaccaccacagcacccagctctttctctaattcttaggcagatgttttctaattagattaagcataaattaagtgtgaagtttacatttggtcttgtagccatcctaagaaattgaccttttaattccatcatttacccaagcttcccaaatcttgctgactgggtggtaggaggaaagatttgcaaggagaataacataatggactgggcgcggtggctcacactgtaatcccagcactctgggaggccgagacgggtggatcacccgaggtccggaattcgagaccagcctgaccaacatggggaaacctcgtctctactaaaattacaaaattagccgggcgtggtggtgcatgccggtaatcccagctattcgggggctgaggcaggagaatcgctcgaacccaggaggtggaggctgcggtgagccaagatcacgccactgtactccagcctgggcaacaagagcgaaactccttctcaaattaaaaaaaaaaaaaaaagaatataatgaatctccatgtctcatcacccagcttcaactatgatcaatgcgtggccagttccttaatatcacatccagtctgtgttcacttaaccaggtgtcttatcaaatttttccagataaggtccattgtggttggttaatgctcctcaaattttaaaaattgatgtttcccttcaggtcttgcaattttgtggaagaaaccagagttctgtagtttaccacatcagaatttgcctgttgtccccatgaagtcacttaacatattcctctttacctgtatttcctgtaaaatggttcaatatcgggattgatgcctcatgatggcaatgtttaatccaaagggatgaatgggtaataatgtaattttcggtgccacttttagagaccaattggaggaatattcacgttaaatataaagcagtagcatcattttggaggaaattcctaacttcccgagggaatcggtgaaaggaaatagccttttattggcatttattgagtgcagagaagtctgctcagggtgtaggtagggaataatttatacaggccacgttgtcctggttttcttgccctttggcggtggatttggtcgtgccctggggtggtggaagaactgaatgggcttaattcacaaaggtcggctgaattacacagtgaaaaggcggtcgcggcggggaggcgggtggcgctggccaccaggctgagaagcccgtagggtctggggacccgcgaaagcaaagcactgagcagggggcttctgagagtcagggaccggggtgagtcagcaaagctctgggcaggctccaaaatgggcctgactgggtacgcaccagcagcagacgcgcctcgagggagcgcataaaacctggcaaagccaaagtgctttatcagccgcctgcctcttgggaggctcccacccgccagaccacgggtgcctcgcggccccgataaaccttgagctcccagcctttgccccacccctcgctcccggaactccacctcccagaaggcagcgagaaccgcacatgtggctaatctttcagcggaaaaggtgtcgcgcacgcgcagagagcgcggctccggcgcagactcggcgcctctcctcaaggccccgctcgccccgcccaccgggctctgcgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggtaagcagaactgaatcggccggctggggagaccgaagtggaggccgggggaaagtctaagcgagcgtcgtgcccgggactgttgccaggcctctcctctgcatgacctcttgtcccgggggctggttgggtctggagcctggactggggcctctgtctggggactgaaactgcttgtgtgtccaccctacccgataccttcctcgttctaccacgccctgcccaggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctgtatgtgccagggagtaggggttgatgggggcgaagggacggcgaacggtccggagacaagaggtgggggaggaagatctgatggccatagagcttttccctcaactcctaactctgcgctttctatccctacccacatagggctgagccacaaagccagggaaatagccaggtgctactggacgcccctatccagttgtcaaagataacggagaactacggtgagagtgaggggaggttgaactaactgcccccctgtgcttttctccgcccccaaccatctgctgcctgcagcttagggctcctacgtcttttccacaggacaaggttgtaggagctagttgatgtctttaccgagggcagaagagcccatgatgggggtggggaggaggttggagggttctccctccaagctcttgggtagggtaggaagcataagagcctggagctggacagacttgctttcacccccagttttgcaacttgctaaccagctgcatgatcttgtaagagttggttatctgtccccagcctcgtctatgcctctgtatccttctacgtgagttttgttttgttttgttttgttttgtttttagtgcagggaagataatagccatctatctgcagtattataaggttttgtagaaaacatctgtgtctctgcctggttcctattagtcactcaaaatgttagtttcccttccctcagggagaaggtgactgcttttcttatcgcttacagactgtggaaccaaacttccaggactgctaaagagggaacagtcctcggtgaggaggaggaagcaagggaggggactgtctgtgatggggttgggagttgactgtctaattggagtatcttttggggggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtggtggggagcactaagagctgtccatttctccctttaaagagtcttagaagaggcatcagccagccaggcaggcagcagaaaggagagtcggttggaatcatctggcaagaacaaatcctatgatgtgcgaattgagaactttgatgtgtcttttggcgataggtgagggaatagtggtggcaggggttggctttctttttctaattagaggacaatttggagaggtgaaacggggctataaacaatgttaggtttgtcattaaacttgctgtgcacctatttctagagcatctttggtctcctttctccactcctgcagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcaggtgaggactcccggctagggagtaactagcagccgctgtcgcttacagagcgcctgccgtcctggaacaatccataatttgcatgtacatcctagtaatcagcagagcttagaacttggcactctgggactcagaagcccttgttctttccacagtgcccattgccctttcttgttctttccacagtgcccatttccatagtgcccaaggtaatgagcactgtgcaaacccttcctgtattctcttcctcttccagccacaaggtagccaatggcctttccaacggtatagggtgcaggacatcctcctagactgcccccgcttaggccaattgctgtttctcctccctccagggcggagggctctgaagctgcagagctggcagaaatctatgccaaactggaggagattgaggctgacaaggcacctgccaggtatttaaagctccccctccctccttcagatttcctttcccttctgtggactgttccaactgagttcttcgatttcttctctactagggcatcagtcattctcgctgggcttggctttacccctaaaatgcagcagcagcccacccggtgagtgacccttgccattcttggctttgaaccctgttgtctcagccccttcctgccctgatgaacacccacccataatgtgactccatcattctttagggagttctcaggtggctggaggatgaggctggccctggcccgggccctctttgctaggtgagtctcctgggccagtgtatgaagccctatggaagattggtcttagctcttgggaggtggcatgagttgctgacctaaaacctcaggccatgtattctttttcataggccagatcttctgctgttagatggtgagtttgaaatggggcaccctgactttaggatgggcaggggtggtagcatccaagttcctagttctccagcccttcaatcccaagtgtgtgctcccctgcttctccagaacctacaaacatgctggatgtcagggccatcctgtggctggagaattacctgcaggtgagtgcctgtgggtgctggagtgtgttggggaaaggcggcctccaagatacctgggggcctgagaactgactgccctcccaaaccgggcctgctgtcctgtgacccctcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggtgtggggcctggcagggctgggggtcccatcccaggggttccagagtgggggatagtgggggaatttgaccaatgcctacactcctccacctgcaggttttcattgaccggtttcgctacaatgccaacagggcctctcaagtgcagagtaaactcaagatgctggagaagctgtgagtacagcatccttggccagggcctgactcctgttctcttcgtctccttccgcatttgcacgccacccttgccctaccattctaggtctccccttcgctagaagccaactgtgacttcctcctctgctgggaagcagagtattccacactgttcttggagggctaatcttgactagcacgtggcaaccactaatttactttctgtttctgcttctacgtatctgcttattctgggcatttcatataaatggaatcatacaatatgacctttgtgcctggcgtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactgttttctaaagcaacaacatcattttacattcctaccaacaagggatgagagttccaatttctccatgtctttggcagcactgttattgactttttttttttagttttagccatcctagtggctgtgaagtgatagctcattgtggttttgatttgcattgccttaataactaatgataatgtgcattgggagtttaattttgaagtgccctttctataagtgctggcaggaagcttaaaatcataaagcttagatgtttgcgacgtggaaacatatcacaatatagtaactggggataaaaagtcacaaaaagcctaattctattttttagcatacagtaaatgagaagaatggactctaaagtaatgatacctgagtggtaggagtacaagccctttctaagttttctctgaacatatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcctgggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttccttttttttttttttttttcggagacagagtcctgccctgttgccccggctggagtgcaatggcacaatcttggctcaccgcagctttcgcctcccgggttcaaacagttctccctcagccccacaagtagctgagattacaggcacccgccaccatgcccagctaattttttgcatttttagtagagatggggttttaccatattggccaggctggtctcaaactcctgacctcaaatgatctgcctgcctcagcctcccaaagtgctgggaatacaggcctgagccaccgtgcccggctagagtccttaaaaatatttttttggttgttgaaggagtcatcgggactggggactgcctgggaccccttctaatttccttctcctctgtgttacacacagcggtgctctttttattgatacataattgtacatatttatggggtacagagtgatacttccatgcatgtatacaatgtgtaatgatcaaatcagggtaattagcatattcatcataaacatttatcactttatgttgggaacattcagaatcttctagctttttgaaaatgtacagtctatcattgtgaactgtagcgtccctgcagtgctgtagaaccctagaacttattcctccattcctcctatctaactgcaattttgtttcagttaaccaacctctcccgaacccctctctcaattcccctcctccccccttatccttcccagcctctagtaaccacaactctgctctctacttctatgtgctcaacactttttagtgcccacatatgaatgagaacataccgtatttatttttctggcacacactgtatgacattttcatgtttcttaaggttggagagaatggggctgggaagtctaccatgctgaagctgcttttgggggacctggcacctgttcggggcatcagacacgctcacaggtcaggcccacccgcacccctgcccccatgagcacatttgcaggcacccatgctgcctgcgctccttcgtggccattgcctttgtctgtttttccacctcggcttctgcctgcaggaatctgaagattggctatttcagccagcaccatgtggagcagctggacctaaacgtcagtgctgtggaactgctggcacgcaagtttcctggtgagttagggatttgagtcgggggaagagtttgagtagggaagagggctgaggctgaccccggcagctaggcctgccttggggtgcgtgcagagcagccccgccaagcctagatggaaggacatggggacttggaggtgtggctggagggcacagggagggtgttgggccaagaagccacctgatctggggagtccttttccagggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaagccatctttgtcctcactttgcttgggtgattgcatgttctttatatttcctctaaccatataggaggggcctgggaaatagggaatttaggacagggtctaacaggaaggcatggaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtgacaacaaagtcagcagaaagaacttgccgccttcatgcagattgtagtcaaaaagctcgaccaggccaggagcagtggctcacgcctgtaatcccagcactttaggaggccaaggtgggcaggtcacctgaggtcaggagttcaagaccagccaggccaacatagggaggccccgtctctactaaaaatacaaaaattagccaggtgtggtggcacatgcctgtagtcccagctactcaagaggctgaggcaggagaatagcttgaacctgggaggcggaagttgcagtaagctgagatcgtgccattgcactcagcctgggcgacagagcgagacttcttctcaagaaaaaaaaaaaaaaaagcttgaccaaagaatcttaactctgagctgctgagggtagcatggtatgggtcgccggggagagagccctgtttcgggggttaaagaagataaagacagcaaggctctgtggactggtgaagctggcagaaggacgactaatgtgcctgcctccttggcatccttcctcccatgtctgtggccatgggcacccttagctcagcactccagagagcttgctcacagccctcataattctcttccaacttcagacctgcaggtgggtgtatcagggagccatccgttataggatcatgcctgcctacttgccaggcttccagcctctgagcccctcaccaatagtgaaccctagaggagttctctcaactccttagagtccttgggaat

SEQ ID NO: 16596 - DNA, 6450 bp, Human
ccgtcaacaagatcaccttctccgagcagtgctactacatcttcggtgacctctgcggcagtatgtgcctccctcatcttcttgccctgtctcctggctgggagtggggaggtagccagggaagtggcagcagactctggggaacccaaactgggggacagcagagccaggggcccaattcaaggcctgagagttctatggtggaagaagagtccagtttagcctcttcacctggcccacatctccctcttgggcctggcattttctaagtgcctgctctgcctggtaccatgttggttgttcctaaagcatcatcttactcaatattcacaacctcccagaggcccagctcaggaggatactgccagaataggccttttccttctcactcgtcaaggtctcagctagggtgttgtaggcttaaagggaagaactggaggcctaggtagccccgaggagcacacagtcattccctcaaaacaaacagcctggaggctcacgtcatcaccagctctgggcaacagctgacagaccactgctttcctccaccaccactccccatgctggctgctggcctcttgacaggttgatggcttggctgcaggctccacaggcagcctcagagccctgtctcctgacttctctcttggaaggctggggctggctcttcttagggctgggaggaatgtctcatcttaatagggccggtggcctcaagggcagttgtagctctcttggagctctgggacctggtaccgatagtgtgtgagcagagggtgtcccaggcaggtattcagtcctggtggccccttatattctcttcaatgtagttccaacattggtgggagtagccttgccattaaggaatgtataatttccccgggggcgccaggatcgtgagatgagtaatgttggtggagtgagacagtgctatgaagagctaggcctggctgggaacggggtggagagcagtgggggaggcacctaagttgttctttccttctggccccttcccaccctactcaccctgcccagcagcactgggaaagtataatcagggccaagtaccttctatatagggaatctctggaaggccctgcactcattctaggcttttagtgggtatttagttctaggtgaaggggtgggtaacactttacctaaatttcccaaactgctccttgtcctaattaatgacctcatctgagaaggtaaggagaaagtaagctactcttcgcgtctgttctgattagtttaggctgagctgaaggtagtgttcgctattgtgcctcatgaacttcaggtgcgacatacctggtggctgtctagtatttcagccttccaaattctccagtcttgcaccagctgagtgaacggaagagaaaatggccacataagagttttgcaggccgggcgcagtggctcgcgcctgtaatcccagccttttgggaggctgaggcgggcagaccacctgaggttaggagttggagaccagcctggctaacgtggcaaaaccctgtatctactaaacatacaaaaaaaaaaattagccaggtgtggtggtgcaaccctgtcaggaggctgaggcaggagaatcgcttaaaccagggaggaagaggttgcagggagctgaaactgtaccactgcactccagccttggccacagagcaagactccgtctcaaagagttttgccgcttctagcccactgaggccagcagagaaagtgcaaaagcttggccagggccttcaagggattgggaggtacagctttggctgagaacctagaatgatgactcagggttgtcctgagaagggtctccccggggctggctctggtggtggcaaagggggtctgcagaaggggggagctctctgggctgtgcctcctctcattctagccagaaactaccacggtctctctcatccagagcccacctgacctaggctagggacctctctccggaaagacctagctccatccggccctccccttcacagacatggccaacctgtctctccacgatcacgatggctccagtggcgcctctgaccaggacacactggcccctttgccgcacccgggggccgccccttggcccatggctttcccgtaccagtacccgccacccccgcacccatacaacccgcacccgggcttcccggagctgggctacagctacggcgggggcagcgccagcagtcagcacagcgaaggtaaggtagaggggccgtggaggaaggctataggtgggccccaggcttcccccgcccgctcagcctgccccaccccggccctgtttgcctcctacaggcagtcggagcagtggctccaaccgtagcggcagcgatcggaggaaggagaaggacccgaaggccggggactccaagtccgggggcagcggcagcgaatcggaccacaccacacgcagcagcctgcgggggccgcgggagcgggcgcccagcgagcgctcagggccggcggccagcgagcacagccaccgcagccaccattccctggccagcagccttcgcagccaccacacacacccgagctacggtcctcccggagtgccccctctctacggcccccccatgctgatgatgcccccgccgcccgcggccatggggcccccaggagcccctccgggccgcgacctggcctcagtgcccccggaactgaccgccagcagacagtccttccgcatggccatgggaaaccccagtgagttctttgtggatgtgatgtgagcagggcccctcccccagctccattccgctcccaccccagccggctgcgttcctctctccatccgtccgtcttttttactttgtctggtacctgaaagggaaataaaaggaactaaatccaggtgcgctaactgctcgcagggtgctgcgagggtggggtgcacctaccgattggctctgcagccccctaacctgcctctggccccagttcgtttcctctgcccactaatccctgcgcaggacttcccaggaccccttttgtctctgggaccagacttgttggtgctaccccttactcccctctgcaacccccattttgggagttgaccccagcaatgaccttggtggcacgctcactccctcattctctcgtttcccctttagctccctttcaccatttattcagctacatcatccctctattaaccccaccccatcaggcacgtgtgcaaacctcttgactttaccccacattactgaaaccaaaatatatttgcttcatctgcccctactaaccatccccctgcctgctgcctcagtcctgcaacctaaagctgtagtcgcctccaatagccatccatgccatccctgcctgtgcctagatcagaggcccagagggccccctcagttgcctgagcagctggtggcttccagggagcatctctgctctacccctgccccatgcctgccctgcgtgctggttccttcagacccctaaccctactaaccagcaggctcatctcacctccaggcctgaaacatttcttttctttcttttttcctcccccaattttccctgggcctggagcagccaagaatttcgggctgtttgactttctgtgagcccccagcgaggggaggcccagcctccgaggagaccaggaaccctgcttcagcagcccctcagggcttcccaaggatgtccagcccccacacccacacgttaacataatgagtcactaggcttctggggagggcccaacttcacccatgcatgagagactctcctcctttccagagagaatcggatcgcaccacgtgtggcagcctgcggcggggggaggggggcctctttagctctctttatctttctctctcactcatgtatgcatacatgcacagagatgcatacacaggtgcctatgcaagttcatttaagcctcagggctggtccctgcccaaagggctggaccctcctaatcctctcctaggttgtggggctggtcccctgacacccttctccccttcctggtagaccttaaacctcgcacacatgtccccagcattttctcacctggataaagcccataagctgggtctcaggctgggctcagcaaaggactcgccttgcaaccgacaggccattcccacccccacacacaacctcccctgttttcacattcaccatggcatcccagagcaaggacacaggagcccacaggccagttgaggttgggcaaggagacttccaggacttccagacagagtaccaggttttatttttcaccttattctctactttaaacaaatcataactttctctttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattattttatcattattattatttactctaaattggtagcagtttagggtatttttggaagataaagcttttgcaaaggtagaagtgaagccttgagtgctggttcaaaaattagaagtgcctgtattcagtcacttaatgacttcaggccgtgactatgatgtgagagaggtcagatcttcatcctgccacatcgtggcttctggctggaggctgggaaggactgtaacatttgcaaccagatctgtcctttcttgcccttccttcctcccatgacaggcgtagtcctgcccaaggaaggcagcagtttatctctgcctacagaaagagaagagccaacagattttcttaagactctgcaagaaccaagcaggcctttcatgtgtgagggttgggtctgtctcctcagcttggatgtaaagattctgtttatcaaagaggggatttcaaatcccatgtcaaactaaattcaactcttcgaacgtcttctaagcaacatatatgcctgtcactagaaggcatacacagtcgcataggtatagctaaggagaacatcggctcgttcatgaaaagctgtagctgacctccgggaagagtgtacagtcatggacttatttgtgaaaaggtttagtttcttccaagtagtcgcctccttcctccccgctcctctccttgggtcttgatcccttggaaaaagctcatgtccggaacaaatatatgagaaaagcttgagagaatcagaggtagtgttagaaagcagtaaattcagcacaaacacttctactgcccagttgtatttatttgtgtgtaaagtgaggacagccagtcctgggactctggagaca

SEQ ID NO: 16597 - DNA, 126982 bp, Human
ttgtatttctcttttaattcagtttcccaatttcccttaatgaatttgctaggttgaaggttttcctatatatatataaatataactatatatatacatattttttttaatagatggagtcttgctctgtcacccaggctggagtgcagtggcacaatctcggctcactgcaacctctgcctcccaggttcaagcgattctcctgcctcagcctccctagtagctgggattataggtacctgccaccacaccggctaatttttgtttttttctgtatttttagtagagacagggtttcaccacgttggccaggctggtcactaactcctgacctcacgtaatccacccgccttggcctcccaaagtgctgggattacaggtgtgagccaacatccccagccttctttaatatatgttatttataatattggatgtgtgtgtgtgtgtgtgtgtgtgtgtgtgtgtgtgtgtttaaattaattttctagtagttgcctaatctgtagtgctgcttctaggatttctattaaaagaatatatattaaattcttattaaaggccagttatgatggctcataattaagatgccctaggagcaacaagagctgggtgggctactgatttccagatgggaatctggccatgtttataagacctggacttgaagatattgggcagccaacgaggcccatggaggagaattctggcgggctctccacttaagtacacctacctgctctcaccttcaatttgcctttaatgcctctccacttgatgtttacggctagccacttttaggatctgagccatcaagatgatggatgaaattgggtttggaacaagaaggcagggctattttgacccaggacacatttccaacatgctgtgaagaactctcagcatcaaataacatctgggtggaagaagttttgggaaagaagtctagctgtagatcacacaatgcttctaaatgggagaaaatgtccagctccatggcttagattctttgggaagtaggataactggctattccattttaggcaaggctgcctggccagaaacccatgtcttaccatttcgagtacattatggttggcttacaaatcgtagcctcatagagaactttttcttcttttagctactgtcttcctaaaataaaagtctctgtgcaaagcaatggaagaaacctcatattgttttttggggttgtcattttatgtaacttacaataatgactacggctcgtcttatacaagatgtaaaggatttgggagagggaatccagtgtgcatttaggggaagatggtgatgtagatagcatatttcaggaggctgggaagtgtcgagtgcttaaatatatgcttctcaaatttaatgggcatacaaattacctggtggtattattaaaatgtaacctctaattcagtagttttgggatgggtccatggacagcactttggttagttccccttgggactcccctttcccctcagagaagtgtagagggttggggtattgggcttaagaggagttccagactgtaaccatagctctaggtaactcccttctggaagtgatgtgttagcgactggaggagaaagggatccctgggatccttttcagctttactattctgatttggggttctgagattccaacaaagtggacttttgggagtcacagacctccatgggaatgatgaaagctgcgtaccttctttccgcacaaatgcaggcccacctttaattctgcaaaccactttaggccccgcgggcccgcagccctggtccaagacagctgtctgcttcacaggtcgcgcacccagagccgggcggttctgcagctcagcatctggcccgggctgcgcgtcgggctctggcgggggcgtgtcaggaggcgtgtccggggcgtgtcggaggcggggccaaggcgggggtaagcctcgcccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaggaacgcggccgcgccgagatcccagccccctagcgcggcaacccgcgtcgtcgcggcctgccccagcggacgcccccggacccggctgaggaagccacggcagccgccggcttctccctctctccctccccggcttcccgccccgctcccggccgcctccggcccggcttggatccgggctccggcccgcataggccccggccgcggcctctgcctgcgcttggcccctgggccctaccgggctctcagcaggcccgcagggcccacctggtccgggaccgcccccgcggccgtccccatcgcccccgccgcttacctggcgcccgcccggcccccgtttccgggaacgcgccggctcggggctgcggcggagcgggaggggcgtcgggcctgccccctggtccctgacgccgctcaggtaggcggcgaagacagcggccccggccggcgcccctcggccccgccgccgcagtgggccccgctcagggccatcttggctgtcgccgggcacagctggagccggaccaccgagctgacctcgggctacgggggcctcttggaacctgcgttttcaaacttttgcagggtttctgtgcgctggaagggatgggggtggggggcgggttgcccaggcctgtgccacctgtaaggtaggtaggctgcattggcctgggagaggcattttgttccaggccagggatttctgtgttagcattgcgtgcaggaagaaaaaaaaaaaaaaaaaaaaagaagacttaatttggtttaaatggagagatacaggaaatagacaggggtcaaagtgatactgtagtgtctggacatttgaggcagctctgctaattaatgactttccccactgggaatgcttattagctgtgtatggcttttgacagggggtgttgtgaaaataccaggccaggcccgagcctgttagggaccatttccttaaatttactggggaattttgagtagtaatgctatttttaaaacagggaatctcagaactctcttgacaactttagcaaactgcttgtgttgaattattaacagaataagggttggggtacccttggtagtcagtgtgaccatggttactttttgattccattcctcttaaagggcttctagcatttagttaggttcaacagacatttattgaatagttcatgtttatagagcatgccataattcagaaagaagagacaggattttatttatctttacatccctgtcaccctccccatgaaataattttaatatacataaaaaccagtgatagatatatagacaggatgatgtcagagcttagaggacactttctgtgcaggccctcagataattcattcaaattgaattagttattggatgcccactgtgttgcacagcacattatactgatgaagtataagattgacttcctgactgtacagctttacaatttaggtggtggtggttggggcgaaatgaaatggcaaaatgacaatttaggattgtatttcttgttccagatgggtgacttacaaagcttataaaaacaaggtgatttgtttgtttgttttattggtggggaggctgacagtttgaaatagctggatacagtgtgtttttttggttcaaaaaatatttattgagcatctgcataaaacgctcatgctgagtttatagagaattgaacatctctaactgtcctcatggaggttatccccctgtgaagatgggggagggaaggctatttagctaaacatgaaaaattactagttggaaaagtaataaaggtaacaagctgggttttgtgatagaagataatagagggcagtccgcttgataagatggtcagagaaggcttgtctggaaagctaaccctcttttacctgaagacggttctaggcagaggaactgtgtgtatgaaggttccaaagcagggaagagcttggagtgttctaggaactcctaaggcagtggttaggactttttctgatgctgtccgttctcctcagcccttgtatgttgatacccagttaactaaactttctaataagcagaacccattttagaaggaaaaaggacctaagacctctctatgaattattgccgaattttcttttttatcaatattgtgtctagtcttgattgattcaggaatgtgttatatcttgttcttgaaacttttttcattagtcagaatgaagtgcttgatattctcaggatgttgtctagaacagtctgttataaagcttgaacttaagcagcaatttaggatccttctttttggtttgttttgttctgtatcttaattgtgaggcccttgaagaggaaatcttataagaacccaaaaagaaagattcccatccaattgtatgggagtcacacctcccatactgtacttcatctgccaagggtcttcttttgctttagatcagacttcacagagtgggccttagaagatgtttgatgtacttccattccttctcccccaatctaattatacttgccactcaaaaaacttcctttctgggagttgttaatgaccatgctctctgaaacagcaggattcagttgtggaacataaggaatgtttcatgcagtagacattggacatcctcttatgtggtaagcactgtggtgggcactggataaccttgaatactttttcatggcttcatgtttatggcccaagagtggtccaggctggccaatattgctttcttaatatactgcttaagaaccagagctctggagttctgggtttgaatctcttggccaggattcagatatgcgttttgtgaccaggggcaatgaacttggcctttcgaagcctcagtttctcacttggaaagtgggaataacgcttacctccccggtggctttgagaatgcatgtaagcctgggacctgacatgtagtaaggatgcaatacacattagccatcattgttagtagcgacaatattgttatggtctcattaatggtcccttttactattggtaaatgagtccctaacctctcattatttaccacacaatttctttagttcatattactaggtcccactgttctctctaacctgttgatttccccacttttcattattgagcagtcctttcagagtatcctagatgagattttattctacttcaaactccggatctgtttttttctggatctgaggactctcaaatgaattacaatgtgaacgatatgaaacagaagtctagctatcaatttgctctactcatttttttcataggggatgggtagatggttggaatgggatttatagtgaatttgattataagagtaatcaacagacgtagctttggttgcatgtttatgctaacagttatggcttctaatctggccatttttgccactgtccctcagataatagggaatagctgctaattttgttattactcaaaagatttgagtgtcttcactcattctgactcatttttttttcatgttcattcacaaacacacccaacctttatacgttgagtagttcttaggctttggttctttgatgactaaagctaacaaaatgtagatctgtttgccaagttaggtaagtggttttatgaaagtatatttggcattaggatgagtttgcatttgagagaggaaacaatactcaaattaactactctgagaaatgtttttattcttaatgtttcatcaataatttgttaatgtagatagatttaataggaaaatttcttgcatattagggcctcattctgtggaaaagtattattctttagtccaagaaattttagccaacctaaagtacggaattgacttgtagcattcaagaaccttcctagccatggctagggctttcccttgtggcaaatctaaagcctcgtgactttagctgggttagtgtgaatcctgtaaagagaagatcccgttataccaggtaattaatcttagatatgtatagcaaatagtactagatagtatggttggcatgttagagaatagcatattctgattaatagagcttgccagttgagaattcaacagcttctataatgaaattgcataggcaggatgattccttttccagtagtagctgtagcagctagcgttcccatagcatgtagtaatgtttaagaaacaaaaggatgttgaagtgtaaagagcactggacttagactcagaaaaccatggttaaggtaactgctctgctgtttacaaacactgagattttagggaaattccctaacttttctcaactctctgttcagaaatttctcatctgttaaaatagggataatgcctaacctgtagggccattgtaagaatcacattcttaatgcatgtgaaagtgctttgaaaattatagaatatctataagtatatacagattgttattagacatgattatttgcctgctgtagctactaatcacttaaaatgtaatagatttcaaagatcgcttagctgagaaatgtcagttttcaatagatgttttcttaaaatggttagaatagaatctataattgattcagaaaaacattgagccatttgtaaaatacttgttacaagaaatagttagaaagtatatgttgtaggtgcctctgattctcttaaagttctgatttacagaaaactttgtgaccagtcgagtccttagctatttacccttagctgagcatttttatgtatcagtttaagtagaaagatgatagcttgattctgctttagaaaacacgcccagtactttaaaatgtaatgaagtatatctgttaagaaaaagtcaagagatttaaaatcaatgtagttatttctcccaaaaatatttgaatataaaatgtatatgaaatgtcctgcttttgattttgtttatctgtttttactaattagtctggttttcgagaaccatgggagacctttatcttaattttaaagaactgatttgtgcagacagtgaagagtttcaaaccccagaactgcttgcccttcccagtgtgttgcataacatttcttttactgtttaacataacctcatacaagttcacctcagcaaattagtcccccctcaaagctcagactgcatttcttcttatgttcccttaaaaattagagcaaccctagtattaaagtaaaaaagtggaaaaacatctcacctcacttttagaatacatattttctcacattttcctttaaaataccttactagcctgaatgtgtgctgaaacttgtttaagatgggatattagttaaccctgtattttgagtcgttttcttttttcgtaaatttttcttctttcactaatttgagaagctggattgatgtgagcccatagagtttccttatttttaggggtctggatatcataatcctaactccattctacataatcgaggtcagtctcctttgtagtctctaggaagtgcagatggctccaatgatacaacctgagaaactttaattgaggcttaaaaaagaaagggaaagtaacagttaacaacttttttcactgttcctacctaatttgatgctcacaaccaccctttaaaggtaagtggacatagtccccttcatagatgagggggtagacgtttatttgttccggaagaggtaggttttaaccacctgggtgactggtagcctttgctcctcttactactctactgcatggttctctgagcctctttaagtcatttcggccattcaggtctgaaggaagcatctttgccagaagtgatgcagattcaggaatggaggagagagattattttaggtttcagtcagggggcggaagctccaagcaaccagccaccttttgagatgattttggagccttggtgctccaagaatggtgcacttcatgttacaatgttctaaacttgctggagggtttacagtggcattttgaatctggagacatttcgattgggaatctccaagtaagtagaagactttaattagaggaaaccattgcagatttgaaaggtaatagaatccttttaacactatatataaaaggaactcatttgtcataaaatttaacaaatgttgtcgttctggctaaatttgtaatctgggcaaattactatttttgctagtggatgtgggttagcttctagctgtttcctcccaactctagaaaatcttcaggtgtctcttcatgctcggtaaggttgggagtttaatgtgtacttaaattaatagaaagtattcaagtcgtaagactggccttgcttgtagctacacagtgaaagggagatgattagccagtagtttacacaactcaaggtgggccttttgaatgaagaaaacaattacattgtatgcagcttggttctttaagaacaacacattattctccaccacggagaaagaggattaaaatggacatcacagcagctttttcgagctatattgtatttcattttacccaaaattgctcaaacattgaaaaacgaggaatcaagaaaagtgttgccagacatatatatctgaacatacacacacacacacagacaccaaattgttcaaacatttaaaaaaagaggaatcaagcaaagtgttaccagacatatatatctgagatatatatatgtcagatgtatatatatctgacatgcctatgtctatttattgcctggctttgctgaagaaatcagtgacattaaggagctcccctgatgattttggcagtttccctgggatctggttatgtgcctgtcatggggaagcatccatctttttggggttgttagagtcctcaggataccaggctgtgcctaggaagggttgtggcagaggtgtagagggtggggtgtggatctccagggctgtttggagtccttcccttttaattctctcaaggtgactgtgaatgaaaggagaaagactggttttgtgtaggttaagctggtctggtgagcaccagaaagatagggaaggtgccataatcgttgctcccatgagggagagaacaggaataatagtgcctgtgataataataacctgctttagtccaggcttttggttggacattttagatatattttcccatttaatcatcacaaagctcttttgggtattattttatttttcacaaatgaggaaattgaggctcatagaagttagatacttgcccgaaggaacataattgtaagttactgtctcagtgtactgtgcttcattaaacaggcttgagaaggtaatgtggcatttaattttgtggccaaagaataaataaggtggtcattgcccaaagagagaaaaagagctggcattatgaggacacttgaatttaaaaagtgtggaagggatttgatgagtattttatcaactcctgactggtggatgattctaacaacctggaattgctaacttagggtggctcccttttgatagtttcagaaagttgacataaggaaatctgaaagaaataaaccatcaggaaataaatcttggggaacttgctctgagtacaatgaaaatacaaatttagggtaggtttagataacgccttacatgttagagccataatgatatactatgggtagctgtggtttaaggcacatgccagaattttgaagttggaagtttgaaggtgtcagacaaatagacccttcatgcttgtgacagaggaaagactttgtagcacggtcttatgggcatgacccagtaaggcagctctgattttctttacattagtgtgggttcatattgtagttcataatgcactttcagcagtgcaaaaatccagaatgtccagggaatcagaagcaactactgaggagataggaaaccacttatgtccggccccacaccctctctgatttatattatcaacctagaggaatgggaatggagataactacaaaacctcataatggccattacacaagcaaaattagatttaggcacactgttttcaaacccttaagataatattctttatttaaaaatgacaaaactaggactcaagtgaaatgacttcagtttcacagttggaactagaactctggtctcctaacacacttcattttgttttttactttatcgaacaccatttgctttttgtttttataaacacttacacatcctaaacagccgcttacctcactgtatttggtaagaacagtaaattgtaggtttcaagttatggccacataaaagatcttaaaattgaggtaagagggtgagaatgaggggcaaatgtgggaatgagggtaggagatacgtagagagaaaaaggaggaggaaaaaccctcatgtagctttatttcttttataggcttactagcattctgtcctatgcattttgatattgattcatcagtgtcaagaattaagaatttaaattcttaaataaatattattcttgatatttattctaagatttaattaaacttgcctggggccaggaaaaatgaaaaagactcaaatttacccctacttgtaatggggaaaatataaatggaggatcatgtcaaattaagccccagggtacagatagttcacccagatataaaaaagtgaggcacacacgacttaaaatgtaaccagttaactatcaacaggttcaacggattatctagtacctccagagataggacttaaagtaagtgaataggaagtcagaatttcggagacaagggagacttcaaaaattgaacatattggccaggtgagatggctcatgcctataatcccataactttgggaggctgaggcaggaggattgtttgagactagcctgggcaacatgttgggactccatctctacaaaaacaaaaaacaaaaaactccaaaagttagccagacatagtggcttgcacctgctgagatgagaggattgcttgagcccaggagtttgaggctgcagtgagctatgatcatgccactgcactccagcatgagcgacagcaagaccctgtctctaaaaaaaaaaaagaaaaaaagaaaaattgaacatatgtgagtgaatactagtgaatattatatcataactaagaacttgcattttgtaaagttgaggatattggaagttttcctcatttttccttcccaccatctttctcttgtgcaagactgttgcttgtcccctttgcccatccttaccctttgagtatgagctagtggagctatttggtactttcccaaatctgcactataagcactaactttctgacttttgcaggtcttaaagatttagacagactaactaaaaacgcttcttccctaatttaataatgttaagaaagttacagaattgctaaagaaaaggtgagccagtgtgttccagttaatttagaccttgcttgtcagtggactctgggcgagttaccaagtattttcttagtgagaaataatgtggagagatggatgtttggatgagaccccagaattcgttcacctggtcacttcataattagatacaaagaacaagtctatacttatgctttgaacattttaatccccttcccacctcctttgtagctacttatatagattctgtactggtgacagaatttcaggttttgagaattttttaacacttaaactggcgcttagcttttaatgtgttagagcaatcattggcgacattctgtcattctcagtcacatataccttaaaatttttaatatattatacacttattaagcaatgtaactttttttaacacaaccttacatatagatccaactgatttctttttcatataccttacaaatttgttttcttgctcctttcgccatccatattactattttgttcacctcttctctctccttttcacctctttctttttgctacctagtaacagtcaatcagggtattttgctttaaagttgtttgtttcccagcctcctctccagttgtagtagaaggtgagttttaccttcccttttccagtgggatgcggggaagacttgcctgctacttccagagaacccttttcttcctgaatgtagtcagctcattttgcgtggtaggaggccagtggcttttagttgcttaggcttgtaagacccatacatctctgtttttctttctgaattctgttcccactgcacatttggtggggtagcatattgaccttcagtggtagagagaccagggtcagaccttctaggtttgccctagtacttctttcccatgaagtctccattctcacttcttcctgcattgtcatttctatgataaggtagtcagcagtggattacttcggtggtgcaccaaagacacttttcatgtcaaagtagctacattagcatttttcagtttttgtactttatagatggcatcttcttagaatcctaagaattttgataactggataggaaagactacttaactatcctttcttcagtcctggctcttttttctgcgtgttttgattgaatttgtttaaacacaaagttattgtaagcttacttccttcattttgttccccaaaacacaagcgtagatagaccactaacaaaaccagatatccatccactcactaaactaggggtgaaagaatattttgtgaaggcttttgttttaattggcttactttactggatgcatcttatcaaaaattatatctgtatacagtgtatacataaggtgtaaccagatccaactggatttgaaaatgtgtttaggtttctaaggggaattcacaggttttcttcttgtaacttctaaagtactcagctttctcattcctagggacactatcttattttttcaggcctattttagaagaatttcagcccctcttcagcagttcattgtcttattgtttgaagttagctaatttactaggaaatgttttatgtgtgtgtaagtttcacaatttatgaactgctaaaacttttgcatcatagatggtaattaatcatgggtaactctaaatcagtaatttaagttagttaagtaactcattctgtatttgtaggttgaaaacattgaaaaaatggacagaactatcttaaaggttactgttaacttctaagggcttgtagttctttttattaaatatatatgaaaaataaagattaagactgcaacacaatttaaacttgatttcagtttcatgtaatgtattacatctacatctgacagagctaagttttttaagaaagctcatgtgttattgtctctggtgggggtaatgtgatttgacctgttcttgaattagttttattcaaaatttaatataaaaatgcaatgtcatgttccaattttggtttgtttgatttacagtaaatgaactggaacttatcttttttactttaggctttcagataaacttctgtgaaaaggcacaaagtaagctacaaattttatgatattatgctatttatttttttcatatccatcttggtattgggaatgtgtccactattgtttcagctaaccagccatggcaattttacattcaaagagctaccatttttcattcttcttccaaatattaaaaaaattatattcttgattgtaaattgtacttttttcacttgaaattgaaatagcaaaatatgtataggtatttagatgtatataatatggaaatacgtatttaggtatagaaaagtatatataggtattcagacttaaccctaatttaaattacaagtagaagagaattcacttttaagatcgtggtgcagaaagtatagagttatattcagacatcttatgctttaagattgaattattataaaccatacattgaatatatttttaatttttttctttaaaacaaaacagtgtttttcttctgcctccctcaccatccttattctgtattaggacactagtcttcatataatacaaaacagactttctatatcaaaaaaaaagttataaaccttgtattttatttattgagacagggtcccactctgttgtccaggctggagtgcagtggtgcaatcatagttcactgcagccttgacctccctcaagcgatcctcctgtctcagcctcctgagtaactgggactgcaggtgcatgccaccatgcctgactgactttaaacttttttgtagagacagggtctcactttgttgcctaggctagtctcaaactcctgggctcaagagatcctcctttcttggcctcccaaaatgccaagattacaggtgtgagcgactgtacccggccaaaaaaaaaatgcatttaagcttaaatgtcatctgtatcaagtacagttaaaaaaatctcatctcaaggagactactctccagttaacataaaaatataccaaaatatgatataagtcgttttgtcttctgctttttattcatgaactggagaagaatgatgctttgatatgtgtcattcttaagtacattgattcaaaggcaaaaaaaattaacctggaaaaaacatttctgctatgtttaaatttttttttggaatgagaatgcatagtttccactgattgattgttatgactactttgaaatgtagttagcaaaaatttatttcttgaatggttcacccacaatgtaactgtatataaataatagagatcaagcagttagaccctaggataaaagtttttttaattggttcattactgttatgtctcccttgccttaaataactgactaaaagtaatatatgatttcctgctcatagtgaacctttatatatgatatatatctatatgaaatgaagttacaacttctgttttatgcttttaattttgacacattcactgtgataatttttagctttgacttttcaaaatgtctgcttaatatttagcatgacaacgtttagcttttatttgtattttgacctaaaatctaattaatgaaaaaaaaaggctgtcttctatttttgttcatttcggagacagagtctcactgtgtttcccaagttggagcccagcctccaattcctgggttcaagtgatcttcccacctcagcctcccaagcagctgggactacaggtatatgccaccacacccagctcattttaaaatttttttgtagaaatggaatcttgctatgttgcccaggctggtctcgaactcctggctttaagcagtcccacttcagcctcccagagtgctgagattacaggcatgagctaccacacctggcctgactttttaaaaattttaagttgtactcacattattgttcttttatttaacctagttctattgtagatataaaacaagagaaacattgattatagtaaaattgtatatacagtgtctataagtagctttgtatgtggattaaaaatgcttttgaatcttctaaatggctctgtttttgtcattatagaaatgataggtttgcagtgcggcctgctttgatacatatggaagaatttaacaatggaggctgggacagcggaacctgttagaacttaattatgtggtggaggggcatatgtattcccactttgattattcaccttgattgccctcactgtctctttacactgtggctactttctgctggcttttcacatctctctttttatttctgcctcttcccattggaaggctcctctttattttccagttttgggattcaacacagttatttatatacattcacgaaatcacatattggacacctagaaaccatacagtaagcgagattcttggtacagaaatgaatggaataggcccctgccgttagcaagctcatagtttagtggactagagttgatcctacattgattacataagtgttcaaccaccgatgttacatactaattgatttttaactggaaccagggtgaggatggtgcaggagtggatctgtcctggtcacctttgctcctgctgttctctcatgagagagaatgagcataaagggtgctgagagtctcatgataactgctttcttgattggacactgtgtcttagggatccaacaatgggcctaccctgctttggagttaagcagatgtgtctgtgctggctcagacctcagtgaaagactcagggaatgggagtgcacacatcagggaggggagctggagacttggtagagatggctagccctaaattgacagtatttatttttgtactatcagtacctatattttagtataagttctcagttgcttacatatattagcacttcttctaaatctggtcctgtgatttgcatgacttaaaaaattagaagtgcaaatctgtaatgtttgcagacaatctgctggtttgctctggaatatagacattaactttatggtaaaagtggtcacacttttctttaaaattgggcttgggctgggcacggtggctcatgcctgtaatcccagcacttcgggaggccacggcgggcagatcacctgaggttgggagttcaagaccagccagaccaacatggagaaaccccgcctctactaaaaatacaaaattagctgggcgtggtggcacacgcctgtaatcctagctatttgggaggctgaggcaggagaatcgctgaacctgggaggcagaggttgcagtgagccgagattgtgccatggcactccagcctggtcaacaagaacaaaactccgtctcaaaataaataaataaataactccatatcaaaataaataaaataaaaataaaggcttgaaatcatcaaaggactgatttctccactgttggggcacacttatttctagaatctccacttttattctaaggatatttcagaattatcagataaacttatgtttaatttattaaaaagaattatgtatcatacagtagttgtaggagggtatggggcaaagagcatgaaattagatatcattcaagtctgataagtctgagtactggctgcttcaaatgctcaaatctatcacaaataaaaaagatttattgtaagatgattctgatgactaatggaagctctgaaggattaatttttttcattgactttcacatagtttttgctctttatattgctatgtcactctcttttaatcactttattacagttgcctgttacaagtcagtggagttttattggagatgtgtgtgtgtgtgtttacatgcacaaatagcgattacatatttaatttgggaaacatctctgtagaaattcaataaaaattcactctgctcctcacagtcttccttttatagattatagttcatgcatttatctattcttcagtttattttctaaatataagtttattttagataaaataaacttcaagttacatttatttaagaccatagtgtcatgtttcctttaatactgttggatcattgaatttttctgaagtctgaatgtaagaacactttagggaaaaaatatttttccatttgtaaatgtagagttataagtgtagaggtcctgccttagaaggttgattaatttatctgttatttgaagataatgtttttgtacatgtaaaggtatttatataatttatgaccgtatctcactgactttaatgagctaacctgtgaacatagttgtttagaatatgacttacttgctttataaaaccattttttcattttttatttttcgaggagggatgaggatttgcctgaaaacatttttttctcacaagctgcccaactaccaaaaaaatcattcttccaaaacctcctgatgttgattcctcatgaagagcagttgagttgcccaatgtgtgccactcatgacagaagcccccttttttagaaacacagtttttaagaaatgcttttatgaagttgaatttaccttagtgttgtcagcattctaatttttttttttttcagatgagaatcgtgactcatttaaagatctttgggcataggaattttcctcagaaaatgcctaaccgaattgtgtgctaatcagagtgatagtagctaggcgtttggcaaatactcttctgataatttatttttcacacaaaggtgcttttagctctttatcactatcctcccccccgccaccttttttttgtagctgtagtatattatcagttcatggccgaagagttctggagctctaaatattttgggtagtgttaagtttctgtagctttgtcttttacgtttttggtggcgttaaaaactttgtgcttttaaaaaatgatttaacttggaagtgtttacatagcaacaggatatttatttagaagattagatgctccagagctattattctggatgctacgaattgaaattagagtacaggtggcggtggtttttggtggcactgcacatcagtatatttggaggaaaaaaaggaggcatcctggagactgattttataagtatccctaattgttttttaaattggtaataataaaaaggaaaccataaagaggaagaaggatgttttgtgaatcttccaagaaatttgggaaagatactaagtttactgacctgctaagaagtgtctgtaaatgatgatgttttgactttattggagtggactataggaaaacaggaaaagcaaggagcaaagggaaggttaagttgttctgcatttaaaactaagaacttagaaaattcagctggttaaatttctgattcctcgttttatgtagcaaaagtctgcagccagtgacaaaaattatataatttggaaattattaaattcaactgagtttgtcagcaatcctaagaaacaaaatgtcatttactgctcttggaggtttatacagtttatataagtttatatatatatagttaatgaagttagttgaaaaatgagacttgtaggattagccgtaagccagactaacatctaatatttattaccatttgtggggaccatgataaattgtcaatgggaagtccatctgcttggaaaaaagtttttatattagttaaagcccaggaattgtagaagtagaagtggtatattccagagtcaggattcacctattcctctcatactttatgcttataccttataccattacaaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaacgtttccagagagtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggataaggaaagagaggtacaaatgttaacagttaacaaatgtgtatctatatataccttcgacagataaagatattaccaatgataagaagcactgggatccttaaagatgaattaaatctagagcctactctgaagaagtgtatgttctttgagagattgagcatatataggagctatgtggtagaaataataactcttaatgtgtgtcaaatcctgctctaagcactttatattaactcctttaattctcacagcagccttatgaagtaggtataatagttaatatagatgaggaaactgaagcacagagaggttaaataaaatttccaaagtcatatagctaataaggggcagaactgtgtgaccttggtctggtcacagtttacacgttgtaaaccttagtgttttactaattcttgaaagcagttggcgcttataggaatgattttctaaatcaaatggcttttgaggagtcctcatttgcactaggttatgagatctggacctaccatttgtatcttggtaagccatttgtaaggcttatcaaggttatccagtaagccttactgaacattaaagtagaaagattcgtgttgctatgaagttaggaacacaggggatctaccactagggaaaacgatgtttagtgaaaacctaaaactctcctggcctagacagatacaaggaataaattgctccaggattctgaaatgacttatatgcctgggtacagctggagaagattagtaggtcaggagacctgtgaagtcagtggacaaggtggcacagccatgaactttgtgaggacagactgtgtacagactgtcataagaacaaactgatgcttttagcaaaatttttatgcatccccaccccactttctttttggcagggttagaagaaagatttaatttttgaaaacttttaatagtagaaaatttcaaacatacacaaaaatagagtagtgtaatgaacccccatgtacccattatatagcatcagcaattaccaacatatagccaatcttattcttcttccctccagctatctctgctgaaatactttaaagcaaattctgatgatcattattttatccacataaatgtgttacatgtcttctaagtgataaggactcttaagtacataaccttgatacaattatcttaccattaaatgaacaaaacaatattactagatagctactcaatgttcacatttccccaaaagccttgtaaatgctttatttacagttaatttgttcaagttgagacctcagcaaggtatgtgcacacattgtgtttggttgatatgtctcttaagtttctttaagtctgtggtaattccctcttctctcttttccttaccattttttttgtttaaaaaattggttaatttattttgtagcattttgtatattttgaatttagctgattgcatccttttagtgtttaacatgttccttcatgccctgttatttacctttaactggtagttacagaaacttgatcagacttttggcaagaacacttacttcatagacggtgttgtgtgcttcacatcacatccaggtgtgttgttgtatcacatcaggaggcatatgatttcttgctggagctcttgttaagataaaccaatgggcttaggtgctgccagtgtgatccatatagtgtaaagttctccgtcagcctttcatctggtagttctggcccattaactttgcctacattaattattttcttaggaagaggttgactctcattttcagacatatgtgggctttgcagatagtagttgtatccagccaaaaaaagacaaaatttgtgtttggggcatacgactgaaagcaaattatagttaagccttggtcatctctgacttaactatgccagtactgaaggatatgaaagtgtatttatatgtacacatatgatatacaaacatttattgggatgctctgtattttgatagaataaaaactggatacttgtcctttctaccctggaacatgagttgacccgttcattagggctcattaatctttgcagataatcaaaagccacgtcaagtaataagacgttctctggtgaagttgaggagccaatggttagacaagactagtcctgccaaattaagatcaatcccacatcagagcccagcttttaaaatttgtgttcagtgcttagaatgctcagatccttcagggcattgccttcccaatacttgggaatcagattgagtcatcaaaagtcagtttggtgaggattagaagtgagtaagagttctcatccaagatttaataataaaaatctgatgacctacttgtgttttaattagtaatgaccttttaatgaccagtgtattgttgtccagttggtgtcatttaccctttagcagtaataatttcttaaccagctttccttttttcctattcctgttccatcatctaactttaactaaattattaaagtctctctctcataatgttctacaactaatttgctcttttgattttctttttgggtctttgtaagtaacaaattagaaacatttcagtcgagattctctcatgtactgtatacacatgaagtagatagaatgcagcatatcttctttgagtgccattcacgctcttgattattcttaatttagtccaaccttttaaaactttcaatttgtagaatacatttatgggcagcaaatagttttttattgtgtccactaggaaataaaagtgtcattcacgtgttaatatttttgaaattgggagttatttaatgagggtcaaaagaagccatttggatgggaagaggagtataatattgctaattattacagtattacctttgtgtggaagatgcctgctcattttctacctttgttatttgcttttgtagtgacatagttggattttaatttaaatttgactgtgaattgttacctaacatttcttaaaaatgattatatagtgaaatgcagtgctgaaatggaaagttggtggagtatacaaaagatcgccacgtcttatgactcatggcagttaaaaatgccacatatcgttttcaaagccagaagatgtctgactaatttttgtgtcatgaaattctattgttagcatttttctactaaaagcttctggtaactttttcagagaacctgcataacatccagttatacatattttgattaatgaggaaaaaaaagaaacaacaaattggacccatcaggaaatacagataaaacaccctattgtgtctcttagtgaaactgtttgtcctaaagatgttaaatcaaacatttgagcttcgattccttatttattgaagaaatatttgagttcctattaaatgacaggtgctgttacgaaaagaactgagttgtcggactcattagaatgttctgtctgatttccaatggtcagaagtcatgccgatggaggctgggcgtggtggctcatgcctgtaatctcagcgctttgggaggctgaggcagatggctcacctgaggtcaggagtttgagaccagcctggccaacatggcgaaaccccgtctctattaaaaatacaaaaattagccgggtgtggtggcaagcacctataatcccagctacttgggaggctgaggcaggggaattgcttgaacccaggaggtggaggttgcagtgaaccgagatcgtgcctgggcaacaagaacgaaactttgtctcaaaaaaaaaaaaaaaaaaaaaaaggtaccatgtagtagtaacaggttatttgaaggctctctaaatggtcttaattaaaatataaacaaaattatgtatatgacttaattattcttttgcctttccggattcttaaggacagatcatggtgaaaaacagttattacaggtaaagtggtgtgaattgtttgctttgagggtaaagtaattggtcagttggacaaggtagtcaggtgtgccctggagggtggagagaagtcagcttggaataaaaaattaactgaacctgggcaacatggtgaaaccccttctctacaaaaaaatacaaaaattagctaggcgtggtggcctgtaatcccagctacccaggaggctgaggtgggagtatcgcctaagctcgggaggtgaaagccgcagtgagatgtgatcatgccactgcactccagcctgggcagcagagtgagaccttctgtcagaaaacaaacaaacaaaaaactgtgattcactatggagtcgaaaagaaggaaggtagactctctgactttcctgagttaggatgatgtggacgtacacactctttgctttaagaagatgttcttggccaggcgcagtggctcacgcctgtaatcccagcactttgggaggccgaggtgggcggatcatgaggtcaggagatcgagaccatcctggctaacacagtgaaaccccgcctctactaaaaatacaaaaaattagccgggcgtagtggcgggggcctgtagtcccagctactcgggaggctgaggcaggagaatggcgtgaacccaggaagtggagcttgcagtgagccgagattgtgccactgcaccccagcctgggcgacagagtgagactccgtctcaaaaaaaaaaaaagatgttcttgaagtcaggagtctgctaggtatttgaaggacatctggcttgataatccttgataatattttcatacctgtttgtaaatcaactattgatatatgatggagaaaaatatattcataaaccatatcttcctactttatctctaattcacttggaatttgttttacttgtttttaggcttgtttatgtatttggatagttataaaaaccaattacaaatattaatggaaataaggaaatttttatttcatatttccaatattgacaccttgaggtgttttctgacaccaagcaattctctgacagcaaccgtgtatccaacaattgaattcatttctgacactatttacctggagttagcatcagatctcacaagttgaagggctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactcaggaaataactttatttactgttattggctttattataaaggttacagctcatgaacagccaaatggaagagataggaccctgtatagggcaaggtattgggagtaaggggacaggggaatagcgcagaggttctgtgacctttccgtgcacactatccttgattcatttaccaatctggaagctccccgaaccctattgttaggggtttttatggaggttttattaggtaggcatgattgattgtatcattggccattggactccgtctctagtccttttcaccttcctggaggtgtgtgtatgggggcgtggcagctgaaagttttaacagtctactcacttggttgtttttttctggtggccagcccctatcctgaagttatataggggccctctgagagttaccagactcttgcacaaagtcaggtatggttgaaagggccacattatcggtaacaaaagacactcctgtcactcaggagattctaagggttttcagagctctgtgccccaaacctgggacaaaggcaaaatacagttatatttttcattgtactacaggtacttctgtagcaaaattaccttgcacacaattggcccacagctttgaatctatctgggaaaaagagtggtaatcccataatgggttgtctactggattggtgatttttctgtcgtgaaaaggatgaacatggtttgtttccttggagcaaatgggtacttaggctaggaagttctctgcatcttatagctttctttattctaatctacttgctaatgaagttcatatagaattgaagtgcagaagagttaattacttatgacttatgaccagtctggctttcttgtatagttaataacattattacttataacattataaacttgccaagaaggagaagtcagatctgattgttttgatgtaaggaaaaactcaaacttttttcctctgctttcacaccatacaacaatcaacatagaagactttgtgaccaaatatgggggatttctccccactagcaaacaaataatcacttctgcagcacataccagctgggtgtcctccagttcaattatcacacagcttacctggagatagtgtcagatcccaccggttgagggctcagtcccacaaggctgcccctgcttcagataccagttgttaagtctgggccttcagaacttctgactgtccggctcccagttgggtttcccacaaccctcctttggggttaattaatttgctggtctttctggtcaccagccctcatcctgaagctaggtgctgccagtcatcagtcaactcattagcatccaaaaaatacatcaccttggaaattccaagaatttaaggagttgtgtgccaggaaatggggacaaaaccaaaaatatatatttctcaataccatatttggtagctcctcaatttgtgtgctgttgtgagtacttacgtgtcagctgaaatatggatccccttagccctgtggcctggggccactcactagagctctgtgtcattgtccttgagtcaagaacagacttatatttctttcattgtgttgtacacattttttttttcatatgcacatataaaaaaggtttggaagcactgattgaaaaaatattgatgttatagttataaaatatggttaatgtttttatttcacttataggtggtgaacagttgttaaaatagggtggtgataggatgtcatggcatttaccaagcaggaaaaataaatgtgatgtaagacctgtgtgcacgtggttccttgctagggttcaagcaagctgttcttcagagagtatctgatatgtgcttctgtctgtacagtgaggtcagactagaagccactccgtgggctctgggatatagatggaaatcagaacaagccttatgacttttcttgacatagctttcataagtttgcatattctattccttattccattagtaagattgctactaaaaaaataagcatcagttatgtggatggttttccagaaatctgagtatcttgttcttggtacattgtgagacagtaacttaaaactttggggtgctcatgaggagcttaattagaatattgagttggattaggaggcagaggttatcaaagtggcctgtgtattgcaaagtaagagaccactgttgactgttgtacatagaaaattttgttggggttgatcaatttgggtttgtgtctcacttgtcttcatgggatttctgttgatatactcacaagttcgaggcttaaaaacacaaatgccctttggatttgccagagatttaggcatcacatggatttaaaaatggtctgagcacctggataaaatgctgagtacctttactgactcttgctatgctgcaaatgtttcctcttcctggctagaactctcagcacatgtatagcaatagtgtttctgtgtgaatggaatcagtgcaggtatgtagcagattaggccgttcttattaaggactgtgaaagatgatggtatgagagaactctttaaatgagctagggacaaattaaggattcagagaactattaacacattctcttctcccctgaaccaaaggtggagataactggctgcctccttttgggtatccatttggaaccttctcagagtggttgtgtaattgtgaaattccaactcttaggttcccatgaagtctacttgcaaaatcattggaacatggaattggggttcggggggttatttcggataagctttttatattttgttggtgattaaaatgttgttaaatttagcaacattttaaactacagtagggccttctttgattagctggctccctgggtaatttttatggggttggactaatcatgacttggccagagagattttcaatttagcctgtggaattatatatttgcttgttggtagtagacatctggctcagagtctgatagaaagtgttgctgttattggctttaagtgatagctcaaaggtgtggctggctgtggaatcccataatgatggcactgtgcttaattgatgtgaaataactggagatcagagaggggctattataatcaatggcattggtggttagctgaatcagagaatggatgaatcagttatgagtttctgttaataggtttaaaaggaatttagggtgttttgggagctgcattccatgaagcttcataaaccccttattttattataactgaaatgagttaaattttttttttccttgttagatgagcagcttggaagcgagttttgggcttttaagccttccaactctccctgaaggcttttgttaaccaaagaaggactccatacatagtaagaggtagtctacaagtagaatgctgcttttgcctttgtctggtgttctaagaatctgataggagctgttaagccttttgttgtcaaagcagtaccctttcaggaactgatagaggagtgacataatccttggtattctgggttaaattttttttttctacccaagaaaaggactatgaatcttttgccagaggtcggaaatgctgagggtgaattattttgttttttttttccttgacagcagagcctctgaggcccgatcctgtcagatgaggaaaatgtttaatatttaggaatcatggctgttagtaatctacttttaccctggtttaggacttggccatcataaatgtagacagttatcataattgataataaagctggaatgagtgactatctagctgactctgttatgcatagtaatgcctttactcctcacagtgcccctatggggaaggtaatattaatcccatttggcaggtatggcgctaaggcagagaggtgaagtcatttacccaagagatattatatagctagtaagtagcagagttgagcttcaaaactaggccgattggcactgctagtctatattgatttccctggtttctagtttaatagaattaggaaggatcctggattaggataggaataagatttttatgggaaagtggttttaaacacatttacaaagcaagctgaattctttgttgctaatatattttgttggtttaaacgctatcaaacaaacattttccagttttcttctctagagaatttaatactttctcaattaggttttaatatgtacttataactaatatcatagtagttaccacttttcatgtctactgtttgccactattatagcatatttaagatatattaatccttatcacaacagtactgccaagtagcagactgtttttatcctggtttcacagatgtgtagtgtactagaccacagaaatattcttgtttgtatcttgattagtgttccagtggtatttattagtattttcagtggtgatcatttgacatcttggaaaagaattttctttcctattcctaccctttaacctccttgtactacatttctttttctttttttttgagacaggatctcactatgttgcccaggctgcttttgaactcatgggcgcaaacgatccttttgctttggcctcccaaagtgctgggattacaggcatgagtcaccatgtctggcctcacatttctttttaattttttggcagaatgcccaacgaaacagtctttgtggaggggtcagctaccttatctattgttcatctccactgcctggcatataacttgtttgtaattgtggtatttctgcacttgttgttgtgtaaattattatattgggctttctaaaaatccattttacacacaaaagtgtaaaatgtgctaaaagttgctgttgggatatttacttgatttcttaaactcagaaccatctagtttccaaaatgcttagctgtgtggatgaacaacagtgctttattgatgagagttcaaagttctgagtgagattttatgaactttttagtaattgctcactcttatgtatcaaagattgccagtggggggagataggggcaatataatattagctgatagcagctcacttaatacatggatatatggaatacctgatattgcgagtctaacatctctttttctttatttatttttatttatttatttattttttgagacgcagtttcactcttgtcacccaggctggagtgcaatggcgcgatctctgctcactgaaacctatacctcctgggttcaagcgattccattgcctcagcctcccgagtagctgggattacaggtgtctgccaccacgcccggctaatttttgtatttttagtagagacggggttttaccatgttggcctggctggtcttgaactcctgacctcaggtggtccgtccgcctcagcctcccaaagtgctaggattacaggcatgagccaccgtgcctgacctaacatctctttttcttttgagcttatgaaatattaggtctctcattaccgtagtaatttagggagaaaagagaatgaaagtaagttctttactaccactttatttcctcatttctgaaattgtttgactgtaaagttgcatagttggaattgtgggttactcatttcataaccagtgattgcagataattaaaaaattattccaggtaatctttctgttttgaaaatgaggtagtaacaatgagagccaaggaagaaatgagaatttaaatgacagctcccctctctgcgatgtgatgttctgaatacttgtaagtcaaataccaatattcttgaaggtattctatgaatgacttgtacactgcagttccaggtttctctttattgtgtggtggttctagggaataccctgtggtgtcaatgggtgttccctaaaagggattgattcagattgctttttgattattccttcctggctcctttcgcatgtgagtagttgacttgaaagagcaactgtttaatttttatgattcttttcattagttgggtggtagttctgtctcacctgagcttgcttatatgtatttagtaggtctattaggaagactgggactgctgggccttttgttccatgtggtctttcatcaaggagaatagactgagctgcttcacattcaaactcagggtagctttccaggagggcaaaagtggaagctgcaaggcctcataaagggcttagatttggaagtcatacagtattccttctgctatagtattgtggttaaatcaagccccaaggccagcccagattcaaaaggtagggaaatagacctcacctatttatggaaggagcagcaaggtccctttgcagatgggtatggactcagggagctgtggttccttggtggttatttttgtgacaatctaccaaataacctacagtgaactcagcattatatcaaaaaggttatactctagaggcagctattgtagatccttcagtggtcttcattaccatgaacaatgaagtactttgctgttactacaacagatgttaaacaagggctatcaaatatggtgatatcagtggagttgaagatatgcagattggctaaaatgttgtagagacggtttccattcttacaggctgggtgggaggattctagtgattgtagttctctgattctgaccatacaggtaacagaatcttgctttcctgtgatataatgaaacaaaacaagcccattagatggcggcagggggcagggggcagtgaaatgttgataagaaaaacaatctactaataattctaatttaataaatatttgttgaactgctgttttgtctgaggtactgttataggtgatttgcagagttcaaagataaatcaagatagttaaaaatttaaagcagaaaattgtttacaattttttgatggaaacagacttgaggatgagaggatggtaaggtgagcccagtgtaaagtgtttcttcctgagggacatactgatgtttttggaaactaaataatgctggctcttaatagaggaactgacaccttttgctgttctataaaatgtgaaggagagatgcttttggtaacctagattgcagagattccatagattttgtattgagtagtggactctcaactgcccgtgttgaggtttttggccaagatcgaagcaaactatatgctcagcttagctggttgtggaaagcaatgttaaaaaggtttgtattgcttgagaagttagtggagggagaatattcagggctctttatcatcttgtttttaaagctaaataaacctggaaggtgtcttccctccaacttcaatattctgtgagtcagtgagttgctcacaactagacaaagggtattcctaggcctcagtgaatgtggatacacttgaccaatccctttcttcaggattacagttcttaatattcttgatgattccatgtttgggagtgcttttctcatgagaaatttgaggaagacactgtgtgccgatgctgtgaaaagcttgtttgaaaggtgctggctgttctcttaaggcagagttttgaaaccagaatttcaaggatgattctgacagattgttgccctcagccttggagtggctgagtggggacaggactgctcaatgcctaggccagcctctgggccagctgcaattctaattttcccagcatgttgaacaaatattctcatcttttaaacaagccattgcatgaaaaaagtaggcagtattgctttgaggggtggaacagtgctttggaagtgtgatgaggacaggtactgttcctaagtcagggttcttggttgcaaacaacaaagatttactccagccaataaccatataggcttaagttgtctgaggctgtccatgtcaactttattcccaaatcaataaacatttggaagtgttttctgtatcaggcacagagctaaggttttaggtatacagagaatctctcgcaggaaaccgcttctgtataaatattttaggatgtttgatgcctcgtttctctcctgctatagttaaagggacaatgtttatctgtgttgactggttagaaattgatgatatgacagtcccaccaaaggggttattataatcacaaattcataatgtttttgatcagttattttaaaccctgttgtacaaatatttcaatctttgttagcatctaaaaatcttcacaggtcatttatagtatcacgtccctcctttctccctgtgaaagttgtttcaagtttttgaaaaaaattcatattaatgtcctatttgcttgtaattttttgtcattaaaaatatctgaatacatggtgacagattgcctttcggttttgatttttttgagggacccttgaaaaagaagtaaaggagagaaggacccagccccagtagaggctctagtacttagagaaagtgaatgggagaggagaagatgcctttttttaaaaaaaaaaaagctcatgcctccaggtagccagaaacagcttctcctgagtattgtaaaagctatttttctacttttcttgaatctcaccttcggttgacattttggggccttccttttcctcctcaaaactgcctttcaagttcatcttaaactgatcagcatttgaagagttggggtacacagatgagacccagcaaggtaacttgatcatgtgctaagctcgttggcacttgttttaggctttgagtgatctttgcttggaaaggcttcgaaacctacagaattacttagtgtgttttgttagtaaatgatcagaatataaatttggactttttcaagataattgcagatgtctctgaagtgtagagtgtgtttaaatctaatttatgtaacttaaatcacattctcttcatcatggtgtacgtttatgaagttaatggcctttaaagctttcaatttagtttttatttaaatgtgaatgcaatgctgaaaaaaatctctctgtgtattcagtataaatacttatattcaagaaaacagtttaagttttaactgttgtaatatattttattgtttatctggtaaggttagctactattccgtcaaattgggctttctaagaaaggaccaatttttgtttttctttggatagttttcacaatagttctttgttctgtccttgtcttgcattttatcttagtcttatattaatttttcttcacacggaggtaatggatgatgtgccagatggtttcaaacacagactacatgacatatgctcagtttttgatttgaggagtttgtaaagattttcttcaaattgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatccttcccatgtgcaaaatacatttaccctaccccagcgtctccaaaattttgactcattacagtattaactcaaatgtaaatctcacctaaatattaccagctcaaaaatcccaaatcccattatgaaaatcatttaaatcaggcatgggtaaaactctgagtattatccagggcaaattccatttggtttcaagacccgggagtaatcctctatctttaaatattttctaaagaaaaattctcaagaagtaaaagagcatatttactaaaaaaacctttttttttgtatattgctgaacctctcacagaaagtttttctaccagcaatatatcttattagtgattcttctacctagccattctgatcatcatgttatcattatgtatatataatataaaaccttcaaactttgccattttcatatgaacaaaagcttaaaatgtttttggtgttagtgtctttttatattttcccttgatttgtctttactgctcatattcttatcactttttttctatttttcttgatttctatgatgtctttatatatttagagctactgatttttgtattgcaagagttttcccaaggttcaatttttttttagttttgttttttggtaatatactgagggtttttgttttttttttaaatacagtcatatctgctatgtttcctagtgtaccctttgcacatgttgtttgaatgtccttcctctacattatgtggaaaagtcatactgtactaaccttatttctgaaaatggatgtgtttggtcttcgtgggaattcacatgatctggtagaaaggaggcttatctttgaaagcagatctaggggccgtggcaaggagctctgtgctcttgtctctttgccatcttctccatccagtgtggctccgtcagattttcagatctcacatttacagtttgaaccctctattaaatcctcatccactgaggtcagaaagtgtttggattgcagagatattttttgagtagttaattgtataataaactctagagagtgagttcaggaaaaagtgtctctaaggtgaatgtgaaaccaagatatgctgcaaatgcttaaaaaattcagttctgttacaaggtatccttttaagtcctaaagaaatgattctgtaagacttattgatatagaaagaaatgttagtgaataaagcattttacaaagcattttcatggtctgatttcaattgtagtgaaaaaatacatgtccctatctatgtatagaaaaaagtctgcagtagttagtaaactgattattttgagatacttggattgataagtttatgtaaaattttaaccctatgtattgtataggtgtatatgtaacatttttaatatatttgatctttttttgcattttctgcccttctaccatggtggttttacttgggtaataaaaaacattggtatctcttcccttcctaccctaaagaaacagcttcatggaaataattatttagaatacttgtattactaacttgaagtttactctaccgtaatgtttttagcaaatttttcagattcttcactctgttgtttatattcattaaaatgagggaaaacgatatttattaaactgagggcattaagtataacactgaacagatggtaatatttttagaatttttcagtatatctactgagataattgatttttataatagtattttcacttgcaaaagtattaacttccctgaataatggaaacttgaagtgatagcattctatctattgtatcatagcctagtgaatgatttgtagttagtaacaactttagattattttattttttcttagtttgagaaattcctcattgcctttcaaaatattgtcctatattaactgtttgttaaagcaagttctcttgccttttggtgtgactttcttatgccctcagaatagtacctgttttgtagtacttgaaacttttactttttatttgttatttctcaggtaaacgcaaagcactgaagttgaattttgcaaatccacctttcaaatctacagcaaggtttactctgaatcccaatcctacaggagttcaaaacccacacatgtgagtattcttggtaatcaaaggctcaactcaagcaaagattttaaagttactgtattttatgaatttttccaattatgagatgtcagtataatttctctgactaaactctctgggaatattgtttattcttttccttctggagttccagttaaattgcaagttgcatttaggaaatttgactgtcttctgtccaactgtacaaattttcaccacttagtgacaaaatagagtcccatcttaataagctagattcctgcaagatttctatgtcatagtaaattgaaagagttgtgtacatgtgagtgtacacatatcagtggttatttcatttactgaatttttaaacaatagaaatgatattgtagcatcttagtgaaaatattagagcatcttagttaacataaagcaataccttcagaacaatattttacattaaccttcaattgaatttaagtgatgtgaaatattaaaaaacctcttcttatttcccatcctaacctatcatgaaaatgaaggccagtggctgtacttttataaccatgtccataaaaataattttgagctagtttcgatgttgagaactataaagcaagtggtgtaaggtatgattaaaaagctggcagatacatttttttttaagtaatttctcaacaatttgcatctagatcttattaggcttaaaatacatttattcttcccaaagaggcacttttattgctattttctcttctttcagaatttggtatgcattgtatttacaaacagtaacaaattggtagaaggtagtgtcttgcaaaagagatgcttaaaatatttttaaaacagcaatgtctagaagggagtagtttcacttgtagccttagagggaatgaaagatattttaaataaaaagtgtagtaacaatttatttttctcaattgtctattaattttattagactggtgttcataatcacacttcttgtcagagctcagcctagagtcccactctttttaccttctctgaaacatcaagtaggggctatcttgaggaaggaaacttagtacttattaattagtcagaatttcagcagcaaggaaacaattcttaaaagaacctccttccttatttcttagaatttgtagtgaaagctagtgcaaaactaattctttaacatagcccccttctgttaccttagttactagctgaaccatatgttggaagtctaagaaggaaaggatatagcagtaatcaccaaacttatcagatctttcttttttaaaagcctttttggacaaggagaaagacaacctgacttaaattaaaactggaaaaacattcatctatttgtactgtcttccctctggagtttctttatgtatgtggaattcatggagcaaaattttttaaaaaatagtaaacacagggtggaaaaaaactttcttccaaagttgagttcaggttttattttttgttttgttcttaactaatgttttataataaacctatagccagctagatttctcattctttgtttcttcccagcaagtatttaaaatttgaaaggacatggtaataggtagttttaccttatgatagaatctttagagcttgattctggtatgtaaaaattttagacccagactttgttgtaagttttttattgtacaggtcaattgttctgggttaggaataggtaactactagcattgttactggtcagagataactgttttattacttagaacaacattatctcctctaccttcccagccccttccaaaaggtatccttttgtactcttcctctgagttgtttgccatcaagcactaaaaacagttgttagtttctgtttaggatgagtacttgcaattagaaaaacataacttgtagtttgtgggagttttgaaataagatatctcttaacatttatatgttttttctcctaaaatttccttgaactttaataattacagatgtgaatataaaacttgttcatgaatttaggaaaagataagatgaaataagcaagctaatgaagttaagatatgtcacaggatctggtttcagatctccttggcatttgatgtctcctggatgcaggatcctttgcaagattaaaaaaaaaattgtaagacagtgttctttttttctgagaaccaacagtttaaataaaattccaagaaatgacaattggctgtcgtaattttagtaaggcataaggtaatatggattgaatgtcaaattaaaggtgtacaaggggtaaatcattttagaaaacctacttgattaaatgcttcccagaagaacaagattttactggattttgaaagacaggcagggaaggttgagtgaagaggacaagggacagtggcattctggtgagcgtatgcacaagagaagttttgggaaccatgtgtagatctgtttaattgtagcagggatgttatttatagattacctatttctctctctcactggaatcttttagcctgttttctttattcttgatattctgtaattatatgaggataagcctcaaattgcatcatcttcccatgtatcagattaacccttttagtttcaagattcatgtatctctttttctgggaaaattgctgctgctttccttttgatacatttccttcatgtttttcctatcatcttctcctgaaacttgtgttactaggatgttggactgcctatatcccctgtatcctagactctaaaaaaaaatgtgttccgtctcattgttttcttactctgtatcctgggagattttctttattttccatcccctaaatggaatcttggcaatcagttttaatttccaagagttgattgtggcattttcttaggattctattcttaattttggatacaaaatagggaatttaaaaattcttttctgttgtttgaattattgatttcctcaaggatcagtttttcttttacctctttctcagtttttttttacatcttataatttttttttcatgtcttgttcttgattgtttcttgaatggaagctttggttatagatcatcacctggtgggcttggctttacttttctgtgagtattttgagagctagctcttaggccaggaatattaccaatgctagaattagtagagccaaaattcaccttaggaagcctggttctctccagatgtgtttgttctctttgaagacatgccccctttttattttaggggaagaataaagaggaaaagtggaattaactagacctttctttttttttttttttttttaagtggcagggtctcactatattgcccaggctggtcttgaactcctggattccagggatcctcccgcctcagcctcccagagtgctgggattacaggcatgaggtactgcgcctggcctagaacttccttatagaaagaagtttaattaactctggtttctaggccttcatttcttctgaccatgaattctctctgatccagtgttctattgggaccatgatttgtccctcatattcactgcatgcctgcctcctaccatgtgttataggttatagttttttctgtttatttttaaaccttttattatggaaaattgcatacctacccaaaagtaaagtggtagatgaatctgtctttactgtcaatcagctttaacagcttcaacagttaatagcatggccaatgttgttttatcttttccttcaaccccttagttttaaccaaatctcagatgttatgcaatctacaaatattttagtatgcatttataaaagataagagctgcttttaaaagacataatcatagtaccattgctacatctagtagaataaatctttaatatcatcaaataagcagatgacctcattagtttttttatttttaatagtttgaagtgaggtctatacaaggtcctgcattctatgcagttagctgatcagtcttttaaactagagttccttctcttgaaatcgattagtttttctttgtgatacatttttatctactcaggcattcagaaatttaattcttttaatttattgcttatttccttaaaaaaaggatttttggggggatcttggaggatgaggagacaacctgaacaggaaaccttgatttttaattatcaatgattaaaattagaaatatttttgacagaaaatgcatattataatagagactcttgtacccactaacattttttcccttggcttttaaaatgaaagattaaactggatagccaaagagtacaaagaaaaagcaaaggaaaaatgtgtggctaccttttaaattttcatcaggtttggattctactaaacactataaatctttttgatactctagggatattcttataaatgtggccagcttgtgttaaaatcatgttgtgtatatgaatttgacaaacagaagtagatattctgttaaacattctgtgttttcatgatagtgagttatggttgagtgctctcagtgtactgagtcgtttagaatatattcagtacaattgttattctgaaagaacatcccttttatcttcataacatatcacaattgtcaagaaaaaacactagcttaaaagttaacactggaaataaatagtggtggatgcagataacattttggggcttaagagttttggaaccacacgttttaagtttaaagtgctctctttagaccagaggatctctaggatttcccttatctttgtttattacattggaacagacagagactcagttgtgctatagaacatctaggagtagtttaaagaggtttcaaagtccctagttaataactaatattcctcgtatttcttgatgagccttctcagtagaactttatcttaaaacttagaatttcttcttctcttggttaaattgtgagaactgtgtcttataaacgttgctgtcttagaattaatgacgaggccgggcacagttgctcacgcctgcaatcccagcactttgggaggccgaggcaggaggattgcttgagccaagaagttcgagaccaggctgggcaacatggcaaaaccccatttctacaaaaatagaaaaaattagccacgtgtgatggtgtgcgcctgtggtcccagctacttgggaggctgaggtagaagggtcagttgagccctggaggttgaggctacagtgtaccactgcactccagcctgtgtaagagttgagactctgtctctattaaaaaaaaaaaaaattgtttttaaaaagaaataacaatgggtagaaatttaggagtctggatttctatcctggtgttgtcgttatctctgtgtccttgactttatcacttaattctgctctcaatttaggcattgaattagaatagcgacatacactattttatataatgaataggaaggggagagaattaagccagccttgcactgccttctttaaataaagtctcatgtacaaaactgataggctaaaaagataaaggaggaactgtgctgactgaagtgtttgtgaggtgggagagagttttgtagcgttgtctgccttcattccccagaatagtcccaggacatctctggtggatttctaagtgtgaatacctctaatctacatgaatttggaagtttttttctgtctctgaaattttttgaagcaatcatgatactgtgaaatctctgcatttctgtggtggaccacttttacaaaatagcggtaatggtagaagtatttatgggtatgtattaatagatgatgtttaatctcaaatgtgttaaatactatggggtgtgtgtgtgtgtgtgtgcgcgcgtgtgtgtgtgtggctggtttggtgctactgctgcgaatcttttttcttactgtagtaaatatacataacgtaaaaatttttatcttaaccattttaagtatacagttcattgggattaattgtgttcacattgttgtacatttgtcaccatcatccatctctagaactttttcatcttctcagatcgaacttctgtacccgttaagcaataagtccttattctcccttccttctagccctggcgcccaccattctactttctgtctctatgaatctaactactttttaggtacctctcataagtggaatcataacaatatttattttgtgtctagcttatctcattcaaaataatgtcttcaaggttcattcatgttgtagaatgtatctttctccacccttctttttaagggtgaataaatattattttattgttatgtgtatgcagcattttgtttagccattcatctgttgttggacatttgggttgtttgtaccttttggctctagtaaataatgatgctgtgtttgggataatctttaaagcttagatcattgtacttcttaatgttacagtttagggatattcagtcttatctttagtcccacattccacctcagtgtacctgaggctgtggtacacttccataagtcagcaattcactggagaagtgattctcgacagaggtggcagtggtaataggagtggtagaactgattttctttgtgggcccctacccccttgagattcacattcccttcaagctggatgtttatagctgaggtggtggatgctaattctggaatatgtatttgcatagattaatgatacatgctgttgagttgtgtgcttttggtgttataaatcatctttgttcttgaatcagagactgaggcagacattagaagatagccctggttttttaacccacagtacttctaagtgctgctccttgaagatacatctgacttcttagctattgatgagttttccaaccatttctaatcaggcagttatgtttttgagttctgatttcaatcagaatattataaggccttttatctttgcagtatgtatgtttctggaaacttttatctattattaaggaaatttgctatatgaaggtaacttttttcagtgtgtttttttttaaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgaagtctgcttcacagggctgttgccattgttttgtgaatgcctgattctgattatctgtttccgggatttcatctttttttatttttcactttcccactctcattttggtagagtatatattctaagtcttcctgagataagaattctttcttagtagtttttaattatttctcaagctttttgggtgtttgtatgcctgaatatgcctttgtcttttttcagacaggatcttgctctgttgccctggctggagtaaatggtgctatcatagctcgctgcagtcttgaaccactggactcaagtgattctcctaccttagccttctgagtagctggcactataggcatgtgccaccatccctggctcatttttaaattattttgtagaggacagggtcttgctatgttgcccaggatggtctcgaactcaagctatcttcctgcctcggcctcccagagtgctggaattacaggcatgaaccactgcctggccttgaaaatgtctttaaataaataaccctcataatagatcagcagttttattgggtatagaattctggggtagaaatttttctccagaattgtgtttgtatttcgacaatgttttctattttccatggttactttaaaaggttagatgtgactttgattcctgaacctttgtatgtgatctcttttttcttttgtgatttattgtggggatttttctttttccccacgttctgaaatcttgctgtgtttgcattcttcccccccacctcccctcttcccttttcccagtcttctccctcctttccctcctccccttacctttctttttccttgtagtttgctctcagtggactctttcaatctagaaaccactctttcattctaggaaagacaatttattattattttattcatctgggatgtgtgttcttctgacattgctatattgattcagtgaaatcccatcagacttttaaaatatgtgtaatgtgacattttgattctaaaatatgtatgaaaatgcaaaggacctagctaaaaacaatttgtaaaacagtaagttgggggacttaaaacgacctgatttcaaggttatctgtaacacagtcagcctacaagtacaacctgcaagctacagtaattaaggcttggtggaaggatattaaggataaacgaatagatcaatggaatataatagaaagtccagtagacaaacacacatgtatagtcaatttatttttgactgtggtgcttataatattcagtgggaaaaaaataggcttttcatagtgatgtaacaaactggaaaaaggtttgaaaggataaattttaatttctacttcataccatatgcaaaaattacctcaagatggatcattgacctaaaagtaaaagcaaaaactctataaagcttctaaaagaaaacatccaaaatatatttgttatctggcataggcagaaatttctttgataggacaaagaaaccactaaaaaataataaattggattttatcaaaattaaaaatttctgctcatcagaagttttttaagaaaataaacaggcaaggccaggcgcagtggctcatgcctgtaatcctagcactttgggaggccgaggcaggcgggtcacttgaggtcaggagttcaagaccagcctgaccaaaatggtaaaactccatctctactaaaaatacaaaattagctggacatggtgtcgcatggctgtaaccccagctacttgggaggctgaggcgagagaattgcttgaatctggaaggcggaggttgccgtaagtagagatcataacactgcactctagcttgggtgacaagagcaaaattctgtcagggggcggggggcggggaggaaagcagggaggaggagaggggaagggggggagagagagagagagagagagaaagagactagaagaaaacattcacaatgtatatatatatatctgacaaaggacttttgtatatataataaaccaaaactcaaaacaacccagtttacttttttgtttttgagacaaaatctcactctgtcaccaaagctggagtgcatcatagcttagcctccagagtacctgggactacaggcacattacatcacacccgactcatttaaaaaaattttttgtagaggtgggatcttgctatgttgcacaggctggttttgaactctccttaagtgatccccctgcctcggcctcccagagtgctagtattacaggcattgagccgctgggccagcccaaagaacccaatttgaaaaatggtttaaagactctgatagacacttcacaaagaaggcattggaatggatgataagtatatgagaaacagccataagaacattagtaataagagaaatgcagactaaaacaaaaaggtgataccactacacttccacccgaagggctagaatttaaaagaccaggcaatatcttggcaaatatgtggtgtaagcagaattctcctatattgttgaggaagcagaaaatggtacaaccactttagaaaactctgctaggtttttaataaaatgaaacaagcacctgcccctgacccagcagtcctaccttttgttatttgcctaagatgaaaatactctcagaaagatttgtaagtgaatgttcatagaaagtttattcagaatagccgccaaattagaaagaacccagagtgttcaataatggaagaatgaagaaacaaattatggtatattatttaacaaaatactcttcctcaataaagtggagaaaatactgatacctgcagtcatattgatggatctctgaaaatgctgagcagaagaagcgagacacaaaagagaacatactgattctatctctatgaaatctagagtaggcagaacagatctgtggtgattgaaatcagatcagtgcttgcctctggaggagattgacaagaatggcaccagggaaccagggaattttctgaggtgatggaatgctctgtatcttgctgtattttgtgaaatagaaaggtgtctgcatttgtcaaaactcattgagccacatatgcttatgatttgtgcatctcactctatgtaaatgatgcctcaattttaaaagcaatcctgaacaataacaattatatatatacatatattattattattattattattattattattattattattggtgtttgttgtttttttttttttgagacagagtcttgctctgtcatccaggctggagtgcaatggtgcgatctcggctcactgcaacctccgcctactgggttgaagtgattctcctgcctcagcctcccaagtggctgggattacaggcctacaccaccatgcctggctagttttttgtatttttagtagagacaaggtttcaccatgttggccaggctggtcttgaactcttgacctcaggtgatctgcccgcctcagcctcccacagtgctgggattgcaggcatgagccactgcgcctggcctaatttttgtatttttagtagagatggggtttcgccatgttggccaggcttgtctcgaactcttgacctcaggtgatctgtctgactcgcctcccacagtctgggattacaggcttgagccgccgtgcctggccagtaacaataaaaattatagtgatagatttttttactctcactgagcagtatttgtggttttctgtccttgttctcaaagcacctatgtatttcgacaatttagatgacttgatgaatatatgaacactgtgcttttaatgaattcagcttttatgcctgtggaacaatactgtgataaattttatttctgcccatgtggtttcccctttcataatgtttgaaagaaccctagagtgaaatttttaagaaggttatcaagtttcttttgagaattattctagagtatctgttgcaccacatcaggtatagtgtacccctaagtagctagagtcccctaaaaagttgaggggatgtgtttttagtgtgctttaaaaataacatttactattgtttctttctttctttttttttttttaatacagagaaagtataaagaagaaagccaaaatggcccattatcttatcatccaggtagttcatgttaccctttaaaaaatcagtagtacctgcttctggtaagagaattcagttggtgcagaaagttataaaacaaaaaatcagcttcatgcccttaatatttatctccaaagataaccctgttaaatgtaaaatgccttgcagaaaagcttattatatgtcagaatacataatttatatagatccttaaagaatatttacacacaatagcagtttttttctgcacttttttgtagcttgattttttattcacttagtaacttagtacatcttgaaaatatttctgaattaacacatacccttttcctcctcctcctcttcttcttcttctttgttttttgagattttctcactcttgcccaggctggagtgctgtagtgcaatctcagctcaccgcaacctccacctcccaggttcaagtgattcttgtgcctcagcctcccaagaagctgggttttaggcatgcactaccacacatggctaattttttttttttgagacggagtctcgttctgtcgcccaggcgggagtgctgtggcgtgatctccgctcactgcaagctccgccttccgggttcacgccattctcctgcctcagcctcccgagtagctgggactacaggcgcccgccactgcgcccggctaattttttgtatttttagtagagacggggcttcaccgtggtctcgatctcctgacctcgtgatccgcccgcctcggcctcccaaagtgctgggattacaggcgtgagccaccgcgcccggcccacatggctaatttttgtatttttgggtagagatggggtttcaccatgttggccaggctggtcttgaactccttgcctcaagtgatccacccacctcggcctcccaaagtgctgggattacaggggtgagccactgtgccccacccacatacctattcttagttatatagtattcattacattgtataggtgtattatatatttaactagttccttattggtagctatttagattattttcattgttgaattaaaaacaatgttttagagaacaactttgtgctggtgaaatgtacttttaaaaattaaccaatgtttaattcttcatagattggtaattttcagcccttttcttgtcataggagagactggaagtagctgtgttttctcgaccttgttactgttgagatactagattggaaaattctttgttgtgggaggccgtcgtcctgtgcgtggtagaatgtttagtgacagccaaaatgtctccagacattaccaaatgaaccttggagtgcaaatttgcttcttcttaggaccactggtacagcgggcactgcaggtttacacagatgaacctttttcctgactgaggagctgcagaagtcagatataagaggtgtattccttggggtttgaatggatgccagaaaaggggaatttggggaatggctatagggatatctcatagagtccagggagaacatcagagctttgggagcaagtcatagttgccagaaaccaaagcaatccagtatgtgttctttcatacatttagcaaatgtttgttgaatgtctgccatctgctagttactatggtgtgggcataggtatttcatgttgaaaaaagagatgtgattgttacttcatgaagcttgagatttagaggcagacacagacgtgtgtgtgtataaaattataatcacctacttgctattaaaggaagagaaccaggtgctatgagaaaatgaaatatgggcctaatttagaaggagggtggtgaaaatgtagtcaatgaaggcttctaaacttgagtgagttttactagatttggggaagggattgatgagtgttccaagtggaaggaatcgcatgtatttgaaattatcaaggtgggaaatattcaacttgtcatggaatggaaggaatggcagttcacatggagggtgactgaatgagaaaggaaaaacaaacaaatttagattaagggtgtagagacagttaggtatggagagatgggccacataatgtagggccttgtagataaagagctggatgacatccaaagtgcagtggggagttatggaaaagttgtaagtaggtcagtgatttacaatttaaactgattatttacagtctaaagtaattattctggctgccgtgtggactatgtactgaaaggaggtaagaatatagttagggagacctgataaaactatggtaatgtaggtaaagcgtaatagtcacctatcatgacttcaatagtattaaattgatgacagtacatgtagagagactgtaaagacattttggaagtaattaataaatattggtgataatttgaatgtagatgatgacaaggaggaaggtgttcatagtgacttgtagaattctggcttgaattaatgggtttagttgcgattactgtgatggagactactgggtatggagcatctgtaaataggggtcatagggcaagatcgagttttagataatatttaagtttgagggacctgtgacattttattagggatatcaaaacatacatatatatattatatatatatatagcgtgtgtgtatatgtatttatgtatacatgtgtttctgtgcttatgtgcatgtatcacatactctggtgttgaaaatatgagtctggtgccagaagtgaagttgtagattggagataaaaagttgaaaattgctgccatatagatgaaagggttgcctaggaagagagtgagaatgtattttgatgagaaaattgtgtccagggctgagccccaagaaaatctaacatttagaggttggatagaagaggagggacaggcaaaaattaaaagatgcttgataattaggaagcaaactggtagtgcatgatgttatagaaatctagcattgtttcaaagtgcagttgggaaggaattgtggttggctatgtctaatgttctgagaatgctagtaaagctaccttgttggcaaaaactcctgagatacactttaaactactcttaatttcttacttacttgggaagaggttttagctgccactggaaattggggcctaaacagggaaaggatctcatgaaaacatgtaacctatagatttagggcagttttccttaccttttcttgaagaagcatagcccagaaaaactgttctaagggtaaacttagagtacaactgacacaggatcagctcttaggaaacagtcaatagcaacatgatgcaaacatgaatgtttgtcttgtcctctttaatgttactcttttctgtggtgataaaacatttctttgtatgtcataaatcagtactacttcagaatactgcagacttatctaatttgtctaatacattctgttcactaaatatgagtatcagaatttgaaattttctatttagaatgtttgagccattcttctggacatttcatttttcagtttttccttttgcctcatcttagatcacagcaaagatactcatttgttggtagtgccaggaagcaggcagtttccatggtaactgacagaccgagtttactgtggaaatttccggaattaacagagctgcattgcagaaggatgcataaagcagtattcatctagagatcgtaacagtacggacacagaagaacagttgcagtgatgtgcagggtatgtcttacctttattttcctgtctaaggaagattagtcatatatatatatatatatatatatatatatatatatatatatatatatatatatatatatatgcatgctgaggagacagtaaaacagcttggggcgttttagtatatgctggcttgatacagtcaaagttgcttaggaaaaagaaggaagaaatgatttgggaaagaaggtatatttgatagcattgggaagaaatcaagatcagatgatcgaggtagaagaatgtgatagtgaaataagaggagaaaacatacttcaaactaattaaataataaaaggttcttacggatagtggttctaggcacaagaagatatttatttatttattgaaggaaaatagtagacattgtcaagtttgagaaatcaagttctcatgtgcaggaaaaagaaatctgttaagataattagctattacttgctgaaagataggtagatatgagagatgtccaggatattaaacaaggaggtttgctgccatcttagcgtacttacctaagtgatgagagaatcctagaagggtttctgcccctaattccactctctgttgattggtgggccattttcaagaaaaattctgaaatgtatcttgagattaaattctggaaacagaactataggatttgggcagataattgaaggtgcttatcatatagagcataattataaatgtaaaagagaaaaaggatatagaaaatatgatttagattatttgcatgatagatgcaatttaggttgctagataccatttggtatcatttatatcatgtagtcagcaaactacagctcatgagccgaatccatcctgtttgcttgtttttgtaagtaaagttttattggaacatagccacacccatctggctgcatagttgcaggagactagtggcttgcaaagcctaaaatatttgctatctggttctttacagaaaaaggttgtgactcatgatttagatggtgtactggatttttcaaggcttctgtgagattaccacaaacttggtggcttaaaacaacagaaatttattctctcacagttctagaggccagaaatctgaaggtgttggcagggccatgcttctcccgaaggttctgggggaggatcccccctttctttcagcttctggtactgctgctcttccttggcttgtggcagcataaccgtaatctctatggtcttcttccctgtgtctgtcttgtgcatctctatcttctccttttctttgtttggtctcctataaggatagttattttatttagtgcccacctaatccagaatctcttttttgagatctttaattttatccgtaaagataggttactttctgagattctggatggacctatcttttttttgtgtggtgggtggtgtatagttcaccctactacagatggtattgaagaactgggttttggcttcttaaatcacattgtatattaaggatagccagttcttagtgtttcctttgacctgctggagaagatattaaactcacatttcaaaggcaaggtgatagaggcatagttgaatcatagaagatagcctttgtgacacaaacataagcagtagagtaaagggagtactagaaaattcataggagaaagagtactaaaatattcactggagacggatgaagaccagtgcctgatgcttcatatcgttctcttcttgtctcttcatatttttctcaccctaactcccacctccaaaaaaacaacaaaatgaatttgaaattttaatgaaaaatggttggcacaaaaacaaaaatcacagttttgaggaatggctcatcgctaaattacggcactgggaaatatatatatatgattcaaaagaagtagacttaataagcaagtagaggagtggcagtgtagaaggtacacaccaatgtatagaccagtgaacctgagatttggcttttgttgagagcctttttgtcattgtgggagtatacaaactattggcctgggcaggagagaaggtctgtgacattttcctcttctcatatgggcatatttgtaaaccataataacagtggtaggtatctatttgcattccctggaagtctcatttactgtatttgggtatattctgaaatgtttaaaaagtgatgaattcacatggtgaagaatcaaatagtaggcaagggattccaatgtagacgctggagctgcagagaaaagccaccttatattgcctatattctcacctgcgcactttgaaatgaagcttctgatacagacttcatggagatgatcatagaagaattaaatagaaatggttaatccaaattagggttcactaagagtaagtaagcagttccaaactagcctaatatacttttttgaaagtgttactaggactgtagatcaggagtttggaacagactaggtgtatcttgatttcaacatttatgggcacagaggaggaacatgaagcccaatacagtattttcaggaagtttcttagaaggacaagagtgaagtctgcgttttctttctaatcaaattctgttagtctgtgaccatgtatattctgaatatcaaataggaagccatgggaatgaaagttttcttattttcttcctttaacaaaacatttgaattgtatgcctaaataccttcatagaaagatacaaattcccttgaatccaactacaattagacttttaacttttaatttttctgttagtgtcatgagtatatgataagaatatcataaggaactagaataaaatcaggtataaagcatagattgggattaaattgagctggttgatcatagttcacatgtacaggctaaaatttaagcagtataaggtactcatgaataccctagatttcaggtctttgtgttatgtaaaatacacatgttcctaaatgtgtctatacataaaatttatttctataaaattgttttccttttctcatcgacatgtttaaataagtgtctcaaaaataataaaagtaagcttgagggtgtttaataagtaggtgttcaaaacacaactcacatagtattaagaattagctaacagatcacaaatgaaaagtagttgagactcttggtttttaatttgctttaagaactaaatttctgactttgtaaaagcaatctgaggtttgtagtacaaaatgatatatgagtagcagtgtcctgctaaaatatttattaagaaacaaagatgaaaatatgaaacactgaaaattaagatgacttaactccctataggatctgataatggatactaatagtaacacagccagaataaggaaaatttttacccagggattcttttatagcagagacttcatcccttttcatgttcatttcttctcctgcccacactggtaactaccagaaaaaaactggggagagatgggaagagggaggatgctgatgaattttatctgggaagtgtcattatgagtgaagtgtactaggtggaagtagagaaggattgtagtaacagtatagtgctgcccagtatagacttaggattgtatttttatattgctgttatcagtccagaatacagtattagagaccaagaaaattggagagaggagaatttaccatgggagcagtgagtgctctgatttgtaatatactaagccttagatatctcaaatctgcctttgaaccataggcatgtaatgggcaaatccgtatcagacaagtagagtgcagcccaaggataatcttctttttctttctctccttctctcagcagttttattgaggtataattggcatagaataaactgtacatatttaaagcgtataatttgctaggttttgacatatgtgtacatctgtgatgccatcaccatagtcaagttaacatatccgtcattcccagaatttcttccttctcgttgtagattttttttttttttttttctgagacggagtctcgtactgttgcctgggctggagtgcagtggcgtgatctcggctcactgggaacctctgcctcccgggttgaagagattctactgcctcagcctcccaagtagctgggattacaggtgcccaccaccacgcccagctaatttttgtatttttagtagagacgggggttcaccatgttggccaagctgagctcaaactcccgacctcgtgattcgcccacctcggcctcccaaagtgcggggactacaggtgtgagccactgtgcctggcctctcgttgtagtttttgtgtttagacatttgatttggttattttttctgtcttccacgtctatatttaacatactctatccatcctttcgtttttttaatatatggaacgtggtaaatgtttcattgtctttattctagtatttttgtcatttctggtcagttgcaattgattgatgtttttctcttcactatgggtcatgtttttctgcttttttgtatactgtggtaattttagattgcatcccagagattattgtgtgatggctgtttttgtattttcatgaatgtttttgagttttgttctttggttaagttacttggagatagtttgatcctttcaggtcttgctttttagctttcgcagatgagactactctagagctaattttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccactgatcaaggagggccctctgcatatcggtggggttctctttctgtgtagctgtctcttatcctgtactctgccatgtgaactttggctaccttggtctccctagattcccagatccttgtccgcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaataatatcttgaagactttgagaaagagcatctccaaacaagatatcttgcaggattcaaaatagtttcttacaatagtgactgacattgttaatacagtgaaagaagtcatggcgtttataaaaatggattggaaaaatctcgaggagagaacagactggatggatacgcaacaagattatagaaagggggcagatgaggaaaagacataactagggacctgaaaagcagtggtagagtgaaatcccttttgatgcaattgtgaatataaatgatactgcatgacagcaaaagaaaagaatttgagggcagtcattgatttgaaagcatacaaattactgaattttttaaaaatgtaaattcataaacacaagggaaggtaaacaacaaactgggaaaatatttgcaatgcaggacaagggttgatggtgttaataggtaaggaacttgttagtagaagcagcgataacaaaacaaacacctgggccaggaaggctcaggggcgctatctcaggcagttaataataatacaaaaaagacatatttgttcaccagatagcttaagaatgttcaactctagcagttgaaaagaatgatctaaccctaacacctttcaaattggcatgaggaaaaaggtgctgttgactaggtacagtgggcaccttttggctgatagtactcctaaatcagtgcagacttggtacacagccattccagtagtgataaccaattatttaatgactgtgttaaaatatattaagtgaaatctataagcagtaggtataatatgctgtttttgcaacctattcccatagtatacaaagatacaaaataatatgtactaaattgttaatagtggtttttttctggattatgattgatttttccattttcctttttatcttctacctttgtagctttaggagggattttagattcggtgtctggttggaaaaagaggttcaagtactggtactgctgctgaatttgcacagcaaacacactgcatctaatagagggtgggagtgaaggtggaggatgtggctagagctgttctaataaccctacttgactggccactgtgtttctttacaaaacaaggccacctgcctatatatgaagttccaggcagctttattagacattgtatagaaatacagcttttctcagtgtccagtctgattaatgttctgggacattatgtcacagttctgtgtgtgtgtgtgtgtgtgtgtgtgtgtgtgtgtgtgtgtgtgtgtttagtctgtaggatttcagaaatttcagactagtagattagtctgggtcaatgaagggacaacaactaaaatacagtagtgttaattcagtattaaatttaagttaacagatatatttgtcatttctatccagaagataaattaataatcgggaaggacttcactgcaaacatgtagcctcaaaaaattagttttcagattttaatctaacaagataaatctctgatatcaaaatataatttctgtacattgagttgtacttttaataaggcctgtattatatgaattcatgccctatattaagtattctatctataatcttgcatgtttcgcaaaagttaggaccattcatatttcacttcttttgaatgtctgtaacacctgtggcagtttttctgggtgtatgtgcatgtgttttctctagaatgtggaactgttaagtctctgggaaccaagaattattagatgtggaatagtaaggcactgaaatcagggacaccagagttacggattttttgtgtgtttgtattttgtgtgtgtgtgtgtgtattttttgtgtgtgtatcttaatcaaattgtattgctttattcatgtgttttttgcagggtactgtggtatggactagagaacttggaatgacttatgaagaaaccttggaatgacacatgaaggatgataggaaagtcattctgaggcaggatgctttactgaattgtttttaaccagggtatcaaacatcaggaatgagttcaggagaacggaaacatcttaggtgctctgcatgttcagagaaacttctctagtaatgaactatagaaatgacccctgaaagtatagtcttagagttaagattctattcaaggaaatacttttggcctgttgctggaactgctctgtggatttggagacagttagcatcattggcccccagccactaaatgctgcttgcacttcccagtgattgggatgaccaaactgctgctgatgctggaggtgtccgggcactacctcctttgagaatccctgggaaataaaataatgctaggggctgtattaattaaaattaagtttgtttgcatctaaacaacaacaaggataggaacaaatagtggcttaaaccagatagtttatttcacttttccatagaaaagtccggagataagcaggctagggttggtgtagtagcttcactgttattggagtcaatgctattttctgctccatcattctcaggacattatttcagttctgcagggcattgagtgtggctggagctctagtcattacctacattccaggcaacaagaaggaggttggaggaaaagaaaaagagtcttttttccaactgagttagctccttttaagtactgtgttcctattttccacctctaactgcaaggaatgttggtgacttagcttggcctgcaaaataccacatactaggtggcttaaacaacataatttatttctcacaattctcgagactggagagtccaagattaaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtagccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgagatgttttgatatgggcatgcaatgtgtaataatcacatcgtgggaaattgggtgtccatcttctcaagcacttttcctttgtgttacaaacaatccaattgtactaggaattatttttgataaaatatagtccccattctgaagaaagtgatatcccaaggaaaagtcagggaactttttttttctttaagagtataattgtaggcaaatatttatcaacaagtaagggcaactttacatctttattggtttgtatttttcaccaatcttctcattgggtgtgttttctactgtttatgttctttctttcctaggcctcttacgtagtttaggacagaaattgattgactccagagtttaatggaaaggttctggtccagttcctgtatctagtcagtccagtgctgtatctgtgtatagtcctgtggaagccattgtggttgtacctactgttaaagcaattgctgtgaaatggactcagttttgctggaaagatcgctagcccagtataaagacgaatgtatgaacatgccttggtgatgtcataactgtggcatgtttttctgtggtttttacagcactttttctttctaaatgagaaacttggaactctgggtaggaatcacattctcctcttttagcagctttgctgagatgtaattcacatattctgcagttacacatttaaagtgtatagttcatttgcttttagtatatttagtatatttacagaattgtgcatctgacaccttattcagtttttggatattagcccaagtaggtaccctgtatcacttcgctttcaacttactcagttttaaaaagaaactacagtgagctaaactattagtagagatattccataatactaaaatttgatctttaaaataagacataatattgtaactgttttcattctgtaatttctatatagtaatgaaatatctttcatttcagttctcaagaatgctagcataagtattatatagcaatgtagtcatgagagtcatattatatcatctttaccatattctcttggttagaggtaagtcacaggtcccactcacacccaaagaaatatgcctacacaaaaatacgaacactaagaaggtggggatcatgaggacttcctggagcctgtctgccacagcccttcaattagcgaacactgtaaaaaattttgcttctgatttacaagtaattttaattaactttttttcagcttccctcagtggtagattggtgctgtatatttcaccagtgattttgccattgagatagtatttacttgccaaagattatagaacaataatcattatacatggaacttcttcatgttagaacttttttcaggcttaatctgtctacttcatgaaaaagattaccaagaagagtttcctatttttgcctagacctgatttccatcttaaaagatcagttccagcttcatcttcacctaaatggtcacttatgccactgatttccgggcttcttgtgattctggatgctagagtatcaaataatatgggtgaaaggactttgaactgaaaagcacttgtatgaatgaaagcttatcacttagtatgatttgaaagtctgttatttggaacactgatttagtaaattgttatttagaccaagtgtatgaatctttgaagtgtaactttgaaccttaatattagtacatacgattattctcagagtgggggtagattttaaagttctaagttttttgggaaccttaaaggttgctacagaaaaccattctactaattggagaaaactttcctaaattttggaagaagaaaaataatgaccaagcacataaactttgcttgtttgcatcataggatcagagtttaaaagagatcctgatcatttagtatgaaactgaaaaatgtagttgatatttaatgaattctttcattgtgtgtatggttgatagtttgttcctacacattggggtttggtgtgtgtgtgagagagagcaagagagagaaacagattgattttacatttttcattggatttacttttttacaaagcatggttagaagttattaatactttgatctccaggttgagattttggagatgattttttatttaatggaaatatgtaatgagtgagctcttttgtctacgagccactcattttttatcccattgctttatcgaacgagggctgaaaatttcaattttgaatagcacatggcaattttcctcttagagccagctagctattcagttaactgttctcccacctcaggatggtattaacaagaacaggacagtatactaaggcactagttcccaaacattactggaatcatctgggggtctttaaaaatactgttttctgactcctgtccctggataattcagatgtaattgctatgggacgatacctgggcattgagatttttaaaatctcccccaggtgattgtaaggtacagcaaaccttgggaatagttgtactaactgaagattgaggcactggaataactaatgttgggtaagatagggtaagaactttttcgcaataaggtttgcagctcttgggattctcacttgataatgctgtttggataaaccatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacacaaatgaaaaacttcaaaaacctggaggtcagactattttagtaatttagaaaacatttttcccacacattaatcagtactaaaagaaaaaagttaaaacctatttaaaatgtggaaaaattgcttcccaatattttaacagagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaagtaggtgatgccatgattatttttggtactttaatccattaggtgaaatttcatggtgcagtaataccactgttgttgtgttcctacttttgtggtaaatgtgggtgtttaaaaaattgtttctccaactcctttgagggtgttctgtgtagaggtttcttattggtggcacattttctatctctttggaaacatgagtgtatgaagtgtgcatgttgattgcatttttggcatgatgcattaacatgttttaaacttcaggcccttctactgccaaggtgagttcaggctgggcggctgcacccctgggagcagggcagtgctgcactgagccaggcgggagctggaagaagacgcagcacactgggttgggcaaggtgcggggctagggctaacagcagtcttactgaaggtttcctggaaaccacgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaatacctggcaagcttatgctggtacctgtaaagaactggtggtttccatctgactcctagtttcatgtaattgtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgtcctattttgagagtttgtcagagtggttgataagagtccttagttttttcttgacatttgagaatgaatttaaattaaaataaaatgctttctgtgtagaagtctgttgtgagccaaaccttactgtaactattttagtatccttcactgttgagcatttctttttgctgggtcatatgaaagtaatgttaaattagtggtagggaaaatttttatgattctctctatgggttcctaacattgtttttggctgtatttttaaaatgtggtgagaactatagacttttcataggcaggtgtatatacacaacattttgtatacaaaccgtagacctctaaagatgcacaggtgaagaactctgcattatgtgttaaaataaaatgttttattggaatgtgaaatgatttctgtattcctattttgtgccactgcagtgtaagtggaaagagtcattttatttagactcctggatgaatgttgtgttgtccctttgtgctacctgtgtgtgacatccagttttagttggctggatcttaagggaaaggtttcctatatagttaaagttgtaaacttttctttcaggtactagggaaagtaattttaaaaaattatttcctgctttttacagtttgtgttatgtgtgcttcaactttgttgatgaacattattaaacattttagtaatatggattgattttagccattgttaaaaaggtcataaaggtaaagagggtacttccttttgacacttaaaagtttttctcactgattaatttgataatattttgggttgtataatgcttactcaagttttgtaggaattcaagaatgaaaataggaaattgttgtccatcatttgtaatgttacattatcagtggctactggctactgtgacagttccagttgggatgctattaaaaatcccagctgtacttgaagaactttcaaggcagtcatgagacctacaaactggttgctgtcacatgtatacccaccacatggtactacctagcttcgtttaccatctcgaattcttgaacaagcatagcagttggggatgggagaggatggcagtacaacacatcaattaacatatagttgaggagtacctttggattccatgacttcattaatactggaagaataagtgtttttgcattaatatgcattaaaatttgataccaattgatgacagatgtatgccatctctgaattaaagaatgcatttattattggtttcttcaaagaagaatagtctttcatcacacttgagagagttcattcattcctcatttaggtacattgactggattgacaggcacaaatatacagaatcaatgtatgattaaggaggtgtttgatttgagactttacggttttaaaggaaccatgagacggtggttcacacagctgagagctttccattgctgttggtgaaatgagaaacacgcttgaagtaactctgtgctaacatcttaatacacactttgagaataaagaaggattgcattattagatgttaagctggaaatgatccttaagatttacttgcaatatctgtagaaaagtgaactgtgatattagcttgatttttttctttgtattattcctcatttttagttctgaggaattccttccccaaatttattttgccatatataagaaatatttgaaaaaggtgacttcttagtaaccagagttaattaccccaaagacttaatctaaaaatcagttttgatataatcagatttagtgaggtaacattgtaagagttatacttaaaacaattttttgatgtttggtttgaggacagtctcccaagctatcggtgagtttctgcattaggacctaagatgtgaacatggtttaccctttagttttaattgcacgtgcttgggaaaagggtcttgctctcctgtgagtgggagtaatttgtatacttgtgcctgaatgactagtcttagggctgcctagggcaaagccagtgttgcctctggggtttcttaaagctcagggagaacaaccttcaactcttaccagggatttacttctaactgtgatcagtatcctttacaaataacatttatttagtgtcctgttttgcacggtggtggggtaaccactgaatgaaaacattagacatgaacagtcactgtcctctacataaagtaggtgcctgctcagctctctggcaggtggaaatgggagaggatggcaatacaacacatcaattaacatatagatgaggagtacctcatctatatgttaaccagctctctggttaaatgtagcggggtaaagcccagagttcagaccaaatgtttgaagaggcagttaggattaggtttctgagctagggtaattcagatctgggagaaacacctagcatcatcagtcagaatcaggatgccacagaaaatctagggacacaggagaaaagagagtaaatgaaatgtcacagcttagaccatgggcttacaagctcagatggctgacagagggaagaatgactgtaagcctctgatgcctgacagtatattctccacctgactctgcctgcagtgtaaaaaatcctgcatgcctagagtaccagcttccctgttgttttctagcagactcatgtccagattgacttcttgaaggtatgcatgcccttttcatgtttgtagaatatgtgcgaaaaaccaaagaaacgtgaaaaagtaagaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagtagaacggaactttaatctgctggttgagtaggcctccctggtgtagatagtatggtgagtatgggaagtcaggtatcagaaaagtatggcttggcttgttttcctgccactggagagaccatgccacttctgtcaaaagttccattaccaaattatttcagtggggattatgatgatgaataatgatttgaggaggttcattttagtgtttaaacattggtcttgcatgttctgaaagcactagaatgatactgggatggccttcaattggaaaagttcctttttgatggcatagagtgctttgttaggccattttattcacttccaaagggccgcagtgatcatatttgattatccaaatcacctatgggatgcagatgtcatggctcttttgtttagaattgagactgtagtctaatatcttaggccgtcgttcggtcagatcatgtgacttacttaaggcatctgtgattgagctgtattcttttatgcttcctaatattgcttaaaagctgtggtggtcatatgaaaagtgtaagtagagcatttccaggaggagacatattcaaggggtgtggcagggctggcctctaggcagccttgattttgaactcaggttgcttatgtagatggggttggaattcccagtatacatgtgtgcttgttttgctgtcactccaagttaatgtttttcagactgtgagtttgttccattaacagaattggatgtgcaacccaagaaataaaacagccaaaatcagtactgttcggggttatgtgagggtgggaagcagactctacctgcagccatattggaagcccttggggcaccagctctgaggaattaataggggtacaattaagacagtttggaaatggttgctctaggtgaattttagtcaatcattatatgtttttgaacattctaaagatctggtttctgaaaccttctaccatcacttggttaaactgaatgaattttgacattggactaaatcccaacttacatagttatctggagaaaaacctgttttttgttttgttttgttttgttttgttttgtttttgagacagtttcactgcgtcgcccaggctggagtgcagtggcacaatcttggctcactgcaacctctgcctcctgggttcaagtgattctcctgcctcagcctcccaagtagctgggactaaaggcacgcaccaccacacccggccaatttttgtattattagtagaggcggggtttcaccatgttggctaggctggtcttgaactactgacttcaggtgatctgcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcagtgctaagattgacattgtttctttaaatgtggatgatgtggttagtaaagaggaagaagatgataccactcttaccaaggcatgtcaaacttgttccattaacttggtcctcagggcagctcttcccataatgtaatataacacatgcttttggaactgaactcccaggtgctctgataatacgtagcagaaggtaaggtaaaaggaattaagtggatctcagtatccccagtgagaagaatggggtattactattaattaattaattaattaatggggctaagatacaactgagagtttattaaattgattttaaaagacttgaatgatttttgcaattaagaattagcattctttcttctgcccgtagtaaaatcatatatgctttcacaatttaaaataattgacttaacagacacttattttttcacaggaaagaaagatttacatctgtgatcagcattctagataatttgcttgcttcttttgctgtttgttttggttaatgttgccatctgctttgaccttattaatgatggctttgtgagatatcatggccattttcgtgtgtgatctatttagaagactctagctgataaggaggaactcgtaccacaaattaggaaaataagaatacctaagattttctgcagcccagaggaaggtgataggatattgatgtgctgctatggtttctaggattttccaactttggtttctaggattttccaactttgtattacaactgaattctggacatttttgctgggaaagcagcatatttgtagggttcagaatagtagggacactggaggagtgtgatccttgctctcctatcctctacatcactgactttggttgatctgatgtcaatcattgactagcagtggattccccttcacattaatgacagtaaccttaagagggatctttagcagggattacttaatgaacaatgaagggtatgtttatggcatagcagtattggtgtttgtagatcacagaaactggatgcgttttcaaaatattacaactgtgttgtaatattatatataaattatatataatatattacatataatatatattaaatattaaaattacaatattaaatataatattaaatatacaatatttaatatattatctataatatgtatgtaatatataatatatattaaattatatctaatatataatatatattaaatatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggtgtggtggttttagccatcatataattggacaggacaattggcaattacttgaaatacagaatacagattcttttttttttttttttttgagacagagtctcgctctgtcacccaggctggagtgcagtggcatgatcttggctcactgcaagctccgcctcccgggttcacgccattctcctacctcagcctccccagcagctgggactacaggcgcacgccaccacgcctggctaatttttttgtatttttagtagagacggggtttcaccgtgttagccaggatggtttcgatctcctgacctcctgatccacctgcctcggcctcctaaagtgctgggattacaggtgggagccaccctgcctggctcggaatacagattcttttggtaaccttagatgatagtaggtgcttatgtaggggaacaagccccctgcactgaagtatgggttttagctaacctagttatagcagattccacatagattgctgaagagtaaatgccttctggtattctgattttggttggtggtaaattggaaatgatgctttgccttgctaatggccaaattactagtagcttgcattattttatcttgtgtctatttgttttaattggtgcctggaagaatctctaaagccctacactgatttcctctaatgattgaattcgttaccttgctgagtttcattgtgtctgagtcctaatttctgatccaggaactcacctgtcttttactttggaatactctacctattcctaacttctctaagcagctacaggtgtacctgtgcagcagggagatgtatctcctactctgctcttactgtctttttatactgccctctcggacactcagctgagccatacaaacacctgacaagaatttgtcatgtgagaatttagagatctgccaggactgatggtcatgtccttccatgtcagttttcccatttcttatgctcctcacatctcattcctccatgcattgtctccattttaaaacaaaacaaaaatagcatcagttagaattgatagccattttgtaagtttatttgattatgttgctgttttcaagtgtgtctgtggcaccactgctttctaaagtcattttctggactcctcagttcttgattccttacatgtttgctgatgactcatatcctttttgcctagaatgttcagatcctaggaactgacatctgtcatgtcctccgtagaacttctgtttatgaagtgcatatatgacttgtcatccgatccttttttactcttgagtcttttgagtatataatgacctattattttccctttctccctgcaggaatgggatcaggtaacccagagtgcctcttcacatacattgttcaagagcttaacttggtaggaaggaaaactgggttatttgggagaatcagtagttgtcacatcaggacaccggcagtcacagaatgggtcatttcaaggcaggccctggtgctttgggataaggtgtgtgctgacctctctagtaactgagatatctttgagcaccctaacatggagatgtaagggttaactctgaatcagggtgactggcaaggaccactatcagaatcagccaggtatttattgagcatctaggcacaatgctacttggtgacctgcttcttaggaactacaacgtgagcctttattttgcctcgtctgcaactccatccttagcctttgcgttgtcagcctgccttcctttgccacacttgagtcttcctaaccttaccccttaatagcaatcacttcatcatcatgcgctttcccactatcccttctccctgtctcttcccacccatgaaaacaaatttagaaaatgaagggaaataaacaaacaaacaaaaagtcaccattatgatgggattgaggcataatatctgagtaagaagggaataaattagttttccttgacagtatatactgcctgtttctgtccatcctcttatttgcttctttttctttgctcttccactccagtccttaagcgagtttagttttattcgttcctcttgtcccttttcatgataacaatgtgtcatagtctgctttaaagtttttcatacttaccgatgttagttttattgctagtcattcatccctgatgagcaccaacaaattgtatgtgagagatggatttggtagggtttggatatgaggctggagaattgtgtcactgtgaagagagagctcccctggagatctcagtgtaaagttggaggacacctagaacagcaccacatttacattgttcttcagtatcagtaaaagagttatttatactttaaattcaagttgttaaaaatggaggcattccacatgaggctaaatattattcaagattttggtccatcgatgttataagctgtcaacatttaaatctaccaatgacttccaggtgccatgttgcacaaaaagaaggaaagcagcctttcaacaacttggaatttgggacatttctatatgattgggactgttcaccaagtggatgttgctgtgttttgtgacgagatggagtagaggacaaggggatcatttgtaactgaacatttttagcttgtcctatgggacttgttaactttctattaccgcggcctaatccatacagaactcccaacaactaaatttgtggctgatccaaccaatggcatgagttggactgacagttttagaaaaaatacgctttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttatatgcaatcttgaatacagatttggacaccaattaaaaaaaattaacttcaagtttataaatttctttactatagaaaactacttatatatgtagagtagtaatttttgttttgattttcaatgttttctttatgttatattccaaataaagtaaaacttgaaataatctgaaaatactttttattattgggaaagagatgtggattctttttcaagaaacacaatttaattttcctggaagcgtgtaataacttaagctaagttagtaaagtagtgttaagtaaaagagctcagtaaccccataatgaaaaagaatgattttgaaaataatataaaaaacttaatgttcttgagttgattttcttaagtattttatggtttcctgtagttttcattctactatttactgccagggaaaaaaaggtttgctgagctcaagtaaacagccttatctaacttttaaatttatataaataaatgaaattttcctgctattcaaagttttttatcaatggttgttgcttctgaacattatgattatgaggatttcaagtcatataattggcgtcaccttgttacttccatttttctgtgctcttaaggacagctttataaagggaagagaagtttgttcttattgatgttcaatttttaggtagttatgctcctttaatgttagaagatcctggactcacttgattcaaatgtagaagtctttcccatagatattgttttgatggttcattagaaaaactttcttggtagtagctttagtctcttaagtattctctaatttgaattgttgattgtcattatgtattctacttgagttatttattgagttattaaaatcactaatttgaagttactgctattataggcatgtgtttgtagttgatccccttttggggtcctttaggccttttgaaatagtttattaattgctcacatatgataaatgttacagttcaaccctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattctggttagtaacaattctgtcagagattgtctcagtgttaggtatcagtaagatgttggaacttcagttaggcctttagatcatgtagtccatatatcctttctgtagctacggtagggttttcggacacaggctcgctcccaaaagtcagttattgatgataactgttgaggttttgactgtaatatgcttcctagttgaaatataaatatttgtacaaatgtgtatttagcataccacacaaccagttttgtgaaacaaaagataaactagtaaagaggacaccttttaaaaatagtagtttatgtgtgttagtatatatccatttgccaatatattcatactagtaaaaatagaaaaaaatacatttgttaacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatctctgggctattttgacttttaaaaatatcctttttgagcaaacatgctgaagttgatttaaaagtaagattattaatccataaactatgaaaataatcaaaatgagaaagaagggaaactttccttaacgttaatagaactagtcttattttgtttccatttttcattcttactttagtgcttgtttatctgagcattgatatttaatataaaagttgtaggtaaatctgtgtctgtaacatagatgccagttactaaattttatttgcttatgaaatactgtaggtagcaagctgtaaattttaagtagcaaaattaaatttgtttggaatatatggaattcctcaaaaatgaaacggagagaacctacttctgttccttaaacaactgcttattctcatgtcacatgaaatacatcttttatatctctttgtgcctctggcttcttttctgtaaaatgggctcaagaatttaattgactgccttcatccctttcaagaacatttgacagatacttcgaagtctttggaagacaaaatgccaccttgtgtattttttgatactaacttgccttgtaagtacacactatgtattgtacacagtggcgtgatgtgacattgtgaacttttttatgagaacagaagttgtttgcatgctttgatgttaaactataattttattattatttttttataatttctgaacatgattctttcctatattgtccctcccaacacctctgtgttctatactgttcctgaataagaggtgggaggaggtggggtacttaatgttttctggcagtctcttagaaatgtgcaaagaaattgttgtacagcttggttaggaatatatccctggtctgcagtatatggaggagcgctttagcaccttaggaatagacaaaaagagccctctgtttcctcagttttaggttttcttccacaggtttatgctgccctacatgctgactcatgggttggagagtcaggtagaactttttgtttttaatgtatagaaagtgcagttaaaggacagagtcccaatctaggattttggagacctggattcttgcctggtgcactgctcctatactagtattcactttatccggttctggactatttcccgtctttatgaatgaggacactgtggtatgagtgtcctcatgagtgaatgagtgaagagggatgttcttgcattgaatgcctagattgcatacaattttgaaacggtgattaaaagtatgtatacagctacctataattattcatatgaaactgttaaaactcattatcattttctttatatttgcatgtgggggttaatttttactgcctaagaactttgttgcataactcccaacattattagtaaatgctcatggttaaattgccctgtctcctttaaaggatttctaagtgctgtttgttaaactttctgtgattaaagtaattcttgtgaagtataaggaaagatgataattttcatatctggtatttgtgaagtttggtaatttttagtctcgtaacggtttttctctaccatgagactaaaaattattggtgtttttgacaaaattattgtgtttttttgacatcttttgtcattcttttccagagaattcggtcaacagtggatgaaaaagaacaaaaacaacttcttatggatttggatgtagtaatgcggagtagtgattgcccatacattgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtgtgtgtgtattttagtattggtggctgtcatttgtaaatctcatacaaatattttctgttctttaagaacctgaaaaatcagctgacttctaaatatcagcacttttgctatagttttagattttcattgggccttgagcaacgcctcccccccccccccccccccccgccgccaactttatattttaacttttactcatctgtcatcaagtgtatgtctgcatttaatataaacacttatgtgtccctgcccataatcctgaagtatacccatcagacatggaaattaacaattacaatataaattatttttttctaattctcttatccagatttttgtgtagaaactaaagctctaatttcttggtctcataatcatgtttcttcttttggcctctggttattttgtgtcccaacttgggttatcatttctgcctccagctctcaatccacttactcatttccagtcatccagctgcctaaaatgtggaagtgagtttgggctaggggtagaactggagctgtaaatgaattaatacattatgatatcctagaccgccatcaaaaattgtgatacttagttgagtaggacttgaactgaactgctaagcatttcaaatactctctaaaaaaaatacctttctcattttgcaaatgttaggatgaataaccgagttgttataaactggtaagaaaaaccctcctgctctcttctttttgggatgggattatagagtgtatccttggggtttttgttgttattggctttaaaattaatatatatttttgaaacagggctgaatgtagcactgagtagaagtatatgcaatcttataattggaaacaatgttagaggttagttaattctaaacctaattctgaagtttttgtttgtttttctgggctcttactaggtaactagtaacaacacattctgcttcatgacagagcccatttctttgttgaatcactaattgttaattctcaactcgtagtttttttctattcctgtctttaaataatgagaatattcatttttatgaccagatatactgaatttattaattttcttccatcatttcacatcagcattccgttacatcagtatacagtcatgtattcatgtgcatgactgtatcttggacctaaatattatgtaatgttattctaaatgtttggaactttcttcatgttgcacaagaatcttaccatatcttcctccctttattcccaactatgaacttttcttcacgatcattaaatcatcacaccatatgcagaacaatagttaattagttaattagggactgaactagattttctctcctaactagattctgtggtcagctttttcagtgctgtattcgttttcattatagactttccccagctctacctgaaccctaaatcacctccatagtgctggaatataccaatttatttcatttgttcatttatttaatcattcatgtaccatttacacacctagccttgggctagatagtgtgggaatctgattgtatgaaaagaaagcagagtaagtcatattcatgattgacaaagatgtggaaacaaagcacggaagcttggagtggtgtctgaacaatattcccatggttttgttatcatggatagctgagtcacatttggttttatgtctcagaaaggttgaagggagttgacatatgcagctgtaaacactaacgtctgttgaatgctttgttgttttcacatatgttttcttcccagtaatcttcgggatttggtggtattatctatcccctttttccagataggaaaatgaaatttagtgtgtttgacaaaagttacacagccaacaagtagcagagatgggattccagagacagaaatcttgctgttccttctattttattagaagtggtccagatatgaagatatatatatgctttttaaataagatttttgacaggataagatgtgtgataaggtgaaggcttaggaactacacagttaagctgtacaaagacacaaaatacctaagtagatgaaacatgaactttcctcccaaatcagaatgcagtctgtaataggtactttctgaataataagagttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctttattaaaaatacaaaaattagccaggcgtggtggcacatgcctgtagtcccggctacttgggaggctgaggcagaagaatcgcttgaacccaggaggcggaggttgcagtgagccaagatcatgccgctgcagtccagcctgggcaacagagcgagactccatctcaaaaaaaaaaaaaaagtatgtgtgtatgtatatatatatatattttcatatatatgtaagtaataaacagattgaataagactttaaagaaacatttttgttttgcagttgatgacttaaacatgcatcttttttggtgacatgaccttcagttccaataatagacacaaaatctgagttcatgaaaggaaatagtagaaatgaatgtatgtagtcaggactttttagcttaccttactatcactgtgagagagacagtgctttcaattcctgttactgtgagacaccctccagggatttcatttcacctaatttatacaaccactagactcagctcttggtttggttcagtcagccatccatcaaggagcttatgagatgttccttttctcattcttgcagcaactatttatttatttaaatttaaatgttatttaaatttaaggggtacaagtgcagtttttttatatgaatatattgagtagtggtacagtttgtgtttttagtgtatccatcacccaaacaatgtaaattgtacccatcaagtaatttttcatcatccaccccgttcaactcctccctcccttctgtgtctccaaggtctccagttccgtattctgtccatgtgtgcacatgatttagctcccccttataagcgagaacatgcagtatttgtctttctgtttctggtttgtttcactaaagataatggcctccagtgtatccgtgttgctacaaaaaaaaaaaaacatgatttcattctttttttaatggctgtcactgtctattgtgtatatatgtcacatttttaaaaatgtggacatttaggttgattctgtgactttgctattatacatagtgctgccataagcataccagtgcagatacctttttgatataatgatttatttttctttgggtagatacccagtagtaggattgctggatcaaatggtagttccactaattagagattaatcttgctgttgggtaatattgagcttctgaaagttccgtcacttattcaaagcagtgaataatccttaatactgaagttggtaacttctatgttgccactatcttcaaccatgcatacttctttctaggatggaaccaacctcaaaaagaaaagtccaaagtacagcttggatttggtttagataagttattaggtcactcagttgcacaggttcctaaaagtcattttcaggctttgtaggtaggtggaaaaaagagcttgataataattgaataatggaagtaacttttagcctatattttacaaaaaagacctaccatttatcttaacagtgctgaaacctagtatcacttaaaaatttttctaatacataaaatttgagaatttcatagcaggtaaactcttattttaaacatcttttgaggttgggcaataaattctagtgcagaaagcactgttctgagtaacttgtgaatgtagaagttcatcagattatagaaggcagtgatgctggctgaagcaagttacctcccccttttttatccttacttccacccctcttctcctttccctcttctttctccttgcaagttttaaatgcagcttatggaggtaaaattgacatctgataaacttcccacatgtaaagtgtacagtttgatatgtttgaacaaatgtatacacctgtagaattatcaccaaaatcaaggtaatgaatatgcccatcacttacgagtttccttacaccacgtaggtaatacctgccacctctctgctgtccccattctcagataaccactgacctgctttatgccattatagattaatttgtatttttctagattttatgtaaacggaatcttacagtatgtacttctctttttcagtttgtcgtctttcattcagtataattatcttgcatttatcagtcatttatttctttgtattgccaagtactatctgtaatgttccattatgcagatctatcagtttgttactcatttacctgttgatggccatttggattgttttcagtttttgtctgttactaataaagttgctttgagcatttatgtacaattgtttgtacataagcttttattttcctggggtaattacatgggggtggaatggctggatcatatggtaggtgtatgtttaactttttaaaaaatggacaaacttttttctaaggtagttgtaccattttatactttcaccagtagtttttgagagttcagcttcttccatgtctattccagcacttagtgtgatgtgttgtgttaatctttagccgttctagtaaatgtgtggtggaatctctgtatttttaatttgcatgtttctaatgactaacagtgttgaatgtcttttcatgtgcttatttaccaaccgtatatctttgatgaagttcctgttaaaatctgttgtacatttttatttaaattgggtttttttgttattcggttttgggaggtttttaaaaatgtgttttgaatacaagtttattatcagacctatgatttgcagatactgtctcctgtctgcgcttatctttatatatatctattcttcacagtgtttttggagagcaaaagtttttaatgttgatataggccaatttttaaatttgtgtattgtgcttttgatgttgtgtataagagctcttgtctaactcaagctcacttaagattatctcttatgtattctcctagcagttttatagttttaggtatcacatttatacttatccatttggagttagtttttatatatatcgagagttatatattgatgatttttttttgcatgtggatatcctttgcacctttatcagatatcagttgtccatacagatgtgtgtctatttctggagtatctgctctgttccattgatctgttgtttttctgtctttgcactgatctcacatggtcttggactactccagctttatagaaagtcttcagatttgagagtgttggtccttaaactttgttcttttaaaagttgtttcggctctttcatatcctttctattttcatgtggattttagaatccacttgtcgatttctaccaaaaaacccgaaaaaaaccaacaacaaaaaaacaacctgctgaaatttttattgggatttttctaatttgtaggtctactgggggagcattgatatcttaacagtattaagtctgttgacccttttttgtggcatctcactttattattttacatcttctttaatttttctcagcaatattttatagttttcgctgtataagtctttcatgcttttgctagagttgcccttaagtgtataatatttttaatgctaatacgtatttttaaatttaattttctcatgtgactaaatgcacaaatatcatttgatttttttatattgatcttgtgtgcagcaaccttgctaaactcaaattccagtagctttttttacctgccttcagatttactacatagatcatcattttgtctgtgaataaagagagttactcctttctttcccaattagttcctttatttatttttgtcttgccttattgcactggctggaaccttcagtatgctgttgagtagatacagtgagagtagacatccttgttttttttcctgatcctagagggaaagcattcatgtttccttcattaaatatgatattagctgtggacttttcatatatatatatttttaatcaggttaaggaagtttctttttactcctagtttgctgagagattttgtcaggaatggatgttagatttttgtcaaattctttttccagatccttgagatgtttttgagatgtatggtttgtttgttgttttaataatggtgagttatatgaattgatctcagatattaaacatagcttttatttctgggagaaatccagttggttaggatgttttatcttttttatctatcattggattcaatttgttaaattactaaaatttagctaatttgctaaaattcatttaaaatttttgtatctatgagagacattgatgtatagttttcttttcttatttttgtctgacttgcatcattgtaatgctagcctcataggatgagttgggaagtatttcttcttcctgaattttctggaagaatttatatagaattggtattattttttctgtaagtatttgatggaatttaccaatgaagccacttgaacttggcaatttctttgtgagaatatttttgactgaatatccagcttctttcaaagatatagttctattcaagttacgtatttcttgtcgagtgatctttggtatttgtttctttgaagaaatttatccctttcatctaaattatcaaatttattggaataaaattattcataatatttcttttttattattttaatattggtagagtctgtagtgtgttacttctgtcttccctgtctccccctccctcccacttgtttctgatactggtaatttatgtcttctttttttcttcccaattagtccagctagaggtttatcaatgttattgatgatctcgatgaaccagctagctctcagttaaatgattttcttttcttttcttatctttaaaaaaaaaaaaaaaaaaaagtcagggtcttgctctgtggcccaggctggagtgcagtggcatcatcctagctcaacccaaccttgaactcctgggctcaagggatcttcccacatcagtctcctgagtagctgggactacaggcatgcactaccaccaccctgctaattgaatttttttttttttttttggaggtggggtctcactttgttgaccaggctagtctcaaactcctggcctcaagccatcctcccaccttggccccctaaagcattggaattacaggtgtgagccatggcgtctggcctccgttacatgattttctgtattgcttttctattattattttttttgacggggagcggtgttcgttctgattgtggtttcttccttttacttatttttgcttaatttgctttttttgtttgtttcttaaggtggtccatgttccttttaaactgtgaaattttttaaacatagactaaattacagaggagaaacagctacccaaatcctatattggcatatttactctttatatgtcttcaaatattataaatagaattaaagccctcatcacatttccctttccagatctcatcactaccctgagtgtttcctttaacttgtttgtttaggtcatccatatgtgcattttcccctacattttacataatatcgctttatgtattttcacatttaagtaaatggaatcctatatgcgttctttattgtacattttattcaacatagttttattcaacatagttttcaagatttatgtaaatatagattcgtaatatacagatttagttaatttattttaactgtagtattctaatgattaaatacacctttttattttatttttttagaaataatcataatgtagattgcttctcatttttttataattataaacagcacaaaaatgaagaattgttttgcatgtctctttgacaacttaggttacagattatttagcatatgtccctggaaatacagttactaaatttaatgatacaaatgtctccaactggagtaccgacttaaatttccaccaaaatttctatatcaataattgtatttggtatcagccattcctgactgttagtagcttgcttactttatagtttcagttgttaaggttacctcatgatccacattggctcctagagttcagctatcatgtccacacgaaggaaaagaaaagggaagaactaaaaggattttcctggagtcacaaaccagtggttttgtgttgatacctctttggctgcctttctatactttaaagactgggaaatgtagattttagccacatacattgtacagaggaaagggggaatggttatttagtatgccatcagcatttactgtcacagatctccttttacctggtgtgtactaacatttgataataaacgtttaatttttggcagtttgaaatggtatctcacttttaaaattgcatttccttgattggtgagatacagaattttttacatgtatttaggctttttttaaaaaaaaattgcctttgatataattctactgagtttggtctttccctaattagtttagcataactctttattattcaggatactgatcttttgtttctttacatccaaatagatgtttttgtctcttatttttaaacttttggtatgttgtccttgtttatacacaagtgttcattattatggggttaaatttaacaggtcttatcctttgtgatttgttgtttttatgtgtgttcttgggaaaaatttttttcctatataaaagtcatggagaactcttagaaaaaaagttttaaacttttgctttttgcaaaatccatttgggagtttttgtatatatatttgtgaatgatttaatgtcagaatttaatgtttttctatatggaaggccagttgtcccagcagcattcattgaataatgcattcttttgctatgatctgctttgttaacttctgtcatatatcagatttctgtctgtgcatgaacttttgcatctgtttctttggtgtatttatcttttatttgtgattgcttcataaaaagtctttgtgtagtaggtcagtatctcttctttaaaattatcttagttattcttggctctactttaatataagctttagggtcagcttgttcaggtccttgaaaattttgattagaatttaactgaattcttagattaatttgggagaatttgacgtgcttctcatcttgaatcttcacatttgtaatcatggtctgctactccatttgttcaggttattgttatgtcctttagtaacattttatatttgttttcataaaggttctgcctattttattagatacatttcctggtgacttagtttatatttttattgagaatgatatctttttattttcgaattagttattggtatatgttattggttatatacggatctttaggaacccttccttatgttaccttagtagttgagttgttcatcattctccagctttttttcccccaataaacccacatttattcacttcttctgcatttcagacctgtggtcatcctgttttctgcttgagcatgacagtcatgctgctgtcactacctttttcaggcagctcagagcatttcattttttaaatgcagctcattgccattgtgttgtttgtatgaccaaaaggaactgtcagagagataagaaggttacattaggttatgttccttaaaaatcacaaagacctctctatctcattgctcttttctgtccccccttctcatcttcagttctcggtttacttgttacctttattctcccactcccatgtccatctttctcttttatttgcccacatttcccttccttctcccttccatttggtaactatagtttttagcacctgccaggcactttagtttgtgctttgcatatgttaactcatttgccctttatcacagtccactgaggatggtggggcagtctcatttcatagctgaggatgcgaggaggcccaagcttatataagtagaaagtaggagagcttggataatgtcaggcttttcagactcctaatgtcatttttttttccgctttgctatattattgaggttgtttctttctactgtttttataagtggatgaagtaaatgtgctgtatgtctctaataagattttttagtaaacctatttagatagtgtctctaaaataaagctgtgtctgttttgggtggagggtgttactcgatctttcatgatagccattctcatagatcactctaaagaaaaagagatttacagagagaagaaagatttaaatgcagaaataataagtaaaatttactacgtcaaatatgctttacaaaaacattatgtatagccatgtatctgtgaatgttctagaaagtggtccttttgtaagagtgcatggcaaacgttgatagaagaaacacattagggacagtggattctattcatgggtagtgtattgttctgggcaagtaattttacttttaacaggcattaatctcctatataatccaaggataggattgattatataattattatataatcgaaggataggagattaatgggtagaaaatctttgatgatacagctgtatttataaataagtaacaacatacagaactgtataattttttaaaaatcattttgatagtattttcatttttgtaaggtactttgtagttcttgttcatctgtgtatcctgtacttttacagttataatcatggtatctacttttattttttattttttcatgactcatgcatctctctcatgaactgtattcattttcaaaaaaattgattttagataatctctttaatgttgttgtattcccttttgtgagatagttcctcggtttctagttttgttttgttttttctttttgtaatttatggaacatttaagttacattcccagtcataggatgattctataaaatggtatcaacacatttatttctgttttattgtcaaattgctttcaaattggtttaaaacaatctataatgcaagaaatgtttgaatgattcagtttaattatagccagcatccagtcatttaacaagtatttattgagtctttgttctggcagaggttacattctagtagggaatatatgagacaaacataataaataagtaaattacactttatattagaggatgatgaaggctttacagaacagagcaggataagggagtgcctgatgggatgacttgcgctttgcatcagttaaagtaggcctcactgagaaggtggcatttgtacggggtcttgaggcatgggatttactttgtgtatttttgtctttttcctttttttttttttttttttggctaatttaagaagtttatgtagtctcttaagattactgtcatctattttcattgttagtaagaatggttttctacacatttcctatttttttttctattttggcaaaatttgaaattttaatgaaagcacagaagttttctgtgtaagcctgtccctgtccatacaattaaagagtggggaaaattggctttaactacattgtttatgtttaaacctgagtagaatattctgttgaaggctttaacaagaaaacaaaaattattactagtttgacatttgaaataagcaagaataagattgctcctttctattgtatttccattttaagtaaaggcaaggtgatatttaagatgtataagaataacagatatttgttattttatagggtgactgttggatctgtatggaactcatgtctacctcgtttgataagttttacaaatatgtatatagtgtattagatgatgttattccagaagaaattttaggcaaaatcactttagcagtaagtacctggtctttaaattattcattgtgtatatagttatatagagatgctgctggagttttgaatgcacatatttgagtgtcactcacagtaccttcctgaaaataattcatagttaataaccagagacaaagtcacttctgtggggtagttaacacaataggtcataatggtctcgataaatactgccaatgttctttccctttgaatctcaatgagtcataacagactgttctgtaaataaagctaggaaaagcaattttctgttcattttttcctgttgctttaactatttttaaataggttatattaccacagttatcctgaaattaatcagaatcacagcagtctccttgaagccccataattgaagcccttggacaaagtttgtttactgtgatttaagattttggttactccataattgaagcccttggacaaagtatgtttactgtgatttaagattttggttattcagtctaaactatttaaaattttgactagcagtttcaggggccagtgttactactaaatttggttaactcacttttaccagagtaccaaaaaagaaaatagctacttttttacatatgtgtttatagttttgaaagtgaattgatcactttgtttcttgctctgaatcttaattttttttcctaaaggaaaaagataatttactttttatagagcaaaattcataagattcttagaaactcctgagaatctgagctaatggcatgttctaggttagttgatatataaactaaatcatacaggaaattgtaaaatagatactttggttgcatgtaatttcctagctcttccttacctgcatactccccctccaatgtagttcaccaagatatatactctttcaaataatttcataaaaagattttatgaaatcattttatttttaaattttataaaaataattgtataaaaagaagctaacttagactagaaacttattatttagcggggtatatgaaattttacaatgattagtttagccatctctctctaatatattaaacccgtgttatcttgaaacttactatttgtaataattataataatagaaaaatgataatagctaatggttattaaatgcttatttgcatcaaactatttgtgacattaaatcttcatagtaactctctgtggtaaatagtgttacctcatttttatgaatgataaatctgaagcatagacagattaaataattaatatgctttgaagtgtgtaagtggtaaataatctaaatccaggcagcctgatcccagaaccctgctcttaaccgctgtataacagggtgaccatgaaattagaaaacagaaaattattttatcatatattgcaatataaagaatatatactgtaaaaaatgatttattccatatttgcctaagtcaagacttggtgatcactttatatatattaagcacacatgtaaaatactttgtgtttagtctcttcttgctaattaataaaccagcaaacaagcatagctattcacaacaaatttatgtgttctacatttcttgtacctagcagcttgacgtcagcaaagacgtcaccttacagcaaatagttggcctgttgtttagttctcttttagtttgaggttgtgtctcttttccttcccttcctgaagaaatgtgtaattttctgatcatgatcagtgaccaggcaacaggataaattcccacagtggtgaacagagtttacactagctcttcaaacatcaccttgaaggcttagcatccaatgagggtggatgatgatgaggaactgagagtttagaaaacttttttatttactactggacttagaaattgaaatcgattttgctgcaagttattactcttagttgaaatggaaccaactcagtgatcattgttgtcctgtttttatttttgaacattttagaggccaggcacaatggttcatgcctgtaatcccagcagtttgagaggccgaggcagaaggatcgcttgagcccaggaatttgagatcagcttgggcaacatagtgagaaccctgtccatactaaagatgtaaaaagttagccaggcatgcatctgtagtcccagctacttggcaggctgtggtgggagcgagacccagtctcaaaataaaaagggaaaaaaaaaaaggaaattttaggttggagataggaaaaaagataaaattttaaatgaattattaaacaaattataagtctaagttactgggttttttgtttgtttgagctatcagggaacagcatataaaggcaactaagcttttagatctaaaattattcagtatctttggttaacaagaaatgacaaaatattgaaatattaagcttaaaatgtatgcagaggactacacgggatattacttgtgataaactgttgtgctgtttgaataaaaagaaacaagttgtttatcccatctctcctttttctccctagactgtgaaagcactaaaccacttaaaagaaaacttgaaaattattcacagaggtgggtatggattggtattttttgtaatagaaattaacttttttctcctaattggtgaaacggttattgaaaattacagtgtcactgtataaactttcctaaaatatttgtatttttagcaaaaaatgctttatgtactttaaaactctattactgctatttttttctttgggattcaataaatttcagtctatcttagtatgttggacttagaaactgaaatagattttgctgcacattgttattagttgaaaaataattattcatttgcctgatagataatgtttttctgcatacaaataaggcatcgaggtggtcctgtggacattcaaagaagaatctgagggatagtaccctcaagcattttaaaggcatgctatccctgtctgttgtttcttcttcacattagaggatgtttctaaattgagagaaatcttttaattagtattataagttgaaatttctctaaagcatgttgtatttgtgtaaacagtgatcttgcctttattagatacatattcaaatgaagcatttgatgtagttgaaggccagacctagaaaagtagtaaccctgtgggaatcctgaatttaatctggcaaatagatgaagtgcttgctttacttattactgtgctagactcagggtaatgaggtgctggctttgaggaaacacaccgaatcactacccctcagcaaatttgtaacggaaaaacctgacagtaagtggcagtgtgtgatttagcctgacagtaaataggaaggaaagtaaagggtcaaaatgaagagaagtgaaaaatttctaattctgggagacaatttctagtggttaaagaaattagtaattgggccatttatttaagttcttttgtttgtggttgacactaggccactgaaattagtgaaccttgaacatcagtaaattttatttaattttgtttggcttaatgcttgttagaaataatatctttttttcttttggcctaaaattatgtagagttaggtccctaaacaaaattctttgtttctcttgtatttcttcttgttcttgtcttgatttttttttttttcccttctttgttagctgtgttctataattatgagagtagcacctttgaggcatttgatagttaccttagggatatttactgatcacagtaaagcaccaaggtactgcctggggagtagttgaataaaataaaaaaacttcagaagtaacttttattgttctcttactaaatgaagtgatgagtttatagccatcttttatcagttaggatcagttagcttttttgttggagtcagtgcttttgattacaagtaatagaaaatcctgataactctctttaaacttcagggaaattcattatctgtcataattagtccaaagatggggtggctcaaagcacaatatgactaggggtcaagttgctcctcttccttctgtcctccttcatgtgttaactctgtcctcagggtagtaacaactagagcagttcccactatcatgtctatatgtggctgcctcgtgaagaagaggtgctctcgtgctgtgcagctctgtagggagtatggaaacttttcccacgtctctaataccttttcttggctcattcaccagaagtgcctcatgcccttaaaccagctactatcaagaagcatgagactacccttataaaacttataccagccaacagccaggttttcgaggtgtggatgttgatgagaagagatacttcaataaaacacaggttctgttagaaagtatggatggggctgggtgtggtggctgacacctgtaatcccagcactttggagaccaaggcagctggatcacttgaggtcagaagttcgagaccagcctagccaacatggtgaaaccccatctctactaaaaatacaaaaattagccaggtgtggtggcgcatgcctgtaatcccagctacttgggaggctgaagcagaagaatcgattgaacttgggaggcggaggttgcagtgagtggggattgcaccactgcattccagcctgggtaaaaaagagcgagactcttgtctcaaaaaaaaaaaaaaaaaaaagcatggatggttaggaatggatgtttgataggcccacagctgtttcggtcatggtaagagatctttactgaatttttttgtggatcaccttctgagttacatttagatgttttctgcatcctatattttaaaaccttattttttattcattgagccaggatagtgacaaggacatggataaaaggactgagctatggatagagaattagttggcacatactggtagtgacttgattgtcaatgagaaagggatttgacattccttatattttgactgttatgtaatgaatctggactaagtaaatgaatttgtaagcctcttgaaaacaatttaatgcctaaatttcttgtgaaaattttttttgatattcagtttttaagcactggcattcagaaaattgttttcctttctcattttcaatagaagaaaaccattgttttttctgtgttttataaatatgaagatgttaagagaaaaatcaatccccatctatatcttacagattaatgtttgtgaaatgacttttgctgttacatttacacaattatagttattaaagctacatgtttaaaacatgaataattattgtatgtgataaatgaagatgttttacttcttatatatctgaatttaaggacttgaccacttatgttgtctaaggtttttcaatatttttgcttaaagtgaagccttatgtaacttaggaagaagctaattgtatactgaatgatatctatgtcttgcagatatcaaaccttccaatattcttctggacagaagtggaaatattaagctctgtgacttcggcatcagtggacagcttgtggactctattgccaagacaagagatgctggctgtaggccatacatggcagtaagtgttaagtccaggccttcttgcttgatagtcattgcacagagagcctgtgctcttttgtgctggccattagtcatacggttttaccatgaaactgctagaatatttcccttaccctaaggcccaagctcaggtcctagcctctccatgaaactttgctaaattatcccagtcagctcctgttttcattgtcttgctttatttctcttacttggtatttagcagttgtggtcttctctgattattgttttttcattatattgaactcaactcattaaacagatggtaacttctcagaaagttcccaccgtcccttagtgagacaaatgggaagccttgagttcattagcagaattcactatgtattacagagtctgaagctgcatattttgaatattgttagtccttttttttaggggtagatgaagcacaccaacaaatgcaaaggtagaggccttcagtattttgcaacctggagcctcttttcctgcaaagagacagatgtacactatccatccatagatatcaaactcatcttaccccagtatatttgcatacagtgttcctacagcctggattttgatctgtatttgaatgaaaatgtagtgtctgtatttcagacatttccctaggtgttaatgtctttcttcaatgttgccatggttctttggggaccagcacactactaaatgtgacacataaggttttgtggttgtttcttgaggcctccctgccagcagcatttctttccatctttgtagactgttttaaactaaagataagcttagaattgaataaaattgttctttcttggtttcctccttgatatatatgttttcaaacctagtgctataaataataaaaaagtaagagtcacaggctagatattataggtgttctagattatttatgaatggataggcttagtgctactacaaattcaacttactgcatttttcaatcctcttttggttttgttatatcttcccatatcactttttcttcagatgaacatgtaaaagcggtgtgtgtgtgtgtgtgtgtgtgtgtgtagacacctaacctgtgtggtaagaccttttaaacttttggttttgtggatgttgactggctgggcagatttcttgactcagtttggaagatcatttgtttatcgtgataactagggataaatggcacaatagtttcaaaggcaagaaataaaaaaaattagacatggagtatttgggaaatgtgatttacatatttattaaggataccccgagaatgaactgaaattgttatttacagttttagggcttgtctcgatactaacagtgactaaatgtttttgttgtgtgacactgactaagaattatatttgattgaagcaggctttgaaaatgcaattgcagcccagataaagtagaatattttgaattcagctttctaagaaagactcagactttctttaaaacagactttcgtcattcttgtgcagagatatgctttgcaggcccaggagatgtaagacttctgttttcttgctgaccttcatctgtggaacacaaaggctgataaactcttggcctctaatctttactggaccagatgaaattcttctgtccattctcatctttcaaagcctgttatagatagacaagaactcaatcaatgttaattttaaaaggcttcaagtggtttgacttttcttcaaatattgacaaaacctattggaggtatatcattttatttgagatttatagttgtctttagtctacaggacttaggattactcattagattgtgcaacataaaaaagtaaataaaatgtagagtttacacataaattttcctgtaaaccgatttcttgtaaacattttcccaactccataccctcatgtaggtacacagtcttatgttgcttaaccgtgggaatatgttctgagaagtgtgttgttaggcaattttgttgtgcaaaatcataagtgtacttacacaaacctagatggtatagcctactacacacataggctatatggtacagcctgttgcttctagactacaagcctatacagcatgttactgtactaaatactgtaggtaattatatcacaacagcaactatttgtgtgtctaaatatagaaaaggtacggtcaaaatatggtataaaggaggtagaggtgacgggccggaggaaagatggaagactaccaggctgcggaggagactgcttttgttgttgatgaagtgagcaaattgtaaaagaggctatagaaagcacaattggtggttaacgcttattaacacagcaaagtgaaccagtggaacacaaatgtagtagaacaaacttcaagccaactcaccaagctgggaaaaccacttaaatacattgtgacctgtgtaattatgcaaaagaatggagctggattacacatggcaagttcctgcttctgggacagctctgctgacaggagctgcactgtgcgatgggagaataaaaccatgtactgcatcgtcggcacctttggactgtgtattggacctcctagtccagcctgtgaccttcctccggtagttcatcttctaacaccagctatgaattgagtgaactcttttctcgttctttttaagtctgttttgtggcactctaaaaatgcagagaaaaaaaccaaatgaccgcactgttacatgaactgtgcactgaagtcagatgagtatccctgtaggtcgcctgcagcctgcattgccacttgtaactctgaatatttcttttcaaaggtgctaaaatctgaaatctgctggtgtgaaacttgctatactgtctgaaatgattcaaatacactaattttccatactttatacttttgttagaataaattattcaaatctaaaaaaatatggtataaaaaataaagaatggttcactggtataaggcactaatcatgaatggagcttacaggactagaagttgttctggatgagtcagtgagtgagtggtaagtgaatttgcaggcctaggatgctactgtagactttataaacactgtacacttaggctacatgacatttataaaaatttttttcttcagtaataaattaacctgagtgtactgtaacttttttactttatacactttttaattaaaaaaaattttttttacttttttgtattaacacttagcttaaaacacaaacacactgtacagccgtacaaaaatattttctttctttgtatctttattccgtaaggctattctgtttacttgtttattctttttaaacttttttgttaaaaactaagacatcattctaggcctatacatgggcgcgatcaatcactgtcttctacatccacatcttgccccactggaaggtcctcaggggcagtaacacgcagggagctgtcatctcctatgatatcaatgccttctttgtaatacctcctgaaagacctgccagaagctgttgataacttttttttaaataagtagaaggacatcaagtatagtgtactgtacataattgtatgtgctatacttttaaatgactggcagtgcaataggtttgtttaaaacagcatcaccacgagcgcgagtaatgtgtcactctacgttatgagggctatggtgtcattaggagataggaatttttcagctccattataaccttatgggacaacctttgtatatgtggtctgtcgttcaccaaaatgttgttttgcagcacgagacaatttctgtatgtgggtatggatgtgccaaaccacctgaaagttagttgcagatatcatgcattttattctaaacacttcagtgcatatctcccaagaaaaagaccattcttctacataaccacgatatcattaccacacctaaaaaaaacaaacaagaatgtcatctttgagcatccccattccaaaaatgcaaagcccgaaatgctcccaaatatgaaacgttaccaacactagtgtgacccaagtggaaaattcacctgaccttatgcgatgggtcacattcaaaatgcaggtgcaccacatcttgttgattcagtgttcccaaggtaaaaaaaaaaagacccttgtggccccctttagctgcaatatatcttttccacacatgcccagattttccccacataagcatgcctacaaagggtaataaaatggcatgtatgcaggcaagatgtgctaatgacaggttccacactatacctcacatggggccaagacctacctgcattactcactgtattttttttgttttttttgctcattttttgctcagtagcttaaagttaatgttgaaaatgtcaaagaggcctgcagatacccctagagagacagcagtttgttaaaggggataaaggggaagtgtttatgtttatagcacagaaagtcaagctgttagagaaactggacaatggtgtaaatgtgaaatgtcttacagaaaagtgtggtgttcgtatgagcaccatatatgacctgaagaaacagaaggagaaactgctgaagttctgtgctgaaagtgatgaacaaaagttactgaaaaatagaaaaacaccacataatagctaaaaatgaagatcttggtaatgtattaaaagagtggatctgtcagactcacagtgaacacatgccatttgatggtatgctcatcatgaaatgaacatctatcatgaagaactgaaaattgaagggaactgtgaagattcaacagactggttatagaaatttaagaaaaaacatagcattaactttttaaagatttatggtgataaagcatctgctgatcatgaagcagtggagaaattcattgatgaattcgccagggttattgatgatgaaaattcaacatcagaacaggtataatgctgatgaaacatcactgttttggcatgattaccccagaaagacactacagctgatgagacagcccctgcaagatttaaggatgccaagagcagaaaaactgtgacgggatgtattaatgcagtaggcccgtataggtataaatctataggaggcaaaagcttgcatccttcctgttttcaagaagtgaatgtcttaccagtccattattatactaatcaaaaggcctggatcactcgggataccttttctgattggtttcataaacattttgtaccagtgccttatgcttattgcagggaagctggactgaaagaagagtgaaagattttgttatccattgataactgttctgcttatgctgcaaccgaaattctcataaaaaataatgtttatgccatgtactttcacccaaatgcgacttcattaattcagccatgtgaccaggatatccttagatcagtgaagggtaaatataaaaacactgtcttgaacatcatgctagcagcagtgaacagaggtgtgggtgtggaaggttttcagaaggcgtttagcatgaaggatgtcatacatgctgttgccagcacttggccaacagtgactaagacacagtcatgcctgcttggcataacctctggcctgtgactattcagtgatgatgatgatgatgaacaaggtagtgacttggatggattccatatgttaaagtgagaaaaaaatgatatctgacctccttttatatgcaaaaaatacatctttagagtctgtcagtaaacggaaagaaggggatattaaagaagtttttattatcaaattaatgaagcttcagtttttcatttattgactaatgatgaaatagctgaaatggttctgaatcaaggtaaatgtgatatttagtgataatgaggatgatgttaacaacgaggaagaaatgcccatagacaaagtgcacattctgcatatcaaaagaaactatcaacagagtaaacagataatctgcagaatgggagaaaatatttacaaataactatgcgtctcacaaagttctaatattcagcatctataaggaacttaaatttataagaaagaaaacaacctcattaaaaagtgggtaaggacgtgaacagacacttttcaaaagaagacatgcatgcatccaacaagcatatgaaaaacacaatgtcactgattattggagaaatgcaaatcaaaaccacaatgagatacatctcacaccagtcagaatggctgttaaaaaatgtcaaaacaacagatgctggtgaggttatggagaaaagggaatacttatatactgttggtggaaatgtaaattaattcaaccattgtggaaagcagtgtggtgattcctcaaaaagctaaaaacagaattgtcattcaacccagcagttccattactggaaatgggtatataccaaaaggaatagaagtcattctgtcataaagacacatacacacatatgttcattgcagcactattcacaatagcaaagacatgtaatcaacctaaatgtccatcagtggaagactggataaagaaaatgtggtacatatacactgtggaatactctacagccataaaaaagaatgagagcatgtcctttgtgggaacatggatggagctgtaggccatccattaatatctaaggatacttacttagcaaactaatgcaggaacagaaaatcaaataccacatgttctcttaagtgggagctaaatgatgagaacacatggacacaaagagcaacaaaacagacactggggcctacttgagtgtgggaggtgggagaggatcagaaaaaataactattgggtactaggcttagtaactgggtgaccaaatggtctgtacaacagacctctgtggcatgagtttacctatataacaaacctgcatgtgtaatcctgggcctaaagtaaaagtttaaaaaaaataaaaattaggccgggcgcggtggcacatgcctgtaatcccagcactttgggaggccaaggtaggcggatcacttgaagccaggaattcaagaccagcctggccaacatgtgaaaccccatcactactaaaaatacaaaaattagccaggcacagtggcacatgcctgtaatcccagctagtcaggaggctgaggcatgagaattgcttgaacccaggaggcagaagttgcagtgagctgaggttgtgccactacacttcagcctgggcaacagagcaagattctgtctcaaaaaacatatatataaataaaaaggaaaaaaactaaaaaaagttttaaagaaaatggaaacaagctccctcattccccccccccataaaaaagaaaaaatgctcttgatgaaaatgtgtaatggactcattaaaggattagagcagtatgcattcataacacaagaagaaatcatgtcagtttataaaactgaagagagactcctaagacaaaaaccattgttaatgaggcagttgactagggaggaaacattttacaaagccatctagcagaatgcctcctcattactagaggacccacttctggcccctcaaatgcttctgatgtttcttctcacctaaaaaaataaaatacagtgtacaatagccttttaatcaaaacacagcatcgtagttggaggttgaaagcttgtagctgtttgttgtagctgctgtttaacagttgatgcaggtattctggcgatgctactgtgctgcttagttccccagaactcattgtttttcactgtattgatacgtcatattttttactgttaagtatttgtgtgaacaagtgtaagacaatgattgcctattaatagcatgtaaattccgagtccggaatgatggtgatgcccagcaaccacagattgtctacctgggtggctgagatagtgacacttttgctttttggtgcttcagtgtacacaaactttgtttcatgcacaaatttatttaaaatataatataaaattaccttcaggctatgtatatagttgtatatgaaacataaataaatttcacgtttagacttgggtcccatccccaagatatattattatgtatatgcaaatattccaaaatttgaaaaaatccaaaatcgaaacactcaggttccaagctttttggatgaggaatactcaatctgtattatctaatacatagttcatactcagatttcccatatgtcaaaaaaactatcttttagctgtcaatccagggtcacattaagattccataccagctactcaggaggctgaggcaggagaatggcgggaacccgggaggcggagcttgcagtgagccgagatcgcgccactgcactccagcctgggtgacagagcgagactccgtctcaaaaaaaaaaaaaaaaaaaagattccacattgattttaattgttacattattttaatatatacagggcttgatcattctttttgttttctgtgacattggcggttttggaagtgttttcagaaggtctcgcattcttataatatctgattgttccctcatgattagattcagactacaactatttttagacatgcatacttcatgtatgaggagtgttttttattgcataacattgcaaagcacataatggttactatttgtaatgtttacagacatgccttttttttaagcagttaaaacagttgcagaatagaaactggtatgtttctttattcatttaggtcttcttgccatctctcagcaatgttttgtagttttcagtgtgcagcttttgaagaccttttaaatttatttctaaggagttcatggtttttcgatactgtgaaaggaaaataaaaacttgggaccccaatttactatgccaaaacaaaaaattcagctgaaagctgagtgatgtaaataaaaaactgcctttccttttgttcttaagcagatagctacagataaagttttaaatatctccacaggtagctattccgttcaccttatcttatttaagtgctaacttactgaggatgagaggaatacataatcaactattccgtacttgctccttttctcttgcaacatacggattcagtaatgtgaccacaccctccctcgtccccctgctgcctgcttttcctctttaattattgaagccctcaaaatcatatttggagaaaggcacaaacttccctttcaggcatgtccttaaccgtggcaagataaacttctaaattgattgagacctgtctcggatttctttttgtcttagaatactgttattgggagtggaattaaaaatattttccaatattttgctattattatatagaaatacaactgctttgcatgtgttaacattggatcttgtgaccttgctagtttagttttactgttagtttcagtaggaattttctgtgtctgtgaataaaggtaatgcttgttttcccccttgcctttctatactggctgggtcctccagtagaatcctgaatagtaataataatagtaggcatatttgccttatgcccaatattaattaaaaagaaagtgttctatatttcaccagtaagtataatgttaactcttggttattttagatgccctttatggaaatgaagatgttttcttctcttagtgtgttgttatttctgttgttattagtgggttttacattttgtcagatgctaattctacatttattgagatgatcacattattttcttcctttctataaataatggtgcattgcattgattttcaagtattaagttagtattgtattcttgagataaactctacttggtcatgatacattacctctttgtatgttgctggattaggtttgctcatattttgttatttttgtgtctttctgtgcaagggctattaattgtcttgtaatgactttgtcaggttttcaaaaatcgttatgctggcctcatgaaatgagttgggaagcgtaccatctctcacttttttgaaaaaaaaatttgtgtaaggccagtgttatttctcacgtatttgaaaagagttcaccagtgagcccatctgggtgtggacttttctttctgggcaggtttttaataacattcattaagtaacatagtttaaaggttattcacactttgatattctttttggtaggttttcattttcagaaaatatttctgtttcatctatttctgtaagaacagtagtaatggcccctctttcattctgattttagtaatttgtatcttttctttttctgtgggtcagtctagccaaaggtgtgtccattttattgatcttttcaaagtactgttggttttcttgacttttctctattgtttttctattcctgttttacttgtcttcacgttactttttcttacgttcttcctcctgcttgctttgtatttcatttgttcttttttttctaattctttaagctataaagtaggtttgatttgagatgtcttctcttctaatgtatgcattttacactatacattttcttctgagcactacttctatatcccacaaattttgggaagttgtaatttcattttcatttagttcaattttttaactatttcttgagacttttttgatccatttgtcatttagaggtgtgttgttaaatcttcagatatttgaggactttgcagatatcttcctgttactgatttctaatttatttattttgtgatctgagaacatgctttgcatgctttccatcttttaaaacaaggtgtgttttatgccccagaatgtggtcaggattaatcaatgttccatgctagtttggggaaaatgttgatcttgatgatgttggatggagtattttttctcttggttgaatatctgggattttaatgtgtaccttatcaggcaaatacttatatttacaacaaaaaaaaacaaagtaaatagcttacagtgaattttatgcagcacagtactcatgctcaaagcaatatacagatgtctttagttgatgctcacaggcagagaatgtaatacagtcaactattatgcttctctgggcatttctttcaacagcagttactctcagacttagcgaaggatccattgtcaactctgtgccaacaggaccctctctctctcttcccttttcctgacacatcatttagatggtccctaatttcaaggaaatgtaaagatgttctttcacagaaattactaaaaatgatttctgcggtacataggataatatattactgtcttggcagtgctttaatttggctacaaatgactaacagacaaatatctttacacatatgtgtagtgataaatttagcgttattgtgaagtatgggtggaataattgtgataaatttagctcttgttttgcttttgtgtctcaaatatattgtggtatggcctcatccaccgagcaaagtcttttaaaaatcgaagacagtcttttttgtttgtttgtcactcgttgccccaaatttgacctaattctttttttaaaacctttttattttttaattttttttttgagatggagcctcgctctgttgtccaggctggagtgcagtggcatgatctcggctcactgcaagctctgcctcccgggttcacgccattctcctgcctcagcctcctgagtagctgggactacaggcacctgccaccaggcccagctacttttttgtatttttagtagagatggggtttcaccgtgttagccaggatggtctcgatctgctgacctcctgatccacccgcttcggcctcccaaagtgctgggattacgggcgtgcgccactgcacctggcgaccttgtaattctttatgttttccagttttcttcctttgtctccctcttccctcagcttcagctttgtaaatgcttttgagtctttgaggggaatagttaaatgaattgcttagtgttctctttatggaagtagccattaagttttttgttgtttgtttttatgataatgatgacttcctattacttccattctgacgctagacatggattcctctaggaatatactggcattttggctgtctacccagctgttgcttccatttgcctattccttgagtgtaaggcaattaataacttacacttgtctttatgttccagcctgaaagaatagacccaagcgcatcacgacaaggatatgatgtccgctctgatgtctggagtttggggatcacattggtatgtttatgctgattcaaccttgccacagtagcgtaacaataagaaatttagaagtgaaagaaaacttaatcagacttccccgttcgttaagaactataatcacagacactatggttttaagttgctgaaaaaaaaaaagtatgtatttatttactttaaaaatcaaatcagacttgattatttcccttgaagttatgtgaagtgtctagagccctttaatgttttaactggatctcttggccacagataataggagtcaactattatctgcaactgcactaagaatgggaacaggacaagccagcttacctgcagtcaattcattgatgaaggcacataggcttctcccatctcaggcaaggtgtagtatgtccagtaatactgtatatagtgtgtatattaagtatacgtatttttatatgtggaaaatagtttctacttgcaatattctattcactgaatagtaaaatcacaagtgaatgagctgaaagtaattcagtttttgagggacaatatattagtccattctcacactactgtaaagaactacatgagactgggtaatttatgaagagaggtttaattgcctcacagctccacaggtcgtacaggagcaggggagagagagagtgaaggggaaggtgccagacacttttaaacaaccaggtctcatgagaactctatcatgagacagcactagggggatggtgcattagaaaccaccctcatgatccaatcacctcccaccaggccgctccttcaacacatagggattataattcgaaatgaaatttgggtggggacacagagccaaaccatatcagacaagaactacctaggtgataattctaaatgaaagttctaccttagaacaacactgagaaagaataataagaaagctacttaatttgcaacaagcaagcgcaattatataaactcttctttcttacctatggactgtattgaaattttggtttcatttaaaatatctgtattagttcaggctgctccaaccaaatgctgacctctgggctataatcttatcaagaacagaaatttctcacagtttcggaggctgggaagtccaagatcaaggcactgacagatttggtggctagtgagggcttgcttcctggttcataaacagccatcttcttgttgtagtctcacatggcagaagaggcaagagagctgtctggggtctttcttacaagggcactaattagattaatgagggttccaccctcgtgaccccatcacttcccaaagatccaccaccaaataccatcacattagggattaggcttcaacatatggatttgctggggggtggggacacacaaacattcagtctctagcagtatctttgctcatttcctttttaccaaattttgttttgaagtcttcggtttattttcttgtgcttgctgttctaccaggacttgctgggtttttctgatttgggatagcttctttagctgcttctacattgaaggcgaattttctatccctagatgaggctgtcctgtaggtaggcaggccaatcctcttctttcattttctcccattttcagtttttgctacctaagactctatagcccagaaatacacaggttcagagcaatgggctttttttgtagcttattaaataatcttcatttgttcattggtattacatgtttctaggatcttctctgtgatcagaagcacataaccttgttagttattcttgatgaatcatattgctaggcctagagaattcttcgtatagagagttgaaggccaacagctcacctctgcagaggactttgatttactttactttgtgaccaaatataggaaataccttctggaatcttttctcattgtgaagccaaccagctaaagaagagattcttctttagacaggagagaacatggatctcgggcatcttttaggtttggcaactggtcccaaagactgcagcaagacctagagcttccagctgaggcaactatttgcatacacaggatatttacaattcagaaatacttatctatgactaaacaattacgttttaaaagcaagtatgtacttctttacagaaagaaaattttgtgaaaggttttaacagaaaattttttagcaagtttcttttagtacttttagctaaaccttgttgtttaaaaggtattctgtacttacagttggttcataatttatttttcatagggacagtcttataaaaattgtgaaatgtatgaaattaatttctaagatcctaagtcctttattttatgacatacagccaacttttccttctattattaaaacacaagaaggaatctaatgaagttattcctaattctgtgaataaccaggaaggtttatgtcttgaaaagcatttataattttaacagaaagaaacttcagctaatggaatacatttttctgtgtgtgtatgcatgcatgcctgcttacttttgtgcacacatgtgtgtaattagaaacaacagtgagctgacagaggcatcctttagggaggaaacggaatcagtgttctgagagttctctctctcttcctgtatgccatcttcctctgtaatatgtttggagcctcatcctcatgtatcagtcacctgtcagtgcatgtaaaatgggattcattatgccatggtgcagatttaaatatgtttcttggaaaaagcaaaatttgtaggttttcttttcttttgttttttgagatggagtctctctctgtcccccaggctggagtgcagtggcgcaatctcggctcactgcaaactccgcctcctgggttcatgccattcccctgcctcagcctcctgaatagctgggactacaggcgcctgccaccacgcccggctaattttttgtatttttagtagagatggggtttcaccgtgttagacaggatggtgtccatctcctgacctcctgatccacccgcctcggcatcccaaagtggtgggattacaggcgtgagccactgtgcccggcctaattggtaggttttcattatttttcagaacagaaagggagatagatgagaatacgattcactggttattagagaatattttttttttggacccttgataggattgggacatacgtaagactcttcagatctcttctggtgtggcttagaggtactgtcctgagccctttattggggcttcaggatgcagggtttgaccctgacttgatttcttcactacttgtaaaatctggttgtggttgaaattgtagtatctgcagaatagctgtagagcaggatttgcacattgtttcctccaagctcagattaggcttttgtttgttggatgttcttttgccttaaaaaggagtctaaccacgattatggaccaaggccttcctctaagatggctacaaattgtgcgtattctatagtaaaatagttctaaaaccagtcttccagactttcttataaagaagtcagaaccacaggctgccctggagcatgcattgtagggacattgtctaggcttaagttttgtgttcccatgtattccaagtccttgaatttggttgattcagaattctctatattattttgatttctaaatataacttctacttagcctttatgattctgaagattcctccccaagctaacctgtgtttaattcaaggctttactagagttttgcttgtagtttagatttttttgtggcccttccagtggggagtagtaaatgatgcctggtgtattttgctctttcctctttgttctctttagtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtggtgagtacctgatttatgaatggtcgaacacgcatggcgagaatagtgagatttacttggtcttagcagcattggtactttacatggaggaaggggacccttggtcacatcaccctacttttcaagctgggactctggatcactgtggctgtatggaaggttacagctagctgggagaggcatcaccttcttattctgctactcaggtattggtgaaaaacagccatgagtggtggagaggctgctgtctccagacttccagtacctggtacaagaaataccaggttaaacttctaggtgagactgatcatcttactctaatgtggttctcacaatgcaattgcaccaaaatcacctggaagcatttactgaatcaagagcttgccagatcagactttcagggttggatctctgttctgacataacatagaaaacagttggttatatgtagtagggtcacatccacacgcaaagtgtagttggtagaactgtatatctttgctctctgaaaccttactccaaggaagatgtgaaccccacacctgttgttgtttgtctacctttttaatagtttgttgtgtgtttgtgtatatgtagcacctaagaataaacatatgcagatatggcagtaatataatcatgctttatactgttttaggctcttttaaataaaatctttttgtgttatcatttggatatttttgacatttattttgtttatccaacatgatttaaatataagacatgctatgaacaaaaagcctcagagcattttgtgtatcttctgtttattcctgaaaataccttttggtttctcataattttttcctgctaagaatgcggtttctcctcattttaggtcttatagacttaaatcagggtctaacattgccctcctttgtatgaaaaatttaaaaatatttgtttgactatagtttttaagtctctttcatcttctgtaaccaaattctacttttgtgttggtttttcagaggggagaggaatacttcaagattttctaggtagaagaaggacataaggatgactcaaattggctgcttcctccttttaaaaaacaatcaattctgtactaatttgcacacagtatggatagtttatataattgcataaatgtgatcattttatgtatttcatttttatgacatatttgcttaaaatgatctgtgtaagtcatagggtataatatctaaaatgatcacctgtgaaccttccatcagggtttctttttaactccttgatctctttattggttttgttctgtatgtgttggtacttgtacatgtttatttctgtttcccttgatgccataatagagtgacagttttagacattggagtcccattgttttccctgagtaggttcatagttccatgtcattgcaaatcattaaggtctacattgaagtgtacttatgttcataatatgctcatattagctctccacatttgtccattctttctgccactctttgtcttggacattgcctgtaatctctaacctggatcattcagatttctcataatccaatattgattttcttataatccaatattgtcttgttccaaattattcccctttttattagagttgtattttttatgatgtatatctgatcatgttacttctctatctaaagtatgcattcttagcagggtgatattgaccctaaggaggcaaaaattgattttggagaaatgaaaatcttaggttgtataatggtttttagtcctccaaagggccatagaatataaacagatatgcactatatctatcatatttaaatttcatgatggggaggataaataatgaaaaaaatactgagagatactattctatagagacttcctcttgtccttaaaattaattaatttaggctttcagaacccattacgatctggacttagtttattgctctggtcacatttctttttttttttttttttctttcttgtttttttggagatggagtctcagttgcccaggctggagtgtaatgatgtggtcgcagctcactgcaacctccacctcccgggttcaaacgattcttctgcctcagcctcctgagtactgctgggattacaggcacctgccaccacacccagctaattttttttttttaagtagagacagttttcaccatgttggccaggctgatctcgaacttctgacctcgtgatctgcccgcctcgacctcccagagcgctgggattacaggcatgagccactgcccccggcccgctctagccacatttctcatgacttccctctccttgaatggtttctgccaaactgaatttcttcagttacataaattaaaagcacatacaggataatatgggagaatgttttcattacgtttgggtaaagatttctgaaacagaacgtagaaagtagccaaacctaagagaaagattgattaaaaaaaaatggatttcattaaaattaagaacttccattgattaaaagacagcactgaatgacatgccaagccacacagtagaaggagatatttttcatacttatattcgacgaaggacttttacacagaatatgtaaagaatacttaaaaatgtaaaacacttatgaaaaataacaaccaaaaatagcaaaatacttgaaaggcactttaaagatgatattcaagaggccagtaaacatattcaatttactgcattcattctgcattattagtaatcaggagacatgcaggtcagaactacagtgaaataccactataattaccagaatgaccacagtttaaaatactgacagtaccaaatattggtgaggatctgaagcaactggaagtctcatacataacttgtaggagtataaattagtacagttcctttgaaaaacaagcagtatccagtatagctgatctaatatggttgatgtatacaccatggttcagcaattcaagttctgactatatacccaacaaaagtgtggacataaatacactaaaagacatatgtaagaatgtccggaaaagcacatttataacctacaattagaaactctctccacagtagaacagataataaattgtagcattatgtatacagcagtatatagcatcagagaagatagaaccattgcttcactcagcaacttcagtaaatctcacgaatgatgttgagtgaaagaagacagaaagcagtatgtatggttctatttctatatgaaagttaaaagcaaacaatataaggtattggaagtcagaatattgttactttttagttctgcacttaggagttgtgttttctgtatgtctgcttcgattaaaagttttcctaaggaaaaaaaaaaaaggataagacttaatggttcaaaaggaagaccttgccgactgaggtgtctgagcgctcagcattgggaaatggtcgactcgtgggttgataaaaagaatttacagacaacagtataggtttgaaaaaggaaagtttattagaaagaaagtatgctgcagaagagtgcagaagggtgctgagcgtgccacagtggatttttccttaggggtatttatggaccttaaagcttgaggataatttggaccatattagccatgtaggtaacaataaatgattacatttgtagtaattttggttccttaatgtcagcaagtgttgcacagtgaatttcgacatggcattctggagatgtatagaaattctagttacttacaaagtttttttggggaaaaaatctggaaccaatgcctgctttagataatagggaagtctgattacttcttgggttttgttgttgttgttgttgttgttgtttttaatatggagccttgctctgtcgcccaggctggagtgtagtggcgcgatctcagctcactgcaacctctgcctcacaggttcaagcgattctcctgcctcagcctcctaagtagctgggactacaggctcatgccaccatgcctggctaatttatgtatgtttaatagagatggggtttcaccacactggccaggctggtcttgaactgctgacctcaagtaatccgcccgcttcagcctcccagagtgctgggattacaggcgtgagccactgcgccaggctgggaagtttaattacttctgattttccccagataaggaattttgcttctagattgcctgttggatagtcatcgggtggtttttgctccttctgcattcctcagataaggaatttttgtctctagggcctgttcagtggtcaccaagtgattttgctctcctcagatctcagcccatattttaaactgtttcccaatttaactatctattgaaatcaccattggaattttttttaggggaaaaattctttatttgtcctgggggaagaaaaaacaaaaaatgttattcttgaggaatttttgtgaaactctggatggggataagactgaattcagggatggattgcctaatccaaaatttatcgtgtgcagaggggaatataaaaagtcactaggacgatataagacccatatacaactctgtagcttgggcagcagacctggaagaagaggcaacttgtgggactgcctaattgtgcaactaattaggcagtaaagctcgatcctgaaatgtcttgaggaaatgccttctgtgctagatctcacaggcagctgggacagtgtagtagtatctactcctgcctttctcttagcagcaagacctgtaaagaaaagctcaagctttgctgaaataacttctaacaacaacgcctgtgttggttagagggcgggagcacagtgcatgctgttagagcaaatgcaaaaattaaatccctatagtaggtgatgatgctgcagtgatggctctccacctaggtgatgatactgcaatgatggctctccacctaggtgatgatactgcaatgatggctctccacctgtttctcacagttaacctgaatccatagctgagattaactgtgataaagaaaaatcactaacagatgaaaactttcagtgattcggagaattgtacctaagaaatctaaacaaatatttcctttaaaatgtcacagaaaaaaaaacaaggtaaaaaattgtaaggagggaataatttgaattccagaaacgttatcttcagatagtaaacatgattcctgaactgaatgggggaaaatggtggcacacagcagattgagtattgcaggttaaccagatctgtaagtaacaccgtttagttaatctttaagaataaagggctaaaaagatgaacatgaggtaaatggtaagagagaagaaaaatccaaaatattctatttagctgattgtagacaaagaattaaaattaaaattccttctacttgaagaataactcaagttcttagattaaaataccagaccaaattaaacaagagagtagagggaagccacatctagatgtgttctgagaaaagataagacttgacaagttttcagttaaaacacatgcacacaaatgtacacaaaacaccaagtcagcaatacctgaagagcagagaaacagctataacaggaggaatgtggttacttcacattactttggtgcattagatatcttggacaacacttgcactgaaactactaaaatgctggataagctttttattttatttattttgagatagggtctcactcactctgtcacccagactggagtgcagtggcatgattgcagcttactgcaacctcaacttcccaggctcaagcgatcctcccatctcagccccccgagtagctgggactacaggaatgtgccactacacctggctaatttttgtttttttgttgttttttgcttttttgttttgagacggacttttgctcttgttgcccaggctggagtgcaatggcatgatctcggctcaccgcagcctcaacctcccggtttcaagtgattctcctgcctcagcctccagagtagctggattacaggcatgcaccaccacacctggctaattttgtatttttagtagagttggggtttctccatgttggtcaggttggtcagctcttgacctcaggtgatccgcctgcctcggcctcccaaagtgttgggattacaggcgcgagccactgcgcctggcccacctggctaatttcttaaaaaaatttttgtagagactggatttcactgtattaccctggttggtcttaaactcctaggcttaagcgatcctcctgcctcggcttcccggagtattgggattacagtggcgtgagccactgtacctggcctggataagcattttaaagtgccatttatttatttaggacagagtctggctctgtcgcacaggctggagtgcagtggcatgatcttggctcactgcagcctccacctcccaggttcaagtgattctcctgtctcagcctcctgagtagctgggactacaggcacgcaccaccactcccagctaatttttgtatttttagtacagacagggttttgccacgttggccaggctagtctcgaactcctgacctcaggtgatccgcctgcctcagcctcccaaagttctggcattacaggggtgaaccatcgtgccccacctaaagtccctcttaaaatgtaaaagagttggtgcaaaactgaggaatccatggagctctgaagttgactgaaattcagggagggagattatgggagagaaggaagagtcaaagtaaattaaaggataacccaagcaaatgtagatttgccatctaaattcatattgaatatggtaaaaatacttagagaatttaattttaagaaaaattacttttcagagtccctggttggaaagatatgctcctcttgcccccagttgatgggcagaagcaaaagcaaatcattcagcctaggactaaatgattccaaaaaataaagtcaagtggaatatgtagtccacaaaaaaatctcaacactcacaaaagaaatgagaatcagaaacaatggatagtaggaatagatctgcaaaggcttcaaatattggaatgaaaggaaacaaaaaataagtttaaagaaaaagaggcagcttagaaatataagcagggaacacatttataaagaaccaaatagaacttctagaaataaaaagcataaattaaaacaatagctgcattcaacagattagatatcattgaagagagattaatgaactagaagacagagctgaagctctcccaataaaactttttgagatgctggaaatgtcctataatctgctctgtctagtgtggtagctgctggcatttgaaatgtggctaatgtaactaaggaaatgcattttttattggaattaagtttgctaacggctaccttattagatagtctaaggggagctaatataattattgataacattattagtgtcagctgtaattcagaaaagaagacagtcaatgttaatagtttaagatttcaacccaaatagcatcataagtttatacactgacataattttctgctccagtagatgaaatagaaaaacacaaaaccagaaaggtatggcagctttacaaagaaagcaaacctctgtgtgggtgaaaaaatgcaacaaaaatactgacagaatgctgtgtagatctgatgccatggacttgctgtattccaggtcatttttcattctggagaatgaaaaaaatgatatcagttacttcctgggccacagctttaagcaagctatggtactacacaatgacaaggctttagatactggttttgcaaccagaggactggaactgtaattgtcctaataccaacataggagtggaacttgaaaggtccattacaggaccctgtttgatactggtggccctgtgaaatagaggcaactgtaaaactgctctatgtgtgtatccctggctcccagttcagttcatagtgattagtggggcactcagacatatgttgaacaaatgaatggatatgcatggagggtaaacatgttatttcaaaatgagtctgcaaatcataattcttgaatactgaagtgtaatgctaagaaagcatttaacaaaatggaacagaaacttactttaagttgaaatagatttatgaaattgtctgaaatatgctgtaaaagaaaatcagtatatttaggatgctcaaggaaataaaggtataaattcaattaaaactgaggaagaaataaagtggttggaaatagaagtcttggaaatggaaaaatcatagctgttgatataaaagacacaacagacttgatgttctctagactggaaataattgaagacaaaattagggaaataggagctgagacgttcccccagcatggcacagattatatgaaaagcagtgaagaatcagaacagattgcagagttagaggttctaagatgcatgtaatggaaataaagaaggcaactctgaaagtggagaagcaatgtttacagagatcataggggaaagaaaacatttgagaactgatttagtataggttttcagattgaaagtgaagtctctttatcatgtaggataaacaaaggtataagcttaaaggtaaatttaaatataaatttaaaagtaaattttaattgatattctgtagttttgcttcagtgcataaatgataaacaaaggtataaatttaccttttaaatttatatttaaatttacctttaaatttatacctttgtttatcatcatttatgtattgaagcaaaattaccgagcaatatcaggaagagaaaacagattatctgttaaggattgataataagactaacagcagatttgttcccagccacaatagttgcaggaaaaagtggagtcacagcaccagagtgctgagggaaaataattgtcagcctggtcctaaagttttagactcagacactcaaatattcacagtaaggaagaaatacagttttaggaatgggaagactgagcacttacaatttatagactgctttgatccttgaatggtgtggaggttagggatgctgaccccctgtacagtcaaaaatccgcatataacttttgattaccccaaaacttgactactaacaaatagcctactgtcaaccagaagccttactgataacatagttaacatatattttgtatatgtattatatactgtattattacaatgaagtaagctagagaaaagaaaatgttattaagaaaatcataaggaagagaaaatatattatttatgaagtggaagtggatcatcataaagatcttcatccttgtcttcacattgaatagactgaggaagaggaggagttggtcttgctatctcgggtggcagaggcagaagaaaaatccatgtataagtggatttgtacagttgaaatctgtgttgctcaagggccatctgtacttgaccaagaagagaagttaacccagaagaaggatgtcacaggttggatgcctggaaagcaggcttttgagacagagataagagtgtaggaagttgactaggtagtgatcttgggatcaacactaccaatgagaaggaaacgagattgggcagaagaagttcagttgcagtgccatgtcattgaaggcctcagccaactctgtgttgacctgccttggaatgagggtcttggatttttattcacttttgtggatcagtcattagagatggactgtcccaggagggctaaggtggctgtctttagctgtggtaatcctgaagaggccgatagtaaagggttgtctgctggcggcttgccccacagtggaagaataagtccttccttcttaaagagggaatctacatagcacattgcagtatctgttacagaaggtgtgggatatggaaaacagcaatgagtttagaaagaggtgaactatgttacccatattaattcatgtttgatagtaaaatattaattgaggttggaagggaatggtgattaagatatgggccaagatagatgaggtaaatataaacaaaatgaaaatacttttggcagctttaattaggcaaggtagaattcaaggagaaaatgtcaacagagcagacatttttatatactgatgtagtcttcagtgaagttatattgttttaaacttttggaccaaagaacatattgagatacagagtataaacttttttaaaacttaaggataaattgataaaaatgtatatgtaatttatctcccagaattacttgattgctggtttctcttgggtagtatctgcataaatatctgtctacttatttatttacatttagaaaagcatatatgtacacaaataattttatacttataaaacatttatatatttaactgtagtattctgtgtagctatgccataatttagtcaattttcaagaattaatattttttctaatttttaactaatcatcctacactgactatcctagagataaatcttcagattatagactcacaattttttgtatgtgcttttactgtgtttagcaggctgtctgcgttgttactttggatctgaaggaaagaactatttcattatttgtaatatttcatctgtgaaaagaaaaatacttaggcaaatgaatctacattttaataatgttatttttatgttattttagccttacgaaggatgaatccaaaaggccaaagtataaagagcttctggtgagtgtgggactgtggggattgtaggtacatcctaaccccggaactctcttaacatgctggttcactaagcaagcagtgggcctctctgtcataaacaaacatctcaaatttattgagtgttttttgttaatgtttttacacaaagatttggaaagagaaaatttgcagttataatttttctactaatactagctaaattctcatggaaaattttggtcttaacatgttataaaaattacccccaaagaattctgactttaagaagccattttccactgcatagtctatttatatgggatgcagccataagaaaaaaattagtgaaaagtttgtgtttattctgcctttataaaattcatgcaaatttacgtcatatagcctattcccatttctttgaaagttctcattcatcccatggaacttgggtgttttaagcagtctactgggtatggcattggtggggcagggagaaagtgttgtgatctaataatgtgggaatattttaagaaaagatccatttgtttgtcacatttaactactagctcttcaaggatgttgtgacaaacttatatcacagtccaccaatgactgtaaaaatatctagtcaacatacttagtctgtaaaagaaaactgttgctagagatggagttttaaaaggtgggttagtgaagcagatactgggaccctggctctggagagtacagggaagaagctcctggggcaaatttctcttgggcctcttttggtcaaaagaattacagcctttttgttaaaaggtcaaaagaagaggtcaaaaggattgcgacctttttgtaaaaaggtcctcctgttgtatataggagaaatggaggttgagatttatattggtgtcccaagaggaatagtgactggcatttgcgtcattcttcttagctcttagatggtgtggtggaggctccagctatgttttgtgctgagtgacaacttggctgtcttcctcaacaaacactccctggtatacagatgagtttccagacctcactgccaaggtggcaccttcagatcattaccacgtatcctctctctaggcatgcccatgcccattagcatatctgcatggaataaaggctgtactcgcctctctgaacttgtagtgttgcggtatttcatagctatgtgtggttgggagcctggagttctatgttctatagaaattggaaaatgttcagtttgggctgtcatacaaacttttgacttttttgttttcaattttcttgcagaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatgacctccttttggaagtgttttatggctgctttctttttcttcttccttcccatggctaccctttttgcttatccttcttgaaaccacagatgtatctgttaagcatagctttgcttgaacaggtgtcacagtctcttgagtttctttgtttgttgtcctgacctgccccagcattcttaatgctaaaggaagtgggtacagttcttcaacctgtgtcatggtggagaggtacaacttataagtctatctgggccccgtgtatggtttccagccatgctctccgctcttggtgcttcagctgccaggtgagcattagatgtcaggttagatactgggttggaatcactcactgttaccttagaagggtagggaggattgtgggtagaagacgtctgggggtcagacatgggaggtttatggatgagaggacaatggaagtgaacaaaaagccatgggagcctgaaaactgttggagaaaagcactttgcggctccagcactgaatgtatctgctgtactctacctcctaccagtgattgatcagataacagattcattgatattatggtgattcagcaccttgcccttgtgcctgctcctaactgtacctgagatactattacacagccagatgtggtatcaaacattcccctgagaggggtgtgaaagcaggaattctggcctctccagctaacctcagctgctaagggaaagggtacccattgggtttcaatactggcatgagagatagactacacactccatgtttcataggacactgccttgtatttgttcatctcatttgattccaaatgcatcccactaaaatcaagtggctgtatccccttttagatacaagaaaaccaaggtccgaaggagtgaagttctggctcaaataacagtagggagcagagctgagattcaaattcaaggccgtaacacgtaccctaagaagttacattaatttaaaaacactgctattaaagaagtgttgtggagttgagaagtggaagaatgaatatagttgaggatactctgttcataaacctgaccagggcctgctttgttgttttggaaatgagttgaaggcagaggttctgggggccacagtggggcttaacatacaaagcgatccatacaaaggcaactgtgtaattaccttagaattaactagaggaactctaggttgtaattcttcagtgcaaacacctgagaattcagtgtcatggactgaacgtctccattagcatgataatgtggcaatcactgagaatgagtaaagtgccctttcatttattttatttattttttattttttgagacagttttgctcttgttgcccaggctggaatgcaatgatgtgatcttggctctgcaacctctgcctccggagttcaagcaattctgcctcagcctcccgagtagctgggattgcaggtgcacaccaccacacctaggtaactttttcttttcttttttttttttttttttgagatggagtcccactcttgtcgcccaggctggagagcaatggcgtaatctcagcacactgcaacctctgcctcccaggttcaagtgattctcctgcctcagcctcccaagtagctaggattacaggcgcctgccactacacccagctaattttttttttgtatttttagtagagatgtggtttcgccatgttggccaggctcgtctcgaactcctgacctcaggcgattcacctgcctcgccatcccaaagtgctgggattacaaagagccagcatgcccgacttccctttaattgattcgatccaactgtcttagctgcaggaggatagagaaaggacacataaggtcttgaaagtaccgttgggacactggttacttttcttggcagtgtgtagtgattatgtgtctccatctcttgtgcagggctgtctgcaccagtcacatccattgttcctgggcttattgcttgggatgtgagggacagagaatctaaaggctttgt

SEQ ID NO: 16598 - DNA, 10603 bp, Human
tttaacccattacatccaaaacatttaaacatatataaaaatttttaatgtgcacttcaatattctttttgaaaatttcttgtagtaagtccagaaataaaaaaaaagtccagctgatatatacttacagcacatctcaattcatatgctaaagttagagttcataaaatttaagttggaaaaacagattcatatatctgagttgttgcaaacacacttaaaagtattccaacaattgaatcgagcatcaggtttttggtttttgtttaattcaaattcaattaacgattcagtttttccgtctcaaccacatttcaagtgctgagtagccacatatggctagaggacagcctactggacagcacagcttaaggaggtacacaatgtacttatcagtcatcatctttctttttcctactgaatttacgtaatatttaaattgtttttctttgtcatatcctagaactcaaacgcacagatacaatggatacctttgattttctgcgtcgatggcattttgcatttaaaaagatcatctgggtggggtggcgcgcgtctgtaatcccagctactcgggaggctgaggcaggagaatcgcttgaactcgagaggcggaggttgcaggatcgcgccactgcactgcactccatcctgggcgacagagcaaactgtctcaaaagaaaaaaaaatcatttatcactaaatttactcaccaaaagaacttgcaaaaaaaaaaacccaaaaccctactgcctaaaatatattttaaaacgtatttgtgtttaagcagcatatatcttttgataaataatgacgcatggtagctaactagtaaagatgcagctttcatattagccacgcccatccctctctccgccctccacaagcacgtccccgcaagcgcgcaggaacatacacgcgtacgcgcgcacacacacgtacacacgcgcgcgcccgcgaacacatacatacaagcaggcgcgcccaaacgccggcagcacacaggcgcgcacgcgcttttcaggactcaggaaatgcgctttctgctccccgcgcccggtagagctaatgcagggaagtttctgggaacattcgaccagcgtttgtattggtgaggttccaagtttcctttaaaatgatatgactccgcccttctccaaaaccgtttgaggagaaatggaaaaggttgggcgtggaggtgaaaaggagccctgttgtcaactggtccgtactccacctcaggaggcggccaacttggtgcgcccaagaataaaaacatttcccttgtaagaacatgcaagtgtttagaaacgcccccccacccccccgcaaggcgtttgtgagggggacctgtcacagttgagaagtcaggatgggcgttttcctcccaggaggtgccctattaatttgcggcctcgatagttggtcaagccgggatgttagctgcggaacctccaggaccgaagagcgccaattctcctgagttctccttggtttgggtttcccacaaaagagtggtcacaccaaaaactctgtctccacaaatgcgaaacgggctcgaaacttttttttccccacacgatcacttcccacaccactcccatccctttatgtttcgcctcaggagtcgaggaacttctctgaaaaccaattctacgatattccagcagctaaacacagcccgaattccctagaaacagagagagcgagagaaaacactgtaaaccccaatcacacgctcctgttttcccggtactgaaaaaaaaaaaaaaaaaaaaaagtgggtccgtggccgcgctatgcatgctaggattagtagttcctccgtccctcatggcgcggggtcagggcggagctcaggttgactctgcagcagagaactacaattcccatggggccgcgcggcagaaagaaaggggcgggacgggagggggcgcgtcgcgcttgcgcaggtcccggggccggagggaggcggaggcgtagcggtccaactgctgaagtccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgtaagtaaaccgcgggaccgccctgccctcccgcccctcggtggggccccaggagccgggcaaaggcacgggttgtcggcggggtcccccagacaaccgcactggctgcagtgcggtctcgtggagtctgtgtttggaagcaaataacaaagtcgctgcaactcctaccgccaccccaacacacacaccacacacaggctgtcgttcccctcttctttcccaccctggcccccaacctcccgctgcctgcgtctctcccgcgcagtcttccctcttccttctcctctgcgaccgggacacgaaacaaaggggaccggcgcactgagggcccagagtagttttcttgcagcccggcagctcttctggaatggaggcgcctttgttttgctgcccaagctggtgtttggccccaggcggtactaaatcccgtcgtctaggagaaagcggaggaccttcacgaacaaggaagatcctgttcttttctgtgttccgtctcctccggagcggagtgagagggaagccgagctcacccgccgcctggcagtgagccggggttgtaaacggcgtttgcgctgtcagctccgagggcagctactccgatggtggggagcacgtagcctctgcggttttgccatccccttggcagccatcaggattttttgcacgtcttttcgtttgaccatctatgaggtttttagaaacagccgttgctacttttgggagatctggctagcggtaaatgaataacatggtatcgagaacctaccacaagtcctgcatatttttatcttgcgcttggcttagaagtaaatgtaaaagcctgttagctcagtccgtgtttgtttcaaatgctagtctacagctcgcaggagtatatgtaattaaagtttttgaaaagtttatttgtgacactttttgcccgtttaaacagttttcagtgttatccatgagaaactcttcaggtgaacttgcataatttcagattgttttggaaaaatgtgttatagataaatacattgatttaatattcagaaaaatgtataactgaaatttaaatatagttttgaagtcgatagctcatttgtgaaaacgaatggttttgtatctggactataatttgggtattcagttagaaagactggaaagcatacattatattactaaaatatgctgttcttttaagtagagaaagtactgtcaagtagcaaaactgtgagcaacatcatctttcccctcatcagttaaaaattcaacatgaactaattcaggtcatccttactgctatctatctgtttgtttatttatttaagacaaagtctcactctgttgcccaggctggagtgcagtggcgcgatctcggctcactgcaacctccaaccaccaggttcaagtgattctcctgccatagcctcctgagtagctgggattacaggctactgccaccatgcccgcctaattttttgtatttttagtagagacgggatttcactatgttggccaggcttgtgtggaactcctgagctcaagtgatccacccgccttggcctcccaaagtgctgggattacaggcgtgaaccaccgcgcccagcccctcactgcaatttgatgacaaaacccagagggttggaatttctcattctcctctccctccctcccttacccccttccccagatggaaccaacccctccttccccatccaccatccttttaacagtattccagacatcttatgttttagcgtataggatttaaacgtataaatattccattatcttaacaatggcccatcttggctgtctttatttttaagaactcactgtggcatatgtgttttactaatacatagacacattttactgtaatcataagcagtgtgtaaaacttttctgtttcaggcaaggcatctttacatatgtgattatcataaaaacttaattcagagtgttcgaaacagaagaaagagaaaagggagtgatgatgatggaggtgattcacctgttcaagatattgataccccagaggtagatggaagttttttatgcttaatgtaaatcctaagtagtgcattctgaagcctttataaaaagatatgaacaatcttttaagtgtttaaaacatttgagaaatctgaaaatgaaagcaaaattaaatatagccagttgacatgcatttacacagtttgaattgttacattttagattgacaatttttgcagctctgttgtcacataacttactctttttttgacctcagtttatattatttatccccaaaagattaaattctttaataatttatgttggattatataaattttttaaattttttttgattttggaagtaaatttttattgtgctgaagttaaaatgtttgttattatacatatcaatgataaattttcaacaaattgtatgaactcatttatacatgttaattttttctaggttgatttataccaattacaagtaaatacacttaggagatacaaaagacacttcaagctaccaaccagaccaggacttaataaagcacaacttgttgaggtatatatgagttttaaactatttgaactatctgcacaaccgagaggttattaagtgctaatggaagttttaatgtagtgtatgtaacagtacattttaattagaaagaacaaagttaaaaaatctgttgtggaagaatctagttgtgtagaaatgtttgtctgccacttaggaaattcctttttgtaatgactgcttagtagattgtgtacagcaccttctgatactggctttcaaaatgtgttgattgttttttgagacagaatctcactctgtcacccaggctggagtgcagtggcatgatcttggctcattgaaacctctacctaccaggttcaagcaattctccagcctcagcctcccaagtacctgggacttcaggtgtgcaccaccacaccaggctaatttttgtataatatttttagtagagatagggtttcaccatgttggccagacttgtttcaaactcctgacttcaagtgatctgcccacctcagcctaccagagtgctgggattaccagtgtgagccaccgtgcctggccctcaaaatgttgaatgagagtttttttaatcctcactttagaaatctattaattttaaaactccgtttaaccagtaaacatttgagcacctaattgaggcataataaaattaattaacaagctttaatgtccttattagaatttatattttaaagtggtggaataggcctacaaatcagaccctaaacagtatttttataatttgctgacttaactatttcaaaatttgtccttgttgatgtttgttttattagagacatccatgtttttttcacatctagaagaggcaaaagcttttcttttacccaagcttttacttgtagtttgctttgatagaggacttctagtcagtcactgagttgtgaaaagttaacggagcatgcatatgttttcaggatataatagaaccaagaaatctgtgcatcttattaagatgtttatagatttatatatatatatatattttaatcatatttaaaataaaaatttttacttgcagctactgaggaggattgattaagcctaggagtttgagtcaccatgggcaacatagcaacactccatctctaaaaaaagaaaatttggcctactagacaaaatagaagtgtagaaatataaatcagttttctcatattctttgcatggatttagtagttacccaacattttctaaaatgtgcctattgaataaaatgaaatatgaatagaagttacatttatttggcagaatgctttttaacattgttaaaatctaatatattaactatttagctaaaattttttatccttggttgggcaacacagatctaattaatttttctttaattttgatttaaaagatcaagttcttttggggttgtacaatacattaatgtaacataaatatagttattgcccaccatgatgaaatatttcaataggtactaatggagtgaaggcacccctgttttgggacaaatgagaaccaaagaactgattattttaaatgttatatttaggtataaattaaacctgtaatttttgataaactgaccttctaagaacagttatattatttccagagctattttcttttttatacataagagatagccatgagtgttatattttacttaatcagaaatgcagatattagcaagttaaggaatgtgcagatgtagtacatatattttaagagaggggtccccaaccccagggccatggactggtactggttggtggcctgttaggaacgggtccgcagagcaggaggtgagcaccagctagcaagcattactgcctgagctccgcctcctgtcagatcagccacagaattagattctcagaggagtccaaaccctcttgtgaagtgcacatgtgagggatctagattgtatgcttgttataagaatctaatgcctgatgatctgaggtggaacaatttcataccaaaaccaactccgccaccctcaatctgtgcaaaaattgccttccgtgaaatctatctctggtgccaaaaaggttggggaccactgttttaagggaatccagggttgtatgactaagtcttaagtctcttaattattgtgtggatgaacttttttcttaagaaattttattttctggaatctaaatatgcatgtcagcaccccaggtaagtctattattcttctattagtaattgtagtatgcatgttatgttagcacaatgaaaaggcaaggaagcaggtaaacatccttcattgaacatccctctttctcctctcatttccattcataatttttattcagaaaaattttcaaggaaccttaaccaaagaatgctaccaaggtgtgaatgaatgaatataatttgcagcaaacaatttatatgttattgttggtttctctactagcaaaagttttcaacttcatacttctttttctatcagtagagtctaaaccattgcaggtttaatgatgcatgtgatctcttacatctgttttatctcatttaaagtttaaaagtaaaatcatttattccctattctagattctaattataaaatttattatttttattttatttatttatctttttttgagacagagtcttgctctgttgcccaggctgaagtccagtggcatgatctcagctcactgcaacctccaccttctgggttcaagcaatcctcctgtctaagccttctgagtagctaggattacaggtgtacaccaccacgcctatctaatttttgtattttttttggtagagatggggtttcgtcatgttgctcaggctggtctcaaactcctgggctcaagtgatccacccacctctgcctcccaaagtgctgggattacaggcatgagccaccacgcctggcccaattataaaatttaaaataaataaaaggaaaatatattttctaatcaatgtatattaaattgagtgggtcaaagggtcctttgaaatcacactatctcttgttcgtaacattttattcttgaatgctttctgtcttgttgatattttgttaaatataatttttaaaggaaatagcccttatcacatagcactttttcttttgatgaaaccgtattttttacgtagtttatgaaacctgttatatctaaaatttaatttccttaatttttcttttctttgtagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaagtgctttatagggctagcaaatttgaaaaataaacttctcttgtaatgcaacttcttttttatttccttttttttgttattattacttgatgaagtactaggaagaacaaatggtttaatttatatacccacctccttccaaagaagacttaatgtgccagcaaagataaacacaatgctgaaagttgaaataagagtataaaattaaatagctgtttttcaaaattttgtcttcgagaaaagatatttatgtggcatgaatatagaaagtacctctgctatgccccttaatttttagtgatgtcctgtactgtttacattgcaaattgtaactaataagttggagaggtctagatatctatccagatcttcatttaaattttggttatatatggctctgacttgatttatatctcctttttatgtttcattctctgtcagttttctatcaaacattctaaatctctgcttttcttgagattatattgtttagctaaattcttataattacaaatcaaatttatagcttgtgacataaaaaaacgagcttcagcaaactgttctgagataaagctgcagattttaggctggaaatggatgagaccattaatgtagctcatgatttctcaaagttgacatttggacttgttaattctttttttgtgtgaggccgttcagtctattggaggattagcaacatccctaagtccactcagtaggtgccagtagctcccccaaggtgtgacaaccaaaagttcctctagacactgccaaacatactttgagggtcaaaaatcacagctagttgagaaccactgatgcaactaaagtactacatctaaagtactagttcattagtaggtgactgtgcatattttcaagtgttcttaatgtattgacagctagaaaatataatgaaaaataaagcaactggtcgttggttttgctatgaccatttaaagatttacttgctactttattgacaagcagagtctgtgataattgctattatagaaacttctcatttccgacattctggaaatctgtgagaagatttcttatagaaacacattttgaggccgggtacagtggctcacacctgtaatcccagcactttaggagaccaaggtgggcagatcgcttgagcccaggcattcaaggccactgttggcagaatggcgaaaccctatctccacaaaaaaatacaaaaattagataggcgtggtggcatgcatctatagtcccagctacttgggaggctgaggtgggaaaatcacttgagcctgggagacgggctgcagtgagccacgattgcagcaccgcactccagcctgggcgttggagtgagaccctgactcaaaaaacaaaagcaaaaacaaaacagaaaacaaaacaagacccatattctgttcttgtgaaaaaaaaaaacaacttgaaattatttgctgacataaaagtatgaacataacctttgactggcaatgtttatttcatataattatttgtataataaaatgtagttttataaaatatgaagagttctggatggtagttattaaatgaaatcaaatccttgttaaaacaatttaaaatatgaaaaatcagttcttgtaagttgagaacttccagaacctcaccaaagctgagtaactcaagaagctgcaatgtaaaagtcagttttatatgaaaatttcagttaccattggattttttaaatgatggattcattagaaactatttttacttatctatatctgaacaaaaaatga

SEQ ID NO: 16599 - DNA, 8661 bp, Human
tatttttgtccctctaaatttttgaggtcacaggctatgacttttcatctttgtatctcgactgccaagctcaatgcttggcatattcaatacacagttcttgaataaaggcccagtttttatataagcacagcttactttatgccataatttaaaaaaatctaaacagaaacttaaaaatacgttttaaaagtgtaatgcattagtgatctcactgctaattgctatttgaataaagtactatgaattacttggttaatttggatttttgggtgcttttataacacccttgtaactaattttgtaggtattacaacttaaggcagaaaagagaatgttataaactaaggtttttgattaacaaaattctgggacccttaaataaaaggaaatacatttttttctgtttgaaaaactgccactttatttttttgtggtaaaacatacataacataaaagttaccattttacccattcctaagtgtacaattcactggcattaagtacattcacaatgttggacaaccattatccatttcctaggaaaatacattttttttaagatcttttttattagtaaacctagataaacaactgctggttttcaaatactattatgacaaccatatacaaaccaaagagcatagtcttaacatgtgccaacgaacttactgaaaaattaagacaaaatatttaaatttcttgaaacagtcacgcaacctatattccaataatggggggaatccctcaaaactaaataccacagaaatagcacaccaggatgtcaattaaagtcctctaccttgggaaaagcagcttgtgacgctggtaagcagtaaggtaaggtagctttggcgcgctctccctatactaacacggaggttcttaacccaagcttggaggagcctgtaacgtggctgtatgccgtttggagaatatacgcaattgggagtgggatagggagcatgcattgcttttatgcgattctcaatttttaaaaactatcacactagtaggacgagacagtgaatgcccaggcgaaggccaggccagccaaagacagggcagccgccggctccgagctcccggcgcaccgctgcagggtgcggcgtgggggccgagacactcggggcttggaattccggacccggtaggagggggcggggccgggggagaaggcgccgcctccgccccttcgggacccggagggtgcccttgtttacctcccagtatttgtcacccgagacaaagagggaaggaaggaggagccttctgagggaaactccctcggcgggaagcatcttactttcagaacgttttttaacaccctacgggacgcgggaacggttccctcccggccccccgcgccctttccgaggttccctgccttgacttccccgagttctacgacaacctcagcgacagcgggaggagctgggcaatcggttttgcagggcaaactccaggctctcctcatttattattctctgggcggcgcacgggagaccctgcagggcaacagagcagagcgactacagctcccaggagccaacgctgcagggctgagccgacgcgggggacagacaggacctaaatggtggtcggaggaagggcaaggcagacctcttctgttaccttagcgccagcaaaccgagccgccgccgtcgccaagccaggagaccaacccccagtctcccgactaagtatttttaaatctggcggggctttccttcccgagccaaccactcccaccgtttacagccccaaccagtcagcgtgaggcccgccatttttcaaaccctcttcccgccgccaatcaggatcgagcagtacattcctctcctgaccggttctaacgggtctgggagttaacgacctgggcgacccaccgaacctgctaggctggggcgtggagggcgggtctggtaagacactgaccaatcgttagcctccgtggcaagggggcggggactatctgggtttgaataatcgtcagaaccaatcagattagtggggatgtggcccgtggcctagctcgtcaagttgccgtggcgcggagaactctgcaaaacaagaggctgaggattgcgttagagataaaccagttcacgccggagccccgtgagggaagcgtctccgttgggtccggccgctctgcgggactctgaggaaaagctcgcaccaggcaagaataccctccaataccctcgggttcgtggacctgcctttccccattccctcagagcctctactcggtctcggcgcagtggctctcggggtctgacccggcgagcggcatttggggtgcgggccggcgagggctgggtctgtggagggccggcgggcagtcggaggaggcggaaactgcccctgaccgggcccggttctgggagttttcaatgtcggtcacgaggtgcttagcggttaagtgaggctcgcgacgtgggagctgggggacatttctgtcaggaaaggcgttttgagggcgcttgcggagtcaccggactcggtgaagggcgggcggcggcgtctcgggccccgggagccacttgctgggctgagccgcggccgctcgggccgggaggaggaggaggaggagggtgtgcgccggggcgcgggcgggggcgcgggcggccgcccttgggaggacgccctcgggaggaggggggcgcgggcagggcgggagcggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaaggtgaggcaggagagggacggagctcagggggtgcaggtgtggttttcggctaggagggccttaggcaggtagtaggcaactcatgagcttcaactttgccaccccagtgactcacctgaatatcttaagagttccaggcagacgattttaggtttttacttatataagacttcgaaagcaaaatgctgttaaggaaaatgtggtccttaaagatgatcttgtcgtctttggatgtttataggtaacaattttgctgtatttttggctcttattttatgtccacagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccgtaagtttaaaataacccaaattgctccttggatttttccttcagtttattaaactctgttgcttcctttcagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggtacagtgtcatcttttttaaagccgtggataagactaggtataggtaataactgtagaaaacctgggaaatttagttaatcttgtattaatggttgtcagctatgttttgaaaaggcctaatgaaaattgtacacttcaacacaaggtaattgaaaccttccttttgactgaaaccagtgtttgtagcactagtatattcctgcagacagacttgtagttacttgtagttattgtatagtctgtatagtctgttatttttttttttaagcagagagtcaaagaaattgttttatgtagatatatataaaatgtgaaggtacaggagggactatggcactgtgtgtgatgtaaaagggtattggtagtgaaagtactgatactgctgtatcgcaacccttgtcattttacgtcattaacttgttaaagcctagtgggataagtgctctaaaaacttagactggttacctttttagacagttattagggttattggtcaatcatcttagattgtttacaactaagtggtttttcacagttgagtaatgataccggatgctttatttttttgacaatatttcaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatatgtatatatatacacatatatacgtatatatacatatatatgtatatggagtctcactctgttgcccaggctggagtgcagtggcacgatcccagctcactgcaacctccgcctcccgggttcaagcgattcttctgcctcagcctccctggtagctggggctacagccatgtgccaccaagcccagctaatttatatttttagtagagacagggtttcaccatgttggtgaggctggtctggaactgacctcaaatgatctgcccacctcagcctcccaaagtgttgggattaacaggtgtgagccaccacgcctgtcccagtatattgtttaacaagtttattttgggtgaaaaattctctttaatgggaagaagaggggctagaatgtgaattcatatctaaaaggacaaactgaaacaaaattcaataacaagattaagttttctgctattaagttgagctgtttcaagatagaataccggattaggttttgagttacagtagtccctccttatctgtggggtgtaagacctacagtggatgcctgaaagagccaagagtattgaagccttgttttttcctatacatacgcaactgtgataaagtttaatttataaattaggcacagtaagattaacagcaataatgagaacatttataactagtaagttttgtgaatgtggtctgaaaatactgtactgtgggaaagtgaagccatggtaagggaggattactgtatatcttcattttggtcttaagctttagaattatgggtaactaagaagccgtttgagatggttatattccatgactaaacttacctgggaattgtattatttacggggaaggcagttattttaaaaatgcttgtttaaggaagcagttgctgtatttgaattaagataactttcattagagattattagtgaaggttggccatctggttggctatgtgcttatagaattatagaagtaagctatttgttgacaattttagagttaaatttgacaatcttggttacctaccaaactttaaaatagaagtcaggatttctgttacccaaccatgggagctttggttgtctcatattcggtaagataattctctgttaaatagtggggtattagaacaaatggacttaagtaaaatcttcaatcatctttatgattgccctctattaattatattctgagtgggagagacctcccaaagccatgaaagaattgataaattggcctacataaaaataagaaatcttacattcagacttggggctttcacttatcataagatgaaaactaattttcagtgtttcctggtggtagatgacttaatatgctaaaacatttggggtaatctattttagatactacctatgtctgagacccagttccctacctctaccaaatgctagcagtatgaactttacctacttcacagtgttttaatggtcgaagtgttattttaaagtagtaactactgcataaaggatatcgaataagagtttctaaaactgaaatagagtaagtaagtttgtttatttaagaatttctaaataaattagatccaagaggcagacctgttgggttccttgtcacctttctttttgggagtctgtgacttctttcattatcttttccataaaatatacttttaagtttctaagctaagaactattcttttaatcaagagttcctccagaatgaactcaggatttgagatggatccttcctggctcatgtttgatattcttgtaagtgtggatcaaaattccccaaattctcaataatcaagaccaggtgacttcaaggagtgaacatattggaaagaactaaaatgagggcaagaattagatctcacaccagccactacttggaagtgtgtttgtgaaacctgttttctttttaaaaatagatcatatcttaatagttcagaatgtaaaaggatatgtaatagtttatactctttcttgattctgctaccctgtcccaggaggcaacaccaacaatgcaataatctatcctttaagaaagacataggtgtaaaaaatatatatgtgtgtatatgttacagtgttacatagaagcttcctatatacaagtgtattcatctcattattttggagattgttttcagtaccccagagcaacagagctgccattttcctttaaatagctatctgtatggtatcccattgaatagatcataatttaaccagttccctaaggataataggataattatgggttttgttttgtttttgttttatatacatattttcttttttttttcagacggagtttcgctctgtcacccaggctggagtgcagtggcacatctcggctcactgcaagctccgcctcccgggttcacgccattctcctgctacagcctcccaagtatctgggactacaggcgcccaccaccaagcctggctaattttttctatttttagttagagaacacttgctgggtatggtggctcacgcctataatcccagcactttgggagtgtgaggtgggaggctcacttgagcccaggagtttgagactagtctagtcaacatagaccttgtttctaccaaaaatacaaaaattagccgggcatggtggtgcatgcctgtggtcctggctatttaggaggctgaggtggatcacttgagcctgggatgtctaggctataatgagctgtgatcatgccatcgcactccagcctgggcaacagaccaagacttggtctgaaaaaaacgaaaccatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgttattctgatatagataaaatgttttctattatgagtttcattttttttttatgtttaacagccatttgtggggctgagtgcagtggctcatgcctgtaatcccagcactttaggaggccgaagcaggcggatcacttgaggtcaggagttcaaaaccagcctggccaacatggtgaaaccctgtctctactaaaaatacaaaaacattagccgggtgtggtgatgggcacctgtaatcccagccacttgggaggctgaggcaggagaatcgcttgaacccgggaggcagaggtttgcagtgagtagagatcacgccactacactccagcctgggtgacaagagcaagactctgtctcaaaaaaaaaaaaaaaaaaaaaaaagccatttgtattctttcctgtggtcttttctcactggtctttttattaatagtttttgggaatactatatattaaggaaaatgacccttttgactttatgatgcttttttcatgcagagatttctttatgtaggcaaatttagcaattctttcactaaaactt
